United States Patent 9,290,773 (TRANSGENIC PLANTS WITH ENHANCED AGRONOMIC TRAITS) - sequence listing, part 5

SEQ ID NO: 18631 - protein, 702 aa, Drosophila melanogaster
MATTPTAGPAAAPPTSSTPQNYKVPSTSKISVDKLLRVGYYELEKTIGKGNFAVVKLATNIVTKTKVAIKIIDKTCLNEEYLNKTFREIAILKSLRHPHITRLYEVMESQSMIYLVTEYAPNGEIFDHLVANGRMKEPEAARVFTQLVSAVHYCHRRGVVHRDLKAENVLLDKDMNIKLADFGFSNHYEEGATLKTWCGSPPYAAPEVFQGLEYDGPKSDIWSLGVVLYALVCGALPFDGKTILELKSRVVLGKFRIPFFMSQECEQLIRNMLVVEPDRRYTIKQIIKHRWLSEWQSEMQEQERFGDMSPGSGTVSKSASTSSLGSASDSPPQLDSVVMTHMLQLPGLTADMIAQSVHEQRFDNIYAIYNLLHDKLQQRRRENQRLQHHASLAYSRSRKTSITTGVVDRSEPVKQESLDRLSPLSNANASSSALGFGWSDVAVDLEKYGDFELECLARSNDPPVNAQHLSAHAGGGVNGANTRRHTVGPGDVAHEQALANPNVPPIDFKCPPQCSDPTQPVPYYPVNLPMLQNQPLHNLTIKDQHLLKPPVVMGASSFGRRASDGGANLHIYYPATGTVVGPAQGQQMDTAGYYINPNCGTDPLAVQELSPLNEQSVAQMQCCQENATGECNEELQSYMQKRGGTQRHTVGCTEDLSVAHGSGAGSQSQAPTTSSNMRQRRTGLLTVTERPPGALERLTKIL

SEQ ID NO: 18632 - protein, 1098 aa, Drosophila melanogaster
MEATTTTTPDLNRGDATRKSVRLYAARKGAAPAPPKLSVAPSSNQNSNHSSNNNNSSSNLPETEKEMELRQTHLANKDLDGATEDDSIVELRRRDAQATPLPRIAVSALPTLQPHPTPKERQKPPMPRLLSTEDDAGVSFALGSIEKHIHNVEESFKQQQQNQQSQSSMDVMKLEIKRKQSKRYGETENLLRPGISDMSSENDFQYLGGRRAGELDDSNELMLSEFQRGSDGRNSIGAYSKNSAAAANGANAVKAKLARTASDTKNNDTVLAMRATFKQKQHLQDEKQPAVWRPAGTGPTPAARSSSSTTSTSGSASRGGSSSSVVDGVAPSKLTATTISASKRREENLRQFEALLAQKSSHRHGASGASGTGSNAASSKRRSDRPIVAPIPPYNSSRAEHVTSSTRHSVDPRSHSGHESRSGTASTHPPVGHHPTSRVPSVVANRSNVYSNNAAQGSPNMQMRSSAPMRWRATEEHIGKYKLIKTIGKGNFAKVKLAKHLPTGKEVAIKIIDKTQLNPGSLQKLFREVRIMKMLDHPNIVKLFQVIETEKTLYLIMEYASGGEVFDYLVLHGRMKEKEARVKFRQIVSAVQYCHQKRIIHRDLKAENLLLDSELNIKIADFGFSNEFTPGSKLDTFCGSPPYAAPELFQGKKYDGPEVDVWSLGVILYTLVSGSLPFDGSTLRELRERVLRGKYRIPFYMSTDCENLLRKFLVLNPAKRASLETIMGDKWMNMGFEEDELKPYIEPKADLADPKRIEALVAMGYNRSEIEASLSQVRYDDVFATYLLLGRKSTDPESDGSRSGSSLSLRNISGNDAGANAGSASVQSPTHRGVHRSISASSTKPSRRASSGAETLRVGPTNAAATVAAATGAVGAVNPSNNYNAAGSAADRASVGSNFKRQNTIDSATIKENTARLAAQNQRPASATQKMLTTADTTLNSPAKPRTATKYDPTNGNRTVSGTSGIIPRRSTTLYEKTSSTEKTNVIPAETNSGSAAPAGKGHTKSASVSSPRPSTDGCVSVSNDPLGTRMASAVKSSRHFPRNVPSRSTFHSGQTRARNNTALEYSGTSGASGDSSHPGRMSFFSKLSSRFSKRPNQ

SEQ ID NO: 18633 - protein, 1033 aa, Drosophila melanogaster
MEATTTTTPDLNRGDATRKSVRLYAARKGAAPAPPKLSVAPSSNQNSNHSSNNNNSSSNLPETEKEMELRQTHLANKDLDGATEDDSIVELRRRDAQATPLPRIAVSALPTLQPHPTPKERQKPPMPRLLSTEDDAGVSFALGSIEKHIHNVEESFKQQQQNQQSQSSMDVMKLEIKRKQSKRYGETENLLRPGISDMSSENDFQYLGGRRAGELDDSNELMLSEFQRGSDGRNSIGAYSKNSAAAANGANAVKAKLARTASDTKNNDTVLAMRATFKQKQHLQDEKQPAVWRPAGTGPTPAARSSSSTTSTSGSASRGGSSSSVVDGVAPSKLTATTISASKRREENLRQFEALLAQKSSHRHGASGASGTGSNAASSKRRSDRPIVAPIPPYNSSRAEHVTSSTRHSVDPRSHSGHESRSGTASTHPPVGHHPTSRVPSVVANRSNVYSNNAAQGSPNMQMRSSAPMRWRATEEHIGKYKLIKTIGKGNFAKVKLAKHLPTGKEVAIKIIDKTQLNPGSLQKLFREVRIMKMLDHPNIVKLFQVIETEKTLYLIMEYASGGEVFDYLVLHGRMKEKEARVKFRQIVSAVQYCHQKRIIHRDLKAENLLLDSELNIKIADFGFSNEFTPGSKLDTFCGSPPYAAPELFQGKKYDGPEVDVWSLGVILYTLVSGSLPFDGSTLRELRERVLRGKYRIPFYMSTDCENLLRKFLVLNPAKRASLETIMGDKWMNMGFEEDELKPYIEPKADLADPKRIEALVAMGYNRSEIEASLSQVRYDDVFATYLLLGRKSTDPESDGSRSGSSLSLRNISGNDAGANAGSASVQSPTHRGVHRSISASSTKPSRRASSGAETLRVGPTNAAATVAAATGAVGAVNPSNNYNAAGSAADRASVGSNFKRQNTIDSATIKENTARLAAQNQRPASATQKMLTTADTTLNSPAKPRTATKYDPTNGNRTVSGTSGIIPRRSTTLYEKTSSTEKTNVIPAETKARNNTALEYSGTSGASGDSSHPGRMSFFSKLSSRFSKRPNQ

SEQ ID NO: 18634 - protein, 706 aa, Drosophila melanogaster
MQMRSSAPMRWRATEEHIGKYKLIKTIGKGNFAKVKLAKHLPTGKEVAIKIIDKTQLNPGSLQKLFREVRIMKMLDHPNIVKLFQVIETEKTLYLIMEYASGGEVFDYLVLHGRMKEKEARVKFRQIVSAVQYCHQKRIIHRDLKAENLLLDSELNIKIADFGFSNEFTPGSKLDTFCGSPPYAAPELFQGKKYDGPEVDVWSLGVILYTLVSGSLPFDGSTLRELRERVLRGKYRIPFYMSTDCENLLRKFLVLNPAKRASLETIMGDKWMNMGFEEDELKPYIEPKADLADPKRIEALVAMGYNRSEIEASLSQVRYDDVFATYLLLGRKSTDPESDGSRSGSSLSLRNISGNDAGANAGSASVQSPTHRGVHRSISASSTKPSRRASSGVGPTNAAATVAAATGAVGAVNPSNNYNAAGSAADRASVGSNFKRQNTIDSATIKENTARLAAQNQRPASATQKMLTTADTTLNSPAKPRTATKYDPTNGNRTVSGTSGIIPRRSTTLYEKTSSTEKTNVIPAETNLFDRLRMASAVKSSRHFPRNVPSRSTFHSGQTRARNNTALEYSGTSGASGDSSHPGRMSFFSKLSSRFSKRPTIADEAAKPRVLRFTWSMKTTSPLMPDQIMQKIREVLDQNNCDYEQRERFVLWCVHGDPNTDSLVQWEIEVCKLPRLSLNGVRFKRISGTSIGFKNIASRIAFDLKL

SEQ ID NO: 18635 - protein, 565 aa, Drosophila melanogaster
MQMRSSAPMRWRATEEHIGKYKLIKTIGKGNFAKVKLAKHLPTGKEVAIKIIDKTQLNPGSLQKLFREVRIMKMLDHPNIVKLFQVIETEKTLYLIMEYASGGEVFDYLVLHGRMKEKEARVKFRQIVSAVQYCHQKRIIHRDLKAENLLLDSELNIKIADFGFSNEFTPGSKLDTFCGSPPYAAPELFQGKKYDGPEVDVWSLGVILYTLVSGSLPFDGSTLRELRERVLRGKYRIPFYMSTDCENLLRKFLVLNPAKRASLETIMGDKWMNMGFEEDELKPYIEPKADLADPKRIEALVAMGYNRSEIEASLSQVRYDDVFATYLLLGRKSTDPESDGSRSGSSLSLRNISGNDAGANAGSASVQSPTHRGVHRSISASSTKPSRRASSGVGPTNAAATVAAATGAVGAVNPSNNYNAAGSAADRASVGSNFKRQNTIDSATIKENTARLAAQNQRPASATQKMLTTADTTLNSPAKPRTATKYDPTNGNRTVSGTSGIIPRRSTTLYEKTSSTEKTNVIPAETKSNQSTKQHSAGILGHQRCLRRLLPSGSHELLLQTLLTF

SEQ ID NO: 18636 - protein, 521 aa, Drosophila melanogaster
MNNLADTVVVDPGFGGGDKQQQAGPAPQDASVVVPPPATKQSSALKKTSRYRSRSLSASSTDSFSSASYTGSSEDGDDVPPREKVQKNSKGSSDFCVRNIGAQHAFGRREIEIAEQEMPGIIALKKRAAEDKPLKDAKIVGCTHINAQTAVLIETLVELGASVRWAACNIYSTQNEVAAALAESGIPIFAWRGETEEDFWWCIDRCVNAENWQPNMILDDGGDATHLMLKKYPTMFKLVKGIVEESVTGVHRLYQLSKAGKLTVPAMNVNDSVTKTKFDNLYSCKESILDSLKRSTDVMFGGKQVVVCGYGDVGKGCAQALKGQGCIVYITEIDPICALQASMDGFRVVKLNEVIRNVDIVVTATGNKNVVVREHMDKMKSGCIVCNMGHSNTEIDVNGLRTPDLTWEKVRSQVDHIIWPEGKYIILLAEGRLVNLSCSSIPSFAVSITSATQALALIELFNAPPGRYKSDVYLLPKKMDEYVASLHLPTFDAHLTELSDEQAKYMGLNKAGPFKPNYYRY

SEQ ID NO: 18637 - protein, 469 aa, Drosophila melanogaster
MVAAKYERLNTSGEAAGNGNGNASDAEDEEIELHLAQKTQLGNGHRLRQSNFKYASGKCGSGEAPCTNETATLAQENMMMQMAVGTLAIIFLYLALSISLTFYQTDINRQMPFPLAIVTYHLVVKFLLAAAARRIYRMRVGRSRVQLDWRLALRKMAPTGVASAIDIGFSNWGLALVPISLYTMTKSSTIVFILLFAIAFGLEKKSWYLVSIVGLIGTGLLMFTYKSTDFNALGFFFILFASLSSGLRWSFAQFIMQKSKLGLHNPIDMIYYMQPWMIASLVPLVIGIEGAGLIAVIEDLHNHTSNEITWAIARISAGALLAFLMEFSEFLVLCKTSSLTLSIAGIFKDICQLALAVTIRKDHLSVINYIGLIICLAGIVCHLLHKYSNMKEMQRQQELQLDNDQEESSPGEYKFNDGSAIVGVHVKSHSTLTVPLLEQTDSEDESGASNKQNASDVIFDVLKRRDMQR

SEQ ID NO: 18638 - protein, 509 aa, Drosophila melanogaster
MAELISQPTKINNNNFGAGVTMREKKGGALQKLKKRLSHSFGRLTISREDGDESTHHHHHHHHHRGGHGGHHNHGNKVPYNGYNSEEYLDRLEPNGNIPADKTNCRYGDWRSTDSTDHHDRVQRQLSVSSDSKLLDEDIREEMKYHSHVVMRPKKPPRPKSEVFLNKQETHPRRKRFSAFGGDSPFGKQEAYVKLEPLGEGSYATVYKGFSKLTYQRVALKEIRLQEEEGAPFTAIREASLLKELKHSNIVTLHDIVHTRETLTFVFEYVNTDLSQYMEKHPGGLDHRNVRLFLFQLLRGLSYCHKRRVLHRDVKPQNLLISDCGELKLADFGLARAKSVPSHTYSHEVVTLWYRPPDVLLGSTEYSTSLDMWGVGCIFVEMVTGMPTFPGIRDTYDQLDKIFKLLGTPTEDTWPGVTHFPGYKPHKLGFYRPRKLGHNFPRLYDIIEGETIANGFLQLNPEQRLGADDALQHPYFAQLPKKLYELPDETSIFTVEGVQLYTEPNRQNK

SEQ ID NO: 18639 - protein, 320 aa, Drosophila melanogaster
MTGKVEYYFKHNDGTHIQGIGLGTFASTEGDCERAVLHAIDVGYRHIDTAYFYGNEAEVGAAVRKKIAEGVIKREDIFITTKLWCNFHEPERVEYACRKTLKNIGLDYVDLYLIHWPFSYKYRGDNELIPKDANGEVELVDIDYLDTWGAMEKLVDLGLTKSIGVSNFNEEQLTRLLANCKIKPIHNQIEVHPALDQKKLIALCKKNGILVTAFSPLGRHNAELRTPTFMYDGKVQAIADKYNKSIAQVVIRYVIELGTIPLPKSSNPKRIEENFNVFDFKLDAEDHAILDSYHNGERVAHARQAIKSKYYPFNVYSACF

SEQ ID NO: 18640 - protein, 191 aa, Drosophila melanogaster
MKPERNVMIAATGSVATIKLAQLIRELSDERLPFKFHLKVLITEAAKHFFELEQIPENVPIYHNRDEWITWNKRGDPVLHIDLGKWADLLVIAPLSANSLSKMATGICDNIVMCVVRAWDLEKPLLFAPAMNTRMYDHPITREQIDKLTSWGYKEIPCISKTLMCGDTGNGAMAEVPTIVEAVLSAFQPIK

SEQ ID NO: 18641 - protein, 530 aa, Drosophila melanogaster
MVGTTLKMRGDENASENFKQVQLKKLTVPSMEATTKRAALGDLQNRGISRPIAAKDAAQKDSKDLKLTDALRNAKARVDSHWKKQPLGSTNGNGNGAVPPKVNEGGVSAFLRSNSVRNRVPTKTTVEPTKVTVKSSSSENVNEPTLKREDSNLSKKSLTKLRAALAKPVMGVSGIRREPVAVSRKEAETKKELPETKKDSLEVKKDATRMPLIRGNSAVTTTTSTMPTTMSLSSKRLAGIEDIDANDKENLVLVSEYVNDIYDYLYQVELEQPIHKDHLAGQKEVSHKMRAVLIDWINEVHLQFHLAAETFQLAVAIIDRYLQVVKDTKRTYLQLVGVTALFIATKYEELFPPAIGDFVFITDDTYTARQIRQMELQIFKAIDCNLSRPLPIHFLRRYSKAAGAEDEHHTMSKYFIELASVDYEMATYRPSEIAAASLFLSLHLLNGNHRAGTGFNDRHWTPTLTFYSRYSAAHLRPITRLIAKLARDAPQAKLKAIYNKYQGSKFQKIALRTELTGALMDSIVGQSQRK

SEQ ID NO: 18642 - protein, 524 aa, Drosophila melanogaster
MAALEKNASENFKQVQLKKLTVPSMEATTKRAALGDLQNRGISRPIAAKDAAQKDSKDLKLTDALRNAKARVDSHWKKQPLGSTNGNGNGAVPPKVNEGGVSAFLRSNSVRNRVPTKTTVEPTKVTVKSSSSENVNEPTLKREDSNLSKKSLTKLRAALAKPVMGVSGIRREPVAVSRKEAETKKELPETKKDSLEVKKDATRMPLIRGNSAVTTTTSTMPTTMSLSSKRLAGIEDIDANDKENLVLVSEYVNDIYDYLYQVELEQPIHKDHLAGQKEVSHKMRAVLIDWINEVHLQFHLAAETFQLAVAIIDRYLQVVKDTKRTYLQLVGVTALFIATKYEELFPPAIGDFVFITDDTYTARQIRQMELQIFKAIDCNLSRPLPIHFLRRYSKAAGAEDEHHTMSKYFIELASVDYEMATYRPSEIAAASLFLSLHLLNGNHRAGTGFNDRHWTPTLTFYSRYSAAHLRPITRLIAKLARDAPQAKLKAIYNKYQGSKFQKIALRTELTGALMDSIVGQSQRK

SEQ ID NO: 18643 - protein, 500 aa, Drosophila melanogaster
MEATTKRAALGDLQNRGISRPIAAKDAAQKDSKDLKLTDALRNAKARVDSHWKKQPLGSTNGNGNGAVPPKVNEGGVSAFLRSNSVRNRVPTKTTVEPTKVTVKSSSSENVNEPTLKREDSNLSKKSLTKLRAALAKPVMGVSGIRREPVAVSRKEAETKKELPETKKDSLEVKKDATRMPLIRGNSAVTTTTSTMPTTMSLSSKRLAGIEDIDANDKENLVLVSEYVNDIYDYLYQVELEQPIHKDHLAGQKEVSHKMRAVLIDWINEVHLQFHLAAETFQLAVAIIDRYLQVVKDTKRTYLQLVGVTALFIATKYEELFPPAIGDFVFITDDTYTARQIRQMELQIFKAIDCNLSRPLPIHFLRRYSKAAGAEDEHHTMSKYFIELASVDYEMATYRPSEIAAASLFLSLHLLNGNHRAGTGFNDRHWTPTLTFYSRYSAAHLRPITRLIAKLARDAPQAKLKAIYNKYQGSKFQKIALRTELTGALMDSIVGQSQRK

SEQ ID NO: 18644 - protein, 295 aa, Homo sapiens
MSTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSKTQLMSDGTSRFTCKGKSIYHFGNTSTFCEYTVIKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAGRADSTSLNWLLIIWQRS

SEQ ID NO: 18645 - protein, 336 aa, Homo sapiens
RPARGGHAHPIGARGAADGGVWPSWGSSGRRGSAGRRESPPPSPRAPPSSGSPRIAPRLSGVAGDGGGADAESGSRPGMAKYQGEVQSLKLDDDSVIEGVSDQVLVAVVVSFALIATLVYALFRNVHQNIHPENQELVRVLREQLQTEQDAPAATRQQFYTDMYCPICLHQASFPVETNCGHLFCGACIIAYWRYGSWLGAISCPICRQTVTLLLTVFGEDDQSQDVLRLHQDINDYNRRFSGQPRSIMERIMDLPTLLRHAFREMFSVGGLFWMFRIRIILCLMGAFFYLISPLDFVPEALFGILGFLDDFFVIFLLLIYISIMYREVITQRLTR

SEQ ID NO: 18646 - protein, 430 aa, Drosophila melanogaster
MSVSMSLVQGGAAGGAPQGASAILAAAAPYYQPPAVPQDVQPDRPIGYGAFGVVWAVTDPRDGRRVALKKLPNVFQSLVSSKRVFRELKMLCFFKHENVLSALDILQPPHLDFFQEIYVITELLQSDLHKIIVSPQHLSADHIKVFLYQILRGLKYLHSARILHRDIKPGNLLVNSNCVLKICDFGLARVEEPDQAKHMTQEVVTQYYRAPEILMGARHYSSAVDVWSVGCIFGELLGRRILFQAQNPVQQLELITELLGTPTMEDMRHACEGARTHMLRRAPKPPSFSVLYTLSSHATHEAVHLLCQMLVFDPDKRISVTDALAHPYLDEGRLRYHSCMCKCCFTTSAGMRQYTADFEPSAGQPFDDLWERKLTSVQQVKEEMHKFIAEQLQTGRVPLCINPQSAAFKSFASSTVAHPSELPPSPHQWE

SEQ ID NO: 18647 - protein, 414 aa, Drosophila melanogaster
MSVSMSLVQGGAAGGAPQGASAILAAAAPYYQPPAVPQDVQPDRPIGYGAFGVVWAVTDPRDGRRVALKKLPNVFQSLVSSKRVFRELKMLCFFKHENVLSALDILQPPHLDFFQEIYVITELLQSDLHKIIVSPQHLSADHIKVFLYQILRGLKYLHSARILHRDIKPGNLLVNSNCVLKICDFGLARVEEPDQAKHMTQEVVTQYYRAPEILMGARHYSSAVDVWSVGCIFGELLGRRILFQAQNPVQQLELITELLGTPTMEDMRHACEGARTHMLRRAPKPPSFSVLYTLSSHATHEAVHLLCQMLVFDPDKRISVTDALAHPYLDEGRLRYHSCMCKCCFTTSAGMRQYTADFEPSAGQPFDDLWERKLTSVQQVKEEMHKFIAEQLQTGRVPLCINPQSAAFKSFASQ

SEQ ID NO: 18648 - protein, 237 aa, Drosophila melanogaster
MADTANYINDRFQTFMNGLGDRYEPYVREHLSKVYMVLGSTAAATAMGAMLQMRDFLDLGVLAAVATLVLVLGLHFYKDDGKNYYTRLGMLYAFGFCSGQTLGPLLGYICSINPAIILSALTGTFVTFISLSLSALLAEQGKYLYLGGMLVSVINTMALLSLFNMVFKSYFVQVTQLYVGVFVMAAFIVYDTQNIVEKCRNGNRDVVQHALDLFFDVLSMFRRLLIILTQKLKTFMV

SEQ ID NO: 18649 - protein, 599 aa, Drosophila melanogaster
MVGVTADASQANQLSSVRNPMIKYMLKTRENHAREQDRDYSHVFRRKTRFEMFRLSAIAMAIEFAYAAETSFVSPILLQIGVDHKHMSMTWGLSPLIGFFMSPLLGSISDRCKLRWGRRRPIISILSFGIMCGLILVPYGKDLGLLLGDAGYTYAESALNFTSSSGGSVAALVSGEATTGPSASDYKFAVILTILGMVLLDFDADTCQTPARTYLLDMCVPEEQPKAMTMFALFAGFGGTIGYAIGGVDWETTHIGSFMGGNIPTVFTLVTIIFAVCYLITVTTFREIPLPLIEQDELLRPLSEQAIKKELKKKNNTIYYIQETTQLELQMASDDPKRLEALQGSYQNGYSPAVEKQGKSQDLETQSDYDAPVSLKAYLKSIFIMPYSMRMLALTNLFCWMGHVTYCLYFTDFVGEAVFHGDPTAAPNSEAALNYEAGVRFGCWGMAIYAFSCSIYSLSVTKLMKWFGTKAVYISGMIYYGIGMLVLGLWPTKWGVLVFSTSAGILYGTIFTVPFILVARYHAKNCFSIKNGEIVPLKQARGLGTDVAIISSMVFIAQLIVSLSVGPLVSWMDTTCAVLYASTFLSFLAAIAAMFVLYV

SEQ ID NO: 18650 - protein, 511 aa, Drosophila melanogaster
MLDVPHEAKVRGHQRAPSDSKEFHEVTKRDALRLLEHDVDRLLETTEKARQPALKAEMGRFADLFGRFIQEEGPALDWNKIQKLPENAVMNYSNLKSPKNEQIRNMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHYLPVAKDFDVEKDMEAWYPPGHGDFYDTFRNSGLLKKFIEEGREYCFLSNIDNLGATVDLNILNKLVGEERATTPVEFVMEVTDKTRADVKGGTLIQMENKLRLLEIAQVPPEHVDDFKSVKTFKFFNTNNIWANLAAIDRVLRERTLNMEIIVNNKTLENGTRVIQLETAVGAAMKCFDGAIGINVPRSRFLPVKKSSDLLLVMSNLYTLKNGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 18651 - protein, 518 aa, Drosophila melanogaster
MPSGIRPIDVLLERAGVRGHQRAPSDSKEFHEVTKRDALRLLEHDVDRLLETTEKARQPALKAEMGRFADLFGRFIQEEGPALDWNKIQKLPENAVMNYSNLKSPKNEQIRNMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHYLPVAKDFDVEKDMEAWYPPGHGDFYDTFRNSGLLKKFIEEGREYCFLSNIDNLGATVDLNILNKLVGEERATTPVEFVMEVTDKTRADVKGGTLIQMENKLRLLEIAQVPPEHVDDFKSVKTFKFFNTNNIWANLAAIDRVLRERTLNMEIIVNNKTLENGTRVIQLETAVGAAMKCFDGAIGINVPRSRFLPVKKSSDLLLVMSNLYTLKNGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 18652 - protein, 408 aa, Drosophila melanogaster
MFSRHFAAFFRFNRYVAQKYSSFIAAGFSNRFSLKVATLLPLVVLRSADCRQKEDQEVKRPVRRRTMSKVKYETSLEGRAQLYLNAMKVRWDQLHKVPGLFSYQLEKSPQSRKIPGYWGFYAELNSDRNRKRRRPQTIESLNPTFKHMMFNFNKVDAQEVIMTIDDAHGSPEVQMIINKSPITKYHTLICPEVGKNHTQRITRDALQFCITFMRNIDDKDMRMGYNSPGALASVNHLHFHLLHMPQDLYIDHVPLDELAGGYVYRLSRRAPTEGICIVFNENDSDEQVAEKVDQLYMLAMWMCKNNMPHNLFLTQDRRPGKSGNIKVFVFARSEYCVNKDLAEFNVGFCELAGYIPLPDADKMENLTELQVLFRIRTITGNAPKAVYEQITSMVEGQEYYLWDQPLTI

SEQ ID NO: 18653 - protein, 581 aa, Drosophila melanogaster
MKFVILLCVLSALLLQIEASPLQRLSRSERAVSRQQTVNNEVAPAVAPASDDDDDDDDEDDDDEPDLGDLIDDDDDDDEEEDDDEDEEDDTPQGQAAPAATASDDDEEEDDDDDDYLDRLFDDILGDDEDEDDDDETPAATAQQSAVAAAPAQTLDEVAPAAASSVSAGISDGVDLPAESGNAAEVLAAGNAADESVSAAVAPAQNAAASSSNNEGIAGDDDEEADDDDDDDDDDIIGDDIIEARREARDLKNNVIDMSTDAFQARHNHFIDAIFSRINRIVSENYDPYVVNLTGRSVLPNAASGSNVKAANKKQSTSSKVGGHKKLKNTRSEPRSVNSNQEAREAAVKLQEQLTQLQSELAIKAVEKRPSPTSPATESESDSGSPKAETRTVSGSKTGQKKSSNKQNTKKASGLKSGNYNQPAGASKAGASSAGAVEKLQKAEGRLSGLASLKRVGNVKVISDAEGRNSTIKAKFTLGPLVLRVEKSFKKGSVRSVKSATARTNEMMGRIKFSVLDDRATLMSIKVQQPKQVEVESKDNHDRTREFVWRRTPKIAKLVNEKLKLAAESLFAPQGVEVVRL

SEQ ID NO: 18654 - protein, 283 aa, Drosophila melanogaster
MKFVILLCVLSALLLQIEASPLQRLSRSERAVSRQQTVNNEVAPAVAPASDDDDDDDDEDDDDEPDLGDLIDDDDDDDEEEDDDEDEEDDTPQGQAAPAATASDDDEEEDDDDDDYLDRLFDDILGDDEDEDDDDETPAATAQQSAVAAAPAQTLDEVAPAAASSVSAGISDGVDLPAESGNAAEVLAAGNAADESVSAAVAPAQNAAASSSNNEGIAGDDDEEADDDDDDDDDDIIGDDIIEARREAQITKQKKMMMMMKKMKKAQKNRKAEERQEAEQEKN

SEQ ID NO: 18655 - protein, 760 aa, Drosophila melanogaster
MNSTKVPPEWKRRVKSEYIKIRQQKRYKRADEIKEAWIRNWDEHNHNVQDLYCESKVWQAKPYDPPHVDCVKRAEVTSYNGIPSGPQKVPICVINAVTPIPTMYTWAPTQQNFMVEDETVLHNIPYMGDEVLDKDGKFIEELIKNYDGKVHGDKDPSFMDDAIFVELVHALMRSYSKELEEAAPGTATAIKTETLAKSKQGEDDGVVDVDADGESPMKLEKTDSKGDLTEVEKKETEEPLETEDADVKPDVEEVKDKLPFPAPIIFQAISANFPDKGTAQELKEKYIELTEHQDPERPQECTPNIDGIKAESVSRERTMHSFHTLFCRRCFKYDCFLHRLQGHAGPNLQKRRYPELKPFAEPCSNSCYMLIDGMKEKLAADSKTPPIDSCNEASSEDSNDSNSQFSNKDFNHENSKDNGLTVNSAAVAEINSIMAGMMNITSTQCVWTGADQALYRVLHKVYLKNYCAIAHNMLTKTCRQVYEFAQKEDAEFSFEDLRQDFTPPRKKKKKQRLWSLHCRKIQLKKDSSSNHVYNYTPCDHPGHPCDMNCSCIQTQNFCEKFCNCSSDCQNRFPGCRCKAQCNTKQCPCYLAVRECDPDLCQACGADQFKLTKITCKNVCVQRGLHKHLLMAPSDIAGWGIFLKEGAQKNEFISEYCGEIISQDEADRRGKVYDKYMCSFLFNLNNDFVVDATRKGNKIRFANHSINPNCYAKVMMVTGDHRIGIFAKRAIQPGEELFFDYRYGPTEQLKFVGIEREMEIV

SEQ ID NO: 18656 - protein, 316 aa, Drosophila melanogaster
MAVPNVKFNNGKEVPIIGLGTWGSPKGQVTEAVKVAIDAGYRHIDCAYVYQNEDEVGDGVEAKIKEGVVKREDLFITSKLWNTFHRPDLVKSALENTLSSLKLKYLDLYLIHWPMGYKEGCDLFPTDKDGKTLYSPVDYVDTWKAMEKLVEEGLVKSIGVSNFNRRQIERVLEVATIPPVTNQIECHPYLTQKKLIDFCKSKDITITAYSPLGSPNRPWAKAGDPVILEEAKIKEIAAKKKKTPGQILIRYQVQRANIVIPKSVTKDRIESNFQVFDFELTPEEIEIIESFECNGRLVPLLNQYGHPHHPFEKDEY

SEQ ID NO: 18657 - protein, 350 aa, Drosophila melanogaster
MNTLMKIQLVRPVFRITLRNYGKPERFMWCQKEYARAPKVVCLDGNEIPVIGLGTFNSPKGQVTEAVKVAIDAGYRHIDCAYVYQNEDEVGDGVEAKIKEGVVKREDLFITSKLWNTFHRPDLVKSALENTLSSLKLKYLDLYLIHWPMGYKEGCDLFPTDKDGKTLYSPVDYVDTWKAMEKLVEEGLVKSIGVSNFNRRQIERVLEVATIPPVTNQIECHPYLTQKKLIDFCKSKDITITAYSPLGSPNRPWAKAGDPVILEEAKIKEIAAKKKKTPGQILIRYQVQRANIVIPKSVTKDRIESNFQVFDFELTPEEIEIIESFECNGRLVPLLKDAGTHKYYPFHDEY

SEQ ID NO: 18658 - protein, 322 aa, Drosophila melanogaster
MSTPNFLLSNGKNMPMLGLGTWRSPPEVVTQAVKDAIDIGYRHFDCAHIYGNEAQVGAALREKMDEGVVTRDELFITSKLWNTHHKPDLVRPACETSIRNLGVKYLNLYLMHWPMAYKSGSDNLYPTCPDTNKAAFEDIDYVDTWRAMENLVDEGLCQAIGVSNFNEQQMNRLLSVAKLKPVVLQIECHPYLSQKPLITLCYDNAIAVTAYSCLGSGHTPYEKPGAYPLLQHPTILAIAEKYERTAAQVLLRFQTQSGIIVIPRSVSKQHMLDNFKRIWDFELAVDDIQAINELDCNGRFMTMKAAYGHPHHPFEPKAKVDN

SEQ ID NO: 18659 - protein, 491 aa, Drosophila melanogaster
MASFQIHQDMSNKENPGIKIPAGVKNTKQPLAVIGGKAEKNALAPRANFAVLNGNNNVPRPAGKVQVFRDVRNLNVDENVEYGAKKSNVVPVVEQFKTFSVYEDNNDTQVAPSGKSLASLVDKENHDVKFGAGQKELVDYDLDSTPMSVTDVQSPMSVDRSILGVIQSSDISVGTETGVSPTGRVKELPPRNDRQRFLEVVQYQMDILEYFRESEKKHRPKPLYMRRQKDISHNMRSILIDWLVEVSEEYKLDTETLYLSVFYLDRFLSQMAVVRSKLQLVGTAAMYIAAKYEEIYPPEVGEFVFLTDDSYTKAQVLRMEQVILKILSFDLCTPTAYVFINTYAVLCDMPEKLKYMTLYISELSLMEGETYLQYLPSLMSSASVALARHILGMEMWTPRLEEITTYKLEDLKTVVLHLCHTHKTAKELNTQAMREKYNRDTYKKVAMMESVEMSKDDFDQLCEAYNCKQKEDEHQQPDINTKSNVNLFYKF

SEQ ID NO: 18660 - protein, 345 aa, Drosophila melanogaster
MSVTDVQSPMSVDRSILGVIQSSDISVGTETGVSPTGRVKELPPRNDRQRFLEVVQYQMDILEYFRESEKKHRPKPLYMRRQKDISHNMRSILIDWLVEVSEEYKLDTETLYLSVFYLDRFLSQMAVVRSKLQLVGTAAMYIAAKYEEIYPPEVGEFVFLTDDSYTKAQVLRMEQVILKILSFDLCTPTAYVFINTYAVLCDMPEKLKYMTLYISELSLMEGETYLQYLPSLMSSASVALARHILGMEMWTPRLEEITTYKLEDLKTVVLHLCHTHKTAKELNTQAMREKYNRDTYKKVAMMESVEMSKDDFDQLCEAYNCKQKEDEHQQPDINTKSNVNLFYKF

SEQ ID NO: 18661 - protein, 539 aa, Drosophila melanogaster
MSTASSSNSSGEEANKKSGSNNEESSHLLESAENGAKYGSRQPVKIVKASDNGRTSSTPHDQENLLGNMVHTSTSNNSQKWPQYVAALAAAGGAFAAGTVLGWTSPAETEIVDRGEGYDFPVDKDQFSWVGSAMTLGAACVCIPIGFLINMIGRKWTMLFLVLPFILGWTMLIWAVNVSMLYASRFILGIAGGAFCVTAPMYTGEIAQKEIRGTLGSFFQLMITIGILFVYAVGAGVKIFWLSIICGILPLIFGAIFFFMPESPTYLVSKDRSENAIKSIQWLRGKEYDYEPELAELRETDRETKANKVNVWAALNRPVTRKALAISMGLMFFQQVCGINAVIFYASRIFLEANTGIEAEWATILIGIMQVVATFVSTLVVDKLGRRILLLASGISMAISTTAIGVYFFLQKQDAAQVVSLGWLPVASLCLFIIMFSIGYGPVPWLMMGELFATDIKGFAGSLAGTSNWLLAFVVTKTFVNLNDGLGIGGTFWLFAGLTVVGVIFVYFAVPETKGKSLNEIQQELAGNRSTPQAIPAEK

SEQ ID NO: 18662 - protein, 471 aa, Drosophila melanogaster
MVHTSTSNNSQKWPQYVAALAAAGGAFAAGTVLGWTSPAETEIVDRGEGYDFPVDKDQFSWVGSAMTLGAACVCIPIGFLINMIGRKWTMLFLVLPFILGWTMLIWAVNVSMLYASRFILGIAGGAFCVTAPMYTGEIAQKEIRGTLGSFFQLMITIGILFVYAVGAGVKIFWLSIICGILPLIFGAIFFFMPESPTYLVSKDRSENAIKSIQWLRGKEYDYEPELAELRETDRETKANKVNVWAALNRPVTRKALAISMGLMFFQQVCGINAVIFYASRIFLEANTGIEAEWATILIGIMQVVATFVSTLVVDKLGRRILLLASGISMAISTTAIGVYFFLQKQDAAQVVSLGWLPVASLCLFIIMFSIGYGPVPWLMMGELFATDIKGFAGSLAGTSNWLLAFVVTKTFVNLNDGLGIGGTFWLFAGLTVVGVIFVYFAVPETKGKSLNEIQQELAGNRSTPQAIPAEK

SEQ ID NO: 18663 - protein, 345 aa, Drosophila melanogaster
MCDRVREGILVGCGNPLLDISAVVPLNFLQKYSMNEDDAILAEDRHMPIYGELVEGYQAEFLAGGSVQNSLRIAQWILRQPRVAVFFGCVGEDRYANILKEKAQAAGLDVHYQVKKDVPTGTCAVLITGTHRSLCANLAAANNFTIDHLEEPSNKALVDNAQYYYISGFFLTVNPPSIMQVAATAHAKQRPFLMNLSAPFISQFYMAPLLAALPYVDIIFGNEAEAQAFAEAQQWPSGDLREIGKRLVAMEKKNPTRPRIAILTQGCDPVLLIQQDSVQEFPVTKLAVHEIVDTNGAGDAFVGGFLSQFVQGKSLDVCIRCGNYAAGHIIKNPGCTYSGEPEFVE

SEQ ID NO: 18664 - protein, 164 aa, Drosophila melanogaster
MSADTFVMDTKDESFYECNICLDTAQNAVVSMCGHLFCWPCLYQWILTKPDHTVCPVCKSGVDRSKVIPVYARNDKRQEDPRDKTPPRPTGIWSDYANDLELGLFSYLLFGLFFPYGALSSYLDMDEPLNPAADHGIRDGQNETLLSKFFLYVAIMLIIYMIVI

SEQ ID NO: 18665 - protein, 793 aa, Drosophila melanogaster
MKLIDHPHVLGLSDVYENKKYLYLILEHVSGGELFDYLVKKGRLTPKEARKFFRQIISALDFCHSHSICHRDLKPENLLLDEKNNIKIADFGMASLQPAGSMLETSCGSPHYACPEVIRGEKYDGRKADVWSCGVILYALLVGALPFDDDNLRQLLEKVKRGVFHIPHFVPPDCQSLLRGMIEVNPDRRLTLAEINRHPWVTAGGKGELELELPMMEVVQTHVIPTATAVDPDVLNAICSLGCFKEKEKLIQELLSSSHNTEKVIYFLLLERKRRRPALEDDDEIAQKSRSELDAVDPPRKRLDTCRINGTNAPSYGQISEGSPLTPRRQAFNFRSYSSTRNHQRRSPTTVTSSVRSSSYHSPTRCNSPMSSAQQQANAISRPSSPAAGTRHSTYGDRDRSGHHSSVSRTPSHSSQKSIEGDVVVVREPRIERRDSLRQERGGGSPRDRGDCGIPPGSPGGNSSGSTSASPSVHHRANSGPTIAISMFHDPDSNSVVNPNGSPMMNNSSPGMPGSPCNTPGGQLWKTRLTNIKNSFLGSPRFHRRKMQVSADEVHLTPESSPELTKRSWFGNLITTEKDETFTILVKGKPIATVKAHLIHAFLSMAELSHSVVSPTSFRVEYKRNGNGPVMFQRHVKFQVDISAICKQGDIADMLFALTFTLLSGNIRRFRRICEHIQSQVCSKRFPGPSSPPTVTSVTQAVSESSSCGSVSSERLSYKRQVIENDMENDSIFSYKSGNGRRASTTNNNNANPVDIPGSPIAVRSNSETAEHERNRELQSERQATTMSGSAIA

SEQ ID NO: 18666 - protein, 527 aa, Drosophila melanogaster
MPSKKSKNVLNRKKPVKLSLAEFHNQLDEMQTAKTCEKTSAENWKHFFSNGSGIANGTRGRGVCCEKLSIVDQIEGRAIVQNGATTKARGIFESTLNSVAERKKHSEKLDNSKSANQTVKPENSDIKISLLQRPNPQDATQARSKTRVRSAGRIPAPPRKVPKELEDLDRMTSADFRHDTAARLDVMRNRQKDQAHMYFFQSVIHHQRHLIKDRTILVLCCGTGTLALMAAQMGAKRVYAVDYSKVTGYTTLVVRQNGYEGVITVMNGRMKDLKLPTKVDGIICNWMGYCLLYESEILEVLEARDRWLKKGGFILPDLAALYLVASEEHKLKSERCNHWRNVYGFNMNAIRRYALAEPCVALTTGKKLLTMAHCVLRLDLKRARREDLFIDRNIRLSVNREGYLECFLLFFEVQFSNSLNFKLSCNPCLKSPFKSLWMQSVLFVEQPFVMRKNIHYTGNLKFKTLKPNKFNEMEICIEFYEGREYDYDLVMCTLRVAKRWLMLEGFQTLSDVESCQDEQGETGGLYL

SEQ ID NO: 18667 - protein, 351 aa, Drosophila melanogaster
MSVRNSRPQLSWPERVSPQRTIDTPTASGEMLTRRQSAPALVVPPEETTHVVVVKRQSPDAAAAGELVPSRRKDSVAVQSGIVATGPLDTTRSGARDDFLMALLECPVCFGYIMPPIMQCPRGHLICSTCRSKLTICPVCRVFMTNIRSLAMEKVASKLIFPCKHSHFGCRARLSYAEKTKHEEDCECRPYFCPYPDDKCSWQGPLRDVYQHLMSSHENVITMEGNDIIFLATNVNLEGALDWTMVQSCHGRHFLLSLEKINLGEDCQQYFTACRMIGSMKDAAEFVYNISLEAYNRTLRWQSKPRSIRENFSSFTNADFLVLNKHTVELFSEDGNLALNVVIRKVEERTN

SEQ ID NO: 18668 - protein, 623 aa, Drosophila melanogaster
MSNAKLDSKVVQNLKDVAQKLRIHSITSTQAAKSGHPTSCASLAEIMTVLFFQQMRLNLKHPRDPSSDRLVLSKGHAAPILYAVWAEAGLFPVEELRNLRKVDSDLEGHPTPRLSFVDVSTGSLGQGISVAAGMAYVGKHLDKADYRTYVIVGDGEATEGAVWESLHFAGHYCLDNLCVIFDMNKIFCSDIGTEMEVYRERLDAFGFNALVLNGHDIDELAKAFINAASTKGKPTALLARTTKGKDFLGIEGIEEMHAQPLGKRAESAIKHLQMKIANPNVRLTPKKVGKCGHAPEVHINNIMLCSPPNYRLGDSVAPRLAYGTALAKIAADNPRVIALDGDTKNSTYADKMRNAFPERFIECFTAQQNLVGVAVGATCRRRTVAFVSTYATFFTRAFDQIRMGAISHTNVNFAGSHCGCSIGEDGPSQMGLEDMAMFRSIPGSTVFYPTDAVSTERAVELAANTKGVCYIRTTYPSTTVIYNNDEVFAVGLGKVVRQKPSDEVLLIGAGVTLYECLAAAERLEEDCITARVIDPFTVKPLDVGLIVKHGKLCRGRIVVVEDHYQQGGLGEAVLSALADYRNFVVKHLYITTVPRSGPPAVLLDMFGVSSRNIYKASLAIMKK

SEQ ID NO: 18669 - protein, 114 aa, Drosophila melanogaster
MGAVGSALRSPIVDMSTKQAKFVENTIASNKVVIFSKTYCPYCTMAKEPFKKLNVDATIIELDGNPDGNEIQAVLGEITGARTVPRVFIDGKFIGGGTDIKRMFETGALQKYFQ

SEQ ID NO: 18670 - protein, 459 aa, Drosophila melanogaster
MMSSRTQDADGASIRFSDHTLDKATKAKVTLENYYSNLVTQYGERKQRLAKLEAQLKDESLSEAQRQEKRLQHAQKETEYLRLKRLRLGVEDFEALKVIGRGAFGEVRLVQKKDTGHVYAMKVLRKADMLEKEQVAHVRAERDVLVEADHQWVVKMYYSFQDPVNLYLIMEFLPGGDMMTLLMKKDTLSEEGTQFYISETALAIDSIHKLGFIHRDIKPDNLLLDARGHLKLSDFGLCTGLKKSHRTDFYRDLSQAKPSDFIGTCASPMDSKRRAESWKRNRRALAYSTVGTPDYIAPEVFLQTGYGPACDWWSLGVIMYEMLMGYPPFCSDNPQDTYRKVMNWRETLIFPPEIPISEEAKETIINFCCEADRRLGSQRGLEDLKSVPFFRGVDWEHIRERPAAIPVEVRSIDDTSNFDEFPDVSLEIPSAPIPQGGEIAKDWVFINYTYKRFEVRNLE

SEQ ID NO: 18671 - protein, 260 aa, Drosophila melanogaster
MLDKVKNVIVVLSGKGGVGKSTVSTQLSLALRKNGFKVGLLDIDLCGPSVPYLLGLEGRDIFQCDDGWVPVYTDESQTLAVMSIGFLLKNREDPVIWRGPKKTMMIRQFLTDVRWDELDYLIIDTPPGTSDEHITVMECLKEVGCHGAIIVTTPQEVALDDVRKEITFCKKTGINILGIVENMSGFVCPHCTSCTNIFSSNGGVSLATYAQVPHLGTLPIDPRVGILAGTTTSVLDELPDSTTAEVLTHIVEKLKTMLVS

SEQ ID NO: 18672 - protein, 248 aa, Brugia malayi
MNKLLIVFGLVILFVTPLYAKQSIEEEEEEMSDEEEEEKEEEEEENGNEEKEDEDDDYYQDDSDEKEEDEEKEEDEDEDGSEEKEDEDDDYYQDDSDEKEEDEDEDGSEEKEDEDDDDYQDDSDEKEEDEDEDDSEEKEDEEEDKDDSEEKEDEEEDKDDSEEREDEYTAKGEFVETDGKKKQCDSHVACYDQREPQAWCILKRNQSWTNKGCFCDEKRHLCVMERMNGGKLEYAYCAPAKNWKCSYD

SEQ ID NO: 18673 - protein, 172 aa, Solanum tuberosum
MENYATIFPSASSSSSHHDEYISLMNSKSSISDDAKEELLFQGKNKAGFLGLMASMETPRDIITKKDEVIKSCKKKIKKPRYAFQTRSQVDILDDGYRWRKYGQKAVKNNKFPRSYYRCTHQGCNVKKQVQRLSKDEEVVVTTYEGMHSHPIDKSTDNFEHILSQMQIYTSF

SEQ ID NO: 18674 - protein, 474 aa, Solanum tuberosum
DLFLLSFATILTIIIYVFFKYFFAKPKEKIPPGTFGWPIIGETIQFFISLYYGMVHEFVQERTKKYNSHVFKTSLLGQKVVIFSGPAANKFIFTQGNKLIIGWRPKSVQKLFASTSFVPIEHDTKRAHNVISYLLNSQNVERLISTMDNMSHLHLKNHWKGKNEVIVYDLVKLFTFSLSIRAFIGIKESDKILNLYEKFKIFTYGLLAVDINLPGTTFYKAMKAGNELRKQMKVIIKQRRAELSENPNLSKVDVLTQMINEQDEDGKYMTEVEIEDKVFGFIIGSYDTTATTITLTMKYLQQMPEFFNEIIQEQNEISMQMMPRKELCWNDIQKMKKTWSFVNEVLRNTPVVQGIFREVIEDFTYEDFYIPKGWKIYLSFGATQKNGEYFPNPTKFDPSRFEGNGQVPYTSVPFGGGHRMCPGKEFARILILVFLHHLLKNFRWEPKVPSEKILYPFFLLAIPTDGYPITLSAV

SEQ ID NO: 18675 - protein, 467 aa, Solanum tuberosum
MAPDATDALAVREKVNKFLKAACSGDIELFKKLAKQLDDGKGLAGTVADVKDGNKRGALIFAARESKIELCKYLVEELKVDVNEKDDEGETPLLHAAREGHTATVQYLIEQGADPAIPSASGATALHHAAGNGHVELVKLLLSKGVDVDLQSEAGTPLMWAAGFGQEKVVKVLLEHHANVHAQTKDENNVCPLVSAVATDSLPCVELLAKAGADVNVRTGDATPLLIAAHNGSAGVINCLLQAGADPNAAEEDGTKPIQVAAASGSREAVEALLPVTERIQSVPEWSVDGVIEFVQSEYKREQERAEAGRKANKSREPIIPKRDLPEVSPEAKKRAADAKARGDEAFKRNDFATAIDAYTQAIDFDPTDGTLFSNRSLCWLRLGQAERALSDARACRELRPDWAKGCYREGAALRLLQRFEEAANAFYEGVQINPINMELVTAFREAVEAGRKVHATNKFNSPSSLS

SEQ ID NO: 18676 - protein, 278 aa, Solanum tuberosum
LEFFQIINHGVPVDLMDEAMKVYKEFFSLPAEEKAEYAKDAANDTNRGAATLYSSSAKHYDSEEHRYWRDVLEHSCNLDGKDRKTWPSNPPRYREVIGAYGDELRRVSKVILGLLAEGLGLEAGFFDTELGQRMLVNHYPACPDPSLTLGVGGHCDPNLITIIQQEVYGLQILKDDKWIGVQPIQNAFVVNSGLPITVVSNGKLTSVAHRVVTNTTHSRTSIGTFICPHDIVEPAKALVGPENPPQFKSFNWGIDFMPHYLSKKSVYHASLEPFKIDA

SEQ ID NO: 18677 - protein, 307 aa, Oryza sativa (japonica cultivar-group)
MEQKDEAEMEEVDEEEEEEVDEDMAGGHAAQSPSPSCGLGEKKRRLALEQVRALERSFDTDNKLDPDRKARIARDLGLQPRQVAVWFQNRRARWKTKQLERDFAALRARHDALRADCDALRRDKDALAAEVRAHRCVLPDARESLSLTFNSCSIDQIRELREKLPTKPADTAASVKVEAGNDAAAGAAAATVCKDGSSDDSDSSVVFNDEASPYSGAAFIGFGPSFLVDDASAATVGCSSSLPALESKWHGPYSDDSCKGGVYGFTEEWLAACSGEMAGNDAAGFFSDEHASNLNFGWCASGNEGWE

SEQ ID NO: 18678 - protein, 306 aa, Oryza sativa (japonica cultivar-group)
MYENCKVIDLGVTNCRVVESVGEHVEGFAAGDPVVPTFLGQCTECVDCASERSNVCSTYRFAVRPGMPRDGTARFRDRHGAPIHHFLGVSSFSEYTVVDANQVVRVDPAVPPATASLLSCGATTGVGAAWKLAKVEPGSSVAIFGLGAVGLAVAEGARICGKKFGVTHFINPQELGDKPVSQAIIEMTDGGADYCFECIGLASVMSDAFRSSREGWGKTIILGVEMHGAPLSIPSLEILNGKCVMGSLFGGVKPKQDIPILADKYLNKELELDKFITHEVPLKDINTAFDLLLQGKSLRCTIWMDK

SEQ ID NO: 18679 - protein, 360 aa, Oryza sativa (japonica cultivar-group)
MEDQSLKPIRCKAAVCRAASEPLIVEEIVVDPPKAYEIRIKIICTSLCHTDVTLWHKVDPAFPRILGHEAYGVVESVGENVEGLAAGDTVVPTFMGQCDSCASCAAEWTNQCTAVPFTMGPGMRRDGTTRFWDGEGKPLSDTVAVTSFSQYTVVDVNQVVKVDPAVPPKIACLLGCCGGTGEPEIRRYIEPAWGRSSMEVGQSATRFVGGCLRAGIRRIGGKEFGVTDFVNPSQLGDKSVSEVINAMTDGGADYSFECIGISSVMTEAGRGKTIILGVEKDSQPLCLPSFEFLFGKCVMGSLFGGAKPKTDIPILAEKCMNKELELEKLVTHEVGLTEINTAFDLLLQGKSLRCIIWMDK

SEQ ID NO: 18680 - protein, 377 aa, Arabidopsis thaliana
MEAKIVKVSDSSYKDGLGKKRKHPGNYTPYDSGRSYAKLQWVLSPNSSTQKLEKRRNLDGENKVIVSENHVEKSLVRYFSYYKKTGVPKRVMFHENGEWIDLPDHILCDIRNDLEAKRATIEFNWCGRHFLLDFLHMYRLDLETGVKTQLAWIDIAGKCFFPETFDTLERDGCHHIRGEDPEQHDQREIKLHIEIDVNSGELPRLNLNVVTDESGDNMDDFQAVQRSSNGPNDEASEDSCSRELDDAVEKWDKTETDRFSGVKPAEEELDKDAVKQMFALGAATLGHVESLDVYQFSSEIAKARLSLFQKQADITKKHRGDANIRYAWVPAKKEVLSAVMMHGLGVGGAFIKKSMYGVGVHAANCPYFREYSSYYSE

SEQ ID NO: 18681 - protein, 382 aa, Drosophila melanogaster
MGCFGSPTSKQSDVNSEDSKSQKRRSDAISRQLQKDKQLYRATHRLLLLGAGESGKSTIVKQMRILHVDGFSDSEKKQKIDDIKKNIRDAILTITGAMSTLNPPVALEKKENEPRVEYIQDYASSPDFNYPPEFYEHTEELWKDKGVLQTYERSNEYQLIDCAKYFLDRVSTIKNPNYTPNEQDILRCRVLTSGIFETRFQVDKVNFHMFDVGGQRDERRKWIQCFNDVTAIIFVTACSSYNMVLREDPTQNRLRESLDLFKSIWNNRWLRTISIILFLNKQDLLAEKIKAGKSKLSEYFSEFNKYQTPSDAIMESNDDPEVIRAKYFIRDEFLRISTASGDGKHYCYPHFTCAVDTENIKRVFNDCRDIIQRMHLRQYELL

SEQ ID NO: 18682 - protein, 461 aa, Drosophila melanogaster
MYIRKTLLLACLVLLFGGLPPLTFPATTTTLVAAMSIANQDLERYFRPGNGTHSFSGMEDRIAVDVYNYAFLNWSYVEHGNMLCNMEFAQEQARYGEGKVLNVTGRLIHITATDNFSDDYACTPYIRGTLGAPIPDKGETWIALVRRGRCTFEEKVKHVYQQNAAGVIIYNDKQVMQLEKMQIKGKTRNIAAVITYQNIGQDLSLTLDKGYNVTISIIEGRRGVRTISSLNRTSVLFVSISFIVLMIISLVWLIFYYIQRFRYMQAKDQQSRNLCSVTKKAIMKIPTKTGKFSDEKDLDSDCCAICIEAYKPTDTIRILPCKHEFHKNCIDPWLIEHRTCPMCKLDVLKFYGYVFLGSEESILEYQPDPPQGLALVEARDESADLNRSRDFVVDFPRVFVLDSGCVVGAREMLFPCRIPERSQSSLSLRQARDWVSLMSNKLEEQQGLRSMRNDEMQQVIK

SEQ ID NO: 18683 - protein, 286 aa, Drosophila melanogaster
MQLEKMQIKGKTRNIAAVITYQNIGQDLSLTLDKGYNVTISIIEGRRGVRTISSLNRTSVLFVSISFIVLMIISLVWLIFYYIQRFRYMQAKDQQSRNLCSVTKKAIMKIPTKTGKFSDEKDLDSDCCAICIEAYKPTDTIRILPCKHEFHKNCIDPWLIEHRTCPMCKLDVLKFYGYVVGDQIYQTPSPQHTAPIASIEEVPVIVVAVPHGPQPLQPLQASNMSSFAPSHYFQSSRSPSSSVQQQLAPLTYQPHPQQAASERGRRNSAPATMPHAITASHQVTDV

SEQ ID NO: 18684 - protein, 344 aa, Cicer arietinum
GFREFKDDSDFDEDEEDDDDDEGLLVGGKGFTFSSNNTKSFKTFSRGSTAAKSVSPKSNEQAEKACKRKRKNQYRGIRQRPWGKWAAEIRDPRKGVRVWLGTFNTAEEAARAYDAEARRIRGKKAKVNFPEEAPVTSSKRFKPNLENKLVNKNLNSFNPNGNKMFNFGENVENYYSPMDQVEQKPLVNNNNQYANMGPFSGNGVQHSQISPSADVTAYFSSEHSSNSFDYSDLGWGEQGPKTPEISSMLSAAAPLESESQYVQNNMQSNNNQNMLPVEDNSAKTLSEELADIESQLKFFETPYDDNWGDASLASFLGGDATQDGGNPMNLWSFDDLPSISGGVF

SEQ ID NO: 18685 - protein, 170 aa, Anguilla anguilla
LGRFRAIIYLSIVYVIGHVVKSVGAIPDVGDTTTHIVLSILGLVLIAFGTGGIKPCVAAFGGDQFTEEHAEERTKFFSIFYMSINAGSVLSTVITPILRGDVQCFGGDCYALAFGVPALLMIIALVVFIAGSGLYKKNPPEGNILLKVCQCIGYAIKNRWRNRKKSHKRA

SEQ ID NO: 18686 - protein, 963 aa, Vicia faba
MEPFTRDHRGSLEVFNPSSSETNGTPNPNPNPNPSNSWNTGTSSRGTEAPPLRDSIISDEVPTATSWMALKETTPSPKSGESGSVAEQRAAEWGLVLKTDSETGKPQGVGVRGSGGGGGSRRDSNNSVRSSGESSDDGREGGRGIPRVSEDLRDALSAFQQTFVVSDATKPDYPIMYASAGFFSMTGYTSKEVIGRNCRFMQGADTDPNDVAKIREALAAGTSYCGRLLNYKKDGTTFWNLLTIAPIKDEHGKILKLIGMQVEVSKHTEGTKEKMLRPNGLPESLIRYDARQKEKANSSVTELVEAVSKRPRSLSESANRLPFNKKPTNGSNDHATPPNSESSSRKSGSTLRSFRRKSHSGAGNSNSMHPITELPENNNKSRRRSFMGFMRKSLSNNERFNHEQVIDRNSSEDEDRLDSFDEQNIAQKREKRKGFDLATTLERIEKNFVITDPRLPDNPIIFASDSFLELTEYSREEILGRNCRFLQGPETDPATVKKIRYAIDNQTEVTVQLINYTKTGKKFWNLFHLQPMRDQKGEVQYFIGVQLDGSQHVEPLHNGIAEDTAKEGENLVKKTAENVDDALRELPDANMKPEDLWMNHSKVVHPKPHRREDSAWRAIQKIMESGEQIGLKHFKPIKPLGSGDTGSVHLVELCGTDHHFAMKAMDKGVMPNRNKVHRACTEREILDMLDHPFLPALYASFQTKTHICLITDYCPGGELFMLLDRQPAKVLKEDAVRFYATEVVVALEYLHCQGIIYRDLKPENVLLQSTGHVSLTDFDLSCLTSCKPELIVPSTNDKKKGQHGPIFMAEPMRASNSFVGTEEYIAPEIITGSGHTCAVDWWALGILLYEMFYGYTPFRGKNRQRTFANILHKDLKLPKSKQVSLSAKQLIYHLLQRDPTSRLGSKGGANDIKHHSFFKGINWALVRCTKPPELDAPLFDTNKEEKEKDDKYVDNGQEDMSVF

SEQ ID NO: 18687 - protein, 970 aa, Vicia faba
MEKHLKKSPSSSSSSSMRPSFPRDPRGSLEVFNPTSNTSSPVRSPSNLKNWTETEEPRNEFPDKVTNTSWMAIKEGETGAAVQRAAEWGLVLTTDAETGKPQGVAVRHSGGDEPNAVELESKRNSNNTVRTSGESSDGGDPRGFPRVSDDLKDALSAFQQTFVVSDATKPDYPILYASAGFFKMTGYTSKEVIGRNCRFLQGADTDPNDVARIREALEGGKSFCGRLLNYKKDGTPFWNLLTISPIKDDDGNVLKLIGMLVEVNKHTEGSKEKKLRPNGLPESLIRYDARQKEKATSSVSELLEAMKRPRAMSESGHRPFIRKSGGGGSSEEDERLENKSRRKSDSVASFRPKPQGKIRHSMERISELPENKQKNSRRGSFMGFMRKSHSIDESIDNEVIVDVSSGSEDDERDDSFEFDDKEKLKEKRKGLDLATTLERIEKNFVITDPRLPDNPIIFASDSFLELTEYSREEILGKNCRFLQGQETDPATVRKIREAIDNQTEVTVQLINYTKSGKKFWNLFHLQPMRDHKGEVQYFIGVQLDGSQHVEPLHNCIAEESAKEGELLVKETAENVGEAVKELPDANQKPDDLWKNHSKVVRPKPHRKDDDAWRAIQNVVGNGEQVGLKHFRPIKPLGSGDTGSVHLVELEGTGHYFAMKAMDKGVMLNRNKVHRACTEREILDMLDHPFLPALYASFQTKTHVCLITDYYPGGELFLLLDQQPTKVLKEDSVRFYAAEVVIALEYLHCLGIIYRDLKPENVLIQRNGHVSLTDFDLSCLTSCKPQLILPATEEKKKRKNKKKKGQPKNQEVPMFMAEPMRASNSFVGTEEYIAPEIITGSGHTSAVDWWALGILLYEMLYGYTPFRGKTRQKTFGNILHKDLKFPKSKPVSPHGKQLIYWLLHRDPKNRLGSLEGANEIKNHPFFKNVNWALVRCMKPPELDAPILLDNDEKKEAKDIDPGLDDLQKNIF

SEQ ID NO: 18688 - protein, 247 aa, Xenopus laevis
MDKNELVQKAKLAEQAERYDDMAACMKRVTEEGGELSNEERNLLSVAYKNVVGARRSSWRVVSSIEQKTEGAEKKQEMSREYREKIEAELREICNDVLNLLDKFLIANATQPESKVFYLKMKGDYYRYLAEVAAGNAKTEIVGQSQKAYQDAFDISKTEMQPTHPIRLGLALKLLCVLTNEESSTVQDKACALAKAAFDEAIAELDTLSEESYKDSTLIMQLLRDNLTLWTSDTQGDEAEQGEGGEN

SEQ ID NO: 18689 - protein, 251 aa, Fucus vesiculosus
MASRDDLVYMAKLAEQAERFDEMVDHMKAVAQQPKELSVEERNLLSVAYKNVIGSRRASWRVISSIEGKDTVSDQLPLIRDYKSKIETELTDICADILKIIEAELIPNSTSEEGKVFYYKMKGDYHRYLAEFQSADERKTSASDALDAYQLASDHANQDLPPTHPIRLGLALNFSVFYYEILNSPDRACGLAKAAFDDAIAELDTLSEESYKDSTLIIMQLLRDNLTLWTSDQGEAEEAPGNADGTVVEDL

SEQ ID NO: 18690 - protein, 262 aa, Hordeum vulgare; identical to SEQ ID NO: 4454

SEQ ID NO: 18691 - protein, 259 aa, Solanum tuberosum
MADSREENVYMAKLAEQAERYEEMVEFMEKVAKVDVEELTVEERNLLSVAYKNVIGARRASWRIISSIEQKEESRGNEDHVSSIKEYRVKIEAELSKICDGILSLLESHLVPSASTAESKVFYLKMKGDYHRYLAEFKTGARERKEAAENTLLAYKSAQDIALAELTPTHPIRLGLALNFSVFYYEILNSPDRACNLAKQAFDDAIAELDTLGEESYKDSTLIMQLLRDNLTLWTSDTTDDAEDEIREGSKQESGDGQQ

SEQ ID NO: 18692 - protein, 254 aa, Solanum tuberosum
MASPREENVYMANVAARAERYEEMVEFMEKVVAALDTELTVEERNLLSVAYKNVIGARRASWRIISSIEQKEESRGNEDHVASIKKYRSQIENELTSICNGILKLLDSKLIGSAATGDSKVFYLKMKGDYYRYLAEFKTGTERKEAAENTLSAYKSAQDIANGELAPTHPIRLGLALNFSVFYYEILNSPDRACNLAKQAFDEAIADVDTLGEESYKDSTLIMQLLRDNLTLWTSDMQDDGADEIKEPSKADNE

SEQ ID NO: 18693 - protein, 251 aa, Nicotiana tabacum
MDKEREKQVYLARLAEQAERYDEMVEAMKTVAKMDVELTVEERNLVSVGYKNVIGARRASWRILSSIEQKEESKGHDQNVKRIKTYQQRVEDELTKYALTLSVIDEHVVPSSTSGESTVFYYKMKGDYYRYLAEFKSGDDRKEAADQSLKAYEAATATASADLAPTHPIRLGLALNFSVFYYEILNSPERACHLAKQAFDEAIAELDSLSEESYKDSTLIMQLLRDNFTLWTSDLEEGGEHSKGDERQGEN

SEQ ID NO: 18694 - protein, 262 aa, Trichoderma harzianum
MGHEDAVYLAKLAEQAERYEEMVENMKIVASEDRDLTVEERNLLSVAYKNVIGARRASWRIVTSIEQKEESKGNSSQVTLIKEYRQKIENELAKICDDILEVLDQHLIPSAKSGESKVFYHKIKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETPARLMPLLRRRPLLRLPSRRRRAQG

SEQ ID NO: 18695 - protein, 242 aa, Actinobacillus actinomycetemcomitans
MSETILITGSSRGIGKAIALRLAQAGFDIVVHCRSRIEEAEAVAQAVRELGQNARVLQFDVSCRSEAADKLTADVEAHGAYYGVVLNAGLTRDNAFPALTDEDWDRVLRTNLDGFYNVLHPIMMPMIRRRKAGRIVCITSVSGLIGNRGQVNYSASKAGIIGAAKALAVELAKRKITVNCVAPGLIDTDILDENVPIDEILKMIPAGRMGDPEEVAHAVNFLMGEKAAYVTRQVIAVNGGLC

SEQ ID NO: 18696 - protein, 255 aa, Mycobacterium smegmatis
MTVTDNPADTAGEATAGRPAFVSRSVLVTGGNRGIGLAIARRLAADGHKVAVTHRGSGAPDDLFGVQCDVTDSAGVDRAFKEVEEHQGPVEVLVANAGISKDAFLMRMTEERFEEVINTNLTGAFRCAQRASRTMQRKRFGRIIFIGSVSGMWGIGNQANYAAAKAGLIGMARSISRELDKAGVTANVLPPGYIDTEMTRALDERIQGGAIDFIPDKRVGTVEEVAGAVSFLASEDASYIAGAVIPVDGGMGMGH

SEQ ID NO: 18697 - protein, 281 aa, Candida albicans
MSEEIISFTNPALGPLPTKAPQLPSNVLDLFSLKGKVASVTGSSGGIGWAVAEAFAQAGADVAIWYNSKPADAKAEYLTEKYGVKAKAYKCNVTDPNDVSKVINEIEKDFGTIDIFVANAGVAWTDGPEIDVQGYDQWKKIVDCDLNGVYYCAHTVGQIFKKNKSGSLIITSSMSGTIVNIPQLQAPYNAAKAACTHLAKSLSVEWASFGARVNSISPGYILTDIADFADPEMKKKWWQLTPLGREGLPQELVGAYLYLASNASTYTTGSNIAVDGGYTCP

SEQ ID NO: 18698 - protein, 280 aa, Candida albicans
MSKETTSYTNAKLGPLPTKAATIPDNILDAFSLKGKVASVTGSSGGIGWAVAEGYAQAGADVAIWYNSHPADDKAEYLTKTYGVKSKAYKCNVTDFQDVEKVVKQIESDFGTIDIFVANAGVAWTEGPKFDVKGVDKWNKVVDVDLNSVYYCAHVVGPIFRKKGKGSFIFTASMSASIVNVPQLQAAYNARKAGVKHLSKSFTVEWAPFARVNSVSPGYIATHLSEFADPDVKSKWLQLTPLGREAKPRELVGAYLYLASDAASYTTGADLAVDGGYTVI

SEQ ID NO: 18699 - protein, 261 aa, Escherichia coli
MSIESLNAFSMDFFSLKGKTAIVTGGNSGLGQAFAMALAKAGANIFIPSFVKDNGETKEMIEKQGVEVDFMQVGITAEGAPQKIIAACCERFGTVDILVNNAGICKLNKVLDFGRADWDPMIDVNLTAAFELSYEAAKIMIPQKSGKIINICSLFSYLGGQWSPAYSATKHALAGFTKAYCDELGQYNIQVNGIAPGYYATDITLATRSNPETNQRVLDHIPANRWGDTQDLMGAAVFLASPASNYVNGHLLVVDGGYLVR

SEQ ID NO: 18700 - protein, 318 aa, Pachysolen tannophilus
MTLQYYTLNNGRKIPAIGMGCWKLENAADMVYAAIKEGYRLFDCACDYGNEKEVGEGINRAIKDGLVKRKDLFITSKLWNNFHAKENVKKALMKSLSDFNLDYFDLYLMHFPISFKFVPFEEKYPPGFYCGDGDKFIYEDVPIIETWRAMENLVDEGLVKSIGVSNVSGGLLEDLIKAARIKPASLQIEHHPYLQQNKLVEYAQLKGIVVTGYSNFGPLSFLELGNETAKKTQPLYENKTITTIAAKHGKTPFQVLLRWVNQRGIAIIPKSTFPNTLAVNLHVDEFDLTKEDFEEIAKLDRHLRFNDPWTWDKIPTFV

SEQ ID NO: 18701 - protein, 189 aa, Pisum sativum
MAFSNALVLCFLLAIINMALPSLATVYTVGDTSGWVIGGDYSTWASDKTFAVGDSLVFNYGAGAHTVDEVKESDYKSCTSGNSISTDSTGATTIPLKKAGKHYFICGVPGHSTGGMKLSIKVKASSGSSAAPSATPSSSGKGSPSSDDTPAATTTTTTPTKQNESSATSLSPIVALFFTVSWICSYVLV

SEQ ID NO: 18702 - protein, 108 aa, Cucurbita pepo
ATVHKVGDSTGWTTLVPYDYAKWASSNKFHVGDSLLFNYNNKFHNVLQVDQEQFKSCNSSSPAASYTSGADSIPLKRPGTFYFLCGIPGHCQLGQKVEIKVDPGSSSA

SEQ ID NO: 18703 - protein, 578 aa, Nicotiana tabacum
MASLGFLFFFLLPLILLELSSSRSVMAAKTRHFKWDVEYIHWSPDGEESVVMGINGQFPGPTIRAKAGDTVAVHLTNKLHTEGVVIHWHGIRQIGTPWADGTAAISQCAINPGETFLYRFKVDKAGTYFYHGHYGMQRSAGLYGSLIVEVGEGEKEPFHYDGEFNLLLSDWWHKGSHEQEVDLSSNPLRWIGEPQTLLLNGRGQYNCSLAARFSKPPLPQCKLRGGEQYAPQILRVRPNKIYRLRVASTTALGSLSLAIGGHKMVVVEADGNYVQPFSVQDMDIYSGESYSVLFKTDQDPTKNYWISINVRGREPKTPQGLTLLNYLPNSASKFPTLPPPIAPLWNDYNHSKSFSNKIFALMGSPKPPPQNHRRIILLNTQNKIDGYTKWAINNVSLVLPTQLYLGSIRYGINAFDTKPPPDNFPKDYDVLKQAPNSNSTYGNGVYMLKFNTTIDIILQNANALAKDVSEIHPWHLHGHDFWVLGYGEGKFSEKDVKKFNLKNPPLRNTAVIFPFGWTALRFVTDNPGVWAFHCHIEPHLHMGMGVIFAEGVHLVKKIPKEALACGLTGKMLMSNKHN

SEQ ID NO: 18704 - protein, 624 aa, Candida albicans
MRTFLSSFIILTTFLASLIAAETHTWYFKTGWVDANPDGVYPRKMIGFNDSWPLPTLRVKKGDRVQLYLINGFDNLNTTLHFHGLFVRGANQMDGPEMVTQCPIPPGETYLYNFTVTDQVGTYWYHSHTGGQYGDGMRGVFIIEDDDFPYHYDEEVVLTLSDHYHKYSGDIGPAFLTRFNPTGAEPIPQNFLFNETRNATWKVEPGKTYFVRILNVGGFVSQYLWMEDHEFTIVEIDGVYVEKNTTDLIYITVAQRYGVLITTKNSTDKNYVFMNGVDTTMLDSVPADLQVNGTNYIVYNESSALPDAYDIDSYDDALDDFYLKPLSKQKLMDDADYTITVDVQMNVLNDGINYAFFNNISYKAPKVPTLLTVLSAGEAATNELIYGTNTNSFVLQGGDIVDIVLNNFDTGKHPFHLHGHVFQLIERHEAIGSKESAVTFNVSDHAEWPEYPMIRDTVYVKPHSYMVLRFKADNPVVWFFHCHVDWHLEQGLAVVLIEDPQAIQKNEKITENHKRICEKVGVPWEGNAAANSNDYLDLKGENVQVKRLPTGFTTKGIVALVFSCVAAFLGLFSFSFYGMNDIAHVEDKVARDLDIDLEAENEDEEEAVVLNQNSSSSDSNSKPH

SEQ ID NO: 18705 - protein, 511 aa, Mesocricetus auratus
MWELVALLLLTLAYFFWSKSKTCGAKSPKSLPFLPLVGSLPFIPRHGHPHVNFFKLQEKYGPIYSLRLGSTTTVIIGQYQLAKEVLVKKGKEFSGRPHMVTLGLLSDQGKGIAFADSGGSWQLHRKLALSSFALFRDGNQKLEKIICQKASSLCDFLLTHNEESIDLSEPIFNSITNIICIICFGISYENRDPILATIKSFTEGILNSLGNDHLVDIFPWLTIFPNKTVDMIKKNVKIRDEVLSGILEKCKEKFNSDSISSLMDLLIQAKTNADNNNTSEGQGSNAFSDMHILATIADIFGAGIETTASVLSWIIAFLLHNPEVKKKIQKEIDQNIGFSRTPTFNDRNHLLMLEATIREVLRIRPVAPMLIPHRANSDMSIGEFSIPKFTPVIINLWALHHSEKEWDQPDRFMPERFLDPTGSHLITPSLSYLPFGAGARSCIGEVLARQELFLFMAHLLQRFDLDVPDDEQPPCLKGNANVVFLIDPFKVKITVRQAWKDAQAEVNTWRP

SEQ ID NO: 18706 - protein, 250 aa, Sphingomonas paucimobilis
MANRLAGKVALITGGASGLGAAQAKRFAEEGAKVVIGDLNEEMAKGVVAEIRAAGGDALFIRLDVTDAASWNNAIAAAVEAFGGLTTLSNTAGIIHPGGFEEESIEGWNKMVAVNQTAIFLGIKAAIPELVKSGNGSIINISSLIGMFPTAGNASYCATKAAVRIMSKAAALEFVDRGVRVNTIVPGGMNTPITANVPPDVLKQQTSQIPMGKLGDPIDIANGALFLASDEAKYITGVDLPIDGGWSVGV

SEQ ID NO: 18707 - protein, 250 aa, Sphingomonas paucimobilis
MSNRMAGKVALVTGAASGLGAAQARLFAKEGAKVVVADLNVEMGNKVVAEIQESGGEALFVRLDITDAASWAGAVEAAVGAFGKLTTLSNTAGIIHGAMIQDETLEGWSKMIAVNQTALFLGLKIVAPEIAKSGNGAILNISSLVSVICEPGLISYAATKSAVRAMTKVAALEYVGQGVRVNTIVPGGVKTPIQANVTPEQVEWYKAQIPMGDLGEPNDIAYGALYLLSDEAKYVTGTELFIDGGWSSAA

SEQ ID NO: 18708 - protein, 627 aa, Medicago truncatula
MEETKFCALAFICAFFLLLLHPLWLVSANMEGDALHNLRTNLQDPNNVLQSWDPTLVNPCTWFHVTCNNDNSVIRVDLGNAALSGTLVPQLGQLKNLQYLELYSNNITGPIPSDLGNLTNLVSLDLYLNRFNGPIPDSLGKLSKLRFLRLNNNSLMGPIPMSLTNISALQVLDLSNNQLSGVVPDNGSFSLFTPISFANNLNLCGPVTGHPCPGSPPFSPPPPFVPPPPISAPGSGGATGAIAGGVAAGAALLFAAPAIAFAWWRRRKPQEFFFDVPAEEDPEVHLGQLKRFSLRELQVATDTFSNKNILGRGGFGKVYKGRLADGSLVAVKRLKEERTPGGELQFQTEVEMISMAVHRNLLRLRGFCMTPTERLLVYPYMANGSVASCLRERPPHQEPLDWPTRKRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLKTNYIEAEVEQLIQVALLCTQGSPMDRPKMSDVVRMLEGDGLAERWDEWQKGEVLRQEVELAPHPNSDWIVDSTENLHAVELSGPR

SEQ ID NO: 18709 - protein, 391 aa, Carassius auratus
MASRGFAPLSGRQENIMVLGRADGLHALKPGQRVVLGVLTENDQHNRVFGQVSSKYVPALRDASTLDVSTSSATLGVHVVEPVIAQATKPTSFLLPSELLLVDDVVQDLGSGSCMDSSMQSLPEEAAYEDILCVPEYAEDIHRYLRECEVKYRPKPGYMRKQPDITNCMRVILVDWLVEVGEEYKLCSETLFLAVNYLDRFLSCMSVLRGKLQLVGTAAVLLAAKYEEVYPPEVDEFVYITDDTYTKKQLLRMEQHLLRVLAFDMTAPTVHQFLMQYTLEGHICARTVNLALYLSELSLLEVDPFVQYLPSKTAAAAYCLANYTLNGVLWPENLYAFTGYSLAVIIPCLMELHKLHLGAAGRPQQAIQEKYKGSKYCGVSLLEPVESLPLP

SEQ ID NO: 18710 - protein, 397 aa, Carassius auratus
MALRVTRNTRLASSENQGALPGKAAVANKPGLRPRAALGEIGNNPQTRQALRKKEVKVAPKVEAVAEKAPVVQQPKKESPKVQHDVQILSEPSSPVPMETSGCASDDLCQAFSDVMLNIKDVDADDYDNPMLCSEYVKDIYLYLRQLEIEQAVRPKYLEGSEVTGNMRAILIDWLVQVQIKFKLLQETMYMTVAVIDRFLQDHPVPKKQLQLVGVTAMFIASKYEEMYPPEIADFAFVTDRAYTTGQIRDMEMKILRVLDFSFGKPLPLQFLRRASKIGDVTAEHHTLAKYFLELTMVDYDMVHFPPSQVASARYALTLKVFNCGDWTPTLQHYMGYTEDSLVPVMQHIARNVVRVNEGLSKHLAVKNKYSSQKQMRIASISQLKSSLIKDLAKQIS

SEQ ID NO: 18711 - protein, 216 aa, Staphylococcus xylosus
MFKFLKRIKDDVNMVFEQDPAARTTLEVITSYAGVHAVWSHLIAHELYKKKKYVLARLISQVTRFFTGIEIHPGAQIGRRLFIDHGMGVVIGETCRIGDNVTIYQGVTLGGTGKERGKRHPDIGDNVLIAAGAKVLGNITINANVNIGANSVVLNSVPSYSTVVGIPGHIVKQDGRRIGKTFDHRNLPDPIYEQLKELEKQLEKTRNGEIQDDYII

SEQ ID NO: 18712 - protein, 244 aa, Synechococcus sp. PCC 7942
MFKTLAADFRIIFERDPAARNGLEVLLCYPGFQALVCHRVAHWLYQQRLPVIPRLLSHLSRLLTGVEIHPGARLGQGIFIDHGMGVVIGETAIVGDYCLIYQGVTLGGTGKQSGKRHPTLANNVVVGAGAKVLGNIQIGENVRIGAGSVVLRDVPSDCTVVGIPGRVIYRSGVRVDPLDHSQMPDSEARVIRMLLDRIEALEDQLEGLNLPPAEEAIDVTLAPVGDRCQLRDRTIEEFLDGAGI

SEQ ID NO: 18713 - protein, 976 aa, Pisum sativum
MKSITCYLLVFFCVLFTPCFSITDLDALLKLKESMKGEKSKHPDSLGDWKFSASGSAHCSFSGVTCDQDNRVITLNVTQVPLFGRISKEIGVLDKLERLIITMDNLTGELPFEISNLTSLKILNISHNTFSGNFPGNITLRMTKLEVLDAYDNSFTGHLPEEIVSLKELTILCLAGNYFTGTIPESYSEFQKLEILSINANSLSGKIPKSLSKLKTLKELRLGYNNAYDGGVPPEFGSLKSLRYLEVSNCNLTGEIPPSFGNLENLDSLFLQMNNLTGIIPPELSSMKSLMSLDLSNNALSGEIPESFSNLKSLTLLNFFQNKFRGSIPAFIGDLPNLETLQVWENNFSFVLPQNLGSNGKFIFFDVTKNHLTGLIPPDLCKSKKLQTFIVTDNFFHGPIPKGIGACKSLLKIRVANNYLDGPVPQGIFQMPSVTIIELGNNRFNGQLPSEVSGVNLGILTISNNLFTGRIPASMKNLISLQTLWLDANQFVGEIPKEVFDLPVLTKFNISGNNLTGVIPTTVSQCRSLTAVDFSRNMITGEVPRGMKNLKVLSIFNLSHNNISGLIPDEIRFMTSLTTLDLSYNNFTGIVPTGGQFLVFNDRSFFGNPNLCFPHQSSCSSYTFPSSKSHAKVKAIITAIALATAVLLVIATMHMMRKRKLHMAKAWKLTAFQRLDFKAEEVVECLKEENIIGKGGAGIVYRGSMPNGTDVAIKRLVGQGSGRNDYGFKAEIETLGRIRHRNIMRLLGYVSNKDTNLLLYEYMPNGSLGEWLHGAKGCHLSWEMRYKIAVEAGKGLCYLHHDCSPLIIHRDVKSNNILLDADFEAHVADFGLAKFLYDPGASQSMSSIAGSYGYIAPEYAYTLKVDEKSDVYSFGVVLLELIIGRKPVGEFGDGVDIVGWINKTELELYQPSDKALVSAVVDPRLTGYPMASVIYMFNIAMMCVKEMGPARPTMREVVHMLTNPPQSTTHNNLINL

SEQ ID NO: 18714 - protein, 1154 aa, Mesocricetus auratus
MAGAGYQHHPPGGAAVGTSAVSPTAAGPGEDSSDSEAEQGGPQKLIRKVSTSGQIRTKTSIKEGQLLKQTSSFQRWKKRYFKLRGRTLYYAKDSKSLIFDEVDLSDASVAEASTKNANNSFTIITPFRRLMLCAENRKEMEDWISSLKSVQSREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKAMVHTACKDLYHPVCPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPAKASLLPEPPEASGGFYMTIYEDSVANHLTKILNSDEHAVVISSAKILCETVKDFVAKVEKAQDKTLENTVVAEAVANKCSVLNEKLEQLLQALHADAQASRVPPGVGPAIPEEDAVESSSEESLGESKDQLVNDIAKPSSQKAVKPREIMLRANSLKKAVRQVIEEAGKVMDEQTVQPCEPVSPSCDYDSPEADDSKDNDTKESPAAKSTSQAPEAQAIRGHFQTDSVAGSAMATTKENLPVLNTRIICPGLRAGLAASIAGSSIINKMLLANIDPFGATPFIDPDLDSLDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAVFDSVQMAVSRVIKLQHHRIAQCRTVKITIFGDEGVPVQVDGEAWVQPPGIIKIVHKNRAQMLTRDRAFESTLKSWEDKQKCDSGKPVLRTNLYIHPAADLATEEVSQMRLCSQAAEELITRICDAATIHCLLGAGTGSSVNACSHALNKANPRFPESLTRDTATEIAINVKALYNETESLLVGRVPLQLESPHEERVSSALHSVEVELQKLTEIPWLYYILRPNEDEEPPMDCTKRNSKSTVFRIVPKFKMEKAQKQKTSSQPGPGDTESGSYEANSPGN

SEQ ID NO: 18715 - protein, 276 aa, Crithidia fasciculata
MALTQSLKLSNGVMMPVLGFGMWKLQDGNEAETATMWAIKSGYRHIDTAAIYKNEESAGRAIASCGVPREELFVTTKLFNSDQGYESTLSAFEKSIKKLGLEYADLYLIHWPGKDKFINTWKAFEKLYADKKVRAIGVSNFHEHHIEELLKHCKVAPMVNQIELHPLLNQKALCEYCKSKNIAVTAWSPLGQGRLVEDARLKAIGGKYGKTAAQVMLRWEIQAGVITIPKSGNEARIKENGNIFDFELTAEDIQVIDGMNAGHRYGPDPEVFMNDF

SEQ ID NO: 18716 - protein, 501 aa, Macroscelides proboscideus
MSSSGMPDLPAPLTNIKIQHTKLFINNEWHDSVSGKTFPVFNPATEEKICEVEEADKEDVDKAVKAAREAFQMGSPWRTMDASERGQLIYKLADLIERDRLLLATLESINAGKIFASAYLMDLDYCIKVLRYCAGWADKIQGRTIPVDGEFFSYTRHEPIGVCGQIFPWNAPMILLACKIGPALCCGNTVIVKPAEQTPLTALHVASLIKEAGFPPGVVNIVPGYGPTAGAAISSHMDVDKVAFTGSTEVGKMIQEAAAKSNLKRVTLELGAKNPCIVFADADLDSAVEFAHQGVFTNQGQSCIAASKLFVEETIYDEFVQRSVERAKKYVFGNPLTPGVNHGPQINKAQHNKIMELIESGKKEGAKLECGGGPWGNKGYFIQPTIFSNVTDDMRIAKEEIFGPVQQIMKFKSLDEVIKRANNTYYGLVAGVFTKDLDKAVTVSSALQAGTVWVNCYLAASAQSPAGGFKMSGHGREMGEYGIHEYTEVKTVTMKISEKNS

SEQ ID NO: 18717 - protein, 498 aa, Leishmania tarentolae
MLRATLARLEMAPKVTHIQEKLLINGKFVPAVSGKTFEVVNPADEKVIANVAEAEKADVDLAVKAARHAFESFRMTDCQWRRNLMLRLADILEKNSKEMAALESLDNGKPYEVALNVDVALSVECFRYCAGLADKVNGTVPPRSGNFLGIVKRQPIGVCGQIIPWNFPLLMAAFKLSPALAMGNTVVLKPAEQTPLTAVRLGEMVMEAGYPDGVLNILPGFGATAGSEIARHMDVDKIAFTGSTAVGHQVMQMAAETNLKKVSLELGGKSALIVCEDADLEEAAEVATTRVYFNTGQVCTASSRIYVHESVYDEFVSRLRKNAEARKVGPGNDTGNNMGPLVSKKQHERVLGYIEDGVKAGATVVTGGKKIGDKGYFVQPTIFSDVKEDMRICKEEIFGPVTCVMKYKDMDEVVKRANDSIYGLAAGICTRSMDTALRYSTYLNAGTVWVNTWNNFCPSMPFGGFKQSGIGRELGKEVVDMYTEPKAIHFASRSIVKP

SEQ ID NO: 18718 - protein, 497 aa, Enchytraeus buchholzi
MSAPKIPEPVKDLKVEFTKIFINNEFVDSVSGKTFATINPSTGEKLAEVQEGDKADIDKAVAAARAAFKRDAEYRKHDASDRGRLLFKLADLIEAHRVQLRTLETLDNGKPFAMSYLGDTLMAQKVLRYYAGFADKIVGQTIPADGNVFCYTRHEPVGVVGAITPWNFPLHLAASKIAPAIAAGCTLVLKPAEQTPLTALYLASLVKQAGFPAGVINIVPGLGHTAGAALTNHPDINKITFTGSTEVGQLIIQGSGKTNLKRVTLELGGKSPNIIFPDSDLDYAVEVSHQAIMANMGQVCCAGSRTFVHEDIYEEFVRRSVERAKKRTVGDPFDPKNENGPQVDETQLKKILELIESGKTEGAKLECGGKRLGDKGYFVEPTVFTDVTSSMRVAKEEIFGPVQLIFKFKDVDEVIERANDTSYGLAAAVFTKNIDTALKVANSLEAGTVWVNTYNHFAFQAPFGGYKMSGQGREFGHYGLEAFLEVKTVYVRTPTKL

SEQ ID NO: 18719 - protein, 505 aa, Hordeum vulgare
MAAPPAIPRRGLFIGGGWREPTLGRHIPVINPATEDTIGDIPAATAEDVELAVAAGGPVLARRREPWARASGATRAKYLNAIAAKITGKIAYLALLETVDSGKPKDEAVADMDDVAACFEYYAALAEALDGKQHAPISLPMEEFKTYVLKEPIGVVGLITPWNYPLLMATWKVAPALAAGCTAVLKPSELASLTCLELGAICEEIGLPSGVLNIITGLGPDAGAPIASHPHVDKIAFTGSTATGKTIMTAAAQMVKPVSLELGGKSPLVTFDDVADIDKAVEWPMLGCFFNGGQVCSATSRLLLHEKIAEPFLDRLVEWAKNIKISDPLEEGCRLGSVISKGQYEQIKKFISTARSEGATILHGGDRPKHLGKGFFIEPTINTGVSTSMQIWREEVFGPVICVKVFKTESEAVELANDTHYGLAGGVISDDLERCERIAKVIHSGIVWKNCSQPTLVQAPWGGNKRSGFGRELGEWGLENYLSVKQVTRYCKDELYGWYQRPSKL

SEQ ID NO: 18720 - protein, 528 aa, Kluyveromyces lactis
MSTNNRLLPHGRADELNNLENASSNNKGVTFTPHLLLSMLVACLGSLQYGYHMGELNAPEDYITCKAELNPGYADSFLGRLGLAQCIPLTDSQFGLITSVFSVGGLIGSLVAGPLADSYGRKPISYWNCSVGILGAVCLFSSNNYLGMLFGRLLAGISCGSLIVVTPLFINEMSPVHLKGSLGSMNQVSINCGILVTQSLAMLWANMLQWRWILLFGGLISLLNFGLLFRINESPRWLVSKGNMTDAEDVLSQLRGNSRQESRQEIDGWLQGSQPVRTFSDLEAHTNSQMNLGSNLNLERPSSTRSSLRDSESITVVEYWKDPKYKYPRRVITTILMAQQFCGINSIVFYGVKVIKKAFPDTAIIINFAISIVNVLMTFFSSPLVDHWGRKPLLISSSTLMSICSFMICFGIVGNAPMILVIFVILYITAFAGGLGPIPFLIISELSHPETVGVAQSYGTTMNWIATFMVGYGFPALNSVMDGYVFLLFSAVAICFSFYVYRFVPETKGKLDYTDIWKSHDPRIAYTQ

SEQ ID NO: 18721 - protein, 344 aa, Synechococcus sp. PCC 7942
MAQSTTSETHTRDLDRDCTTLSRHVLEQLQSFSPEAQDLAALMQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREAYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 18722 - protein, 402 aa, Glycine max
MAAATASTQLIFSKPCSPSRLCPFQLCVFDTKQVLSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAASTGSNFWIYSPNDECLADIDDDPTLDTTEQRCIVNVCQPGSNLLAAGYCMYSSSIIFVLTLGNGVFVFTLDPMYGEFVLTQENLQIPRAGKIYAFNEGNYQLWDEKLKKYIDDLKDPGQSGKPYSARYIGSLVGDFHRTLLYGGIYGYPRDKKSKNGKLRLLYECAPINFIVEQAGGKGTDGLQVLRLQGTEIHQRVPLYIGEEVEKVEKYLA

SEQ ID NO: 18723 - protein, 329 aa, Beta vulgaris
MTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 18724 - protein, 331 aa, Saccharum sp.
MTITRHVLNEQSRNPESRGDFTILLSHIVLGCKFVASAVNKAGLAQLIGLAGETNVQGEEQKKLDVLSNEVFVKALVSSGRTCVLVSEEDEETTFVDPKLRGKYCVCFDPLDGSSNIDCGVSIGTIFGIYMIKDKDNVTLSDVLQPGKDMLAAGYCMYGSSCTLVLSTGTGVNGFTLDPSLGEFILTHPDIKIPKKGKIYSVNEGNAKNWDVPVAKFVEKCKYPKDGSPPKSLRYIGSMVADVHRTLLYGGVFLYPADQKSPNGKLRVLYEVFPMSFLMEQAGGQSFTGKERALDLVPTKIHERSPIFLGSYDDVEEIKALYAEQAKSSSA

SEQ ID NO: 18725 - protein, 112 aa, Rhodospirillum rubrum
MKKIEAIIKPFKLDEVKEALHEIGLQGITVTEAKGFGRQKGHTELYRGAEYVVDFLPKVKIELVIEDALVERAIEAIQQAAQTGRIGDGKIFVYAIEEAIRIRTGERGGDAI

SEQ ID NO: 18726 - protein, 112 aa, Synechocystis sp. PCC 6803
MKKVEAIIRPFKLDEVKIALVNAGIVGMTVSEVRGFGRQKGQTERYRGSEYTVEFLQKLKIEIVVDEGQVDMVVDKLVSAARTGEIGDGKIFISPVDSVVRIRTGEKDTEAI

SEQ ID NO: 18727 - protein, 112 aa, Fremyella diplosiphon
MKKVEAIIRPFKLDEVKIALVNAGIVGMTVSEVRGFGRQKGQTERYRGSEYTVEFLQKLKVEIVVEDNQVDMVVDKIIAAARTGEIGDGKIFISPVEQVVRIRTGEKNTEAV

SEQ ID NO: 18728 - protein, 105 aa, Methanococcus maripaludis
MKMIRAVVRPSKAEEVVDALAESGCLALTKMDVIGRGKQKGIKIDQIYYDELPKTMLMLVVEDDTAENVIELITKTAYTGSFGYGKIFVSPVDEAYTVRTRSCGL

SEQ ID NO: 18729 - protein, 121 aa, Methanococcus maripaludis
MKEIIAIIRPSKMAQTKTVLEGLGFPAMTANRVLGRGKQKAIVGELGFEVDNKELLNQPGDMRYIPKTMLTLIVPDEDASLVVEAIMKVNKSGQYGDGKIFVCPIEDIITVRTSERGEAAI

SEQ ID NO: 18730 - protein, 105 aa, Methanothermobacter marburgensis str. Marburg
MKMIRAIIRPEKSEEVADALDDAGFPALTKIDVIGRGKQKGIRFDEIYYDEIPKTMMLIVVDDADAERVVLVISASGYTGKIGDGKIFISPVENAYTVRTREEGL

SEQ ID NO: 18731 - protein, 121 aa, Methanothermobacter marburgensis str. Marburg
MKEVIAIIRPKNMKKTRDVLESLGFPSFNATRVLGRGKQRAIIDEVTIPSPSPEIDEVRGTMRYIPKRMIQITVEDPDVQLVVEAIMKVNHTGKIGDGKIFVCPVDDAMRIRTGDRGTEAL

SEQ ID NO: 18732 - protein, 395 aa, Erwinia chrysanthemi
MLDQQTIATIKSTIPLLAETGPALTAHFYQRMFHHNPELKDIFNMSNQRNGDQREALFNAICAYATHIENLPALLPAVERIAQKHASFNIQPEQYQIVGTHLLATLEEMFQPGQAVLDAWGKRYGVLANVFIQRESDIYQQSAGQNGGWHGIRPFRIVAKQPQSSLITSFTLEPVDGGPIAAFRPGQYLAVYIRDKRFEYQEIRQYSLTNEPNGRYYRIAVKRETMGSVSGYLHDVAREGDVIELAAPHGDFYLEVTPETPVALISAGVGQTPMLSMLHSLKNQQHQADIFWLHAAENTEVHAFADEIADVAATLPQLQSYVWYREASSEAARSAHAFHGLMALKDLPTPLPMTNLHCYLCGPVAFMQFAARQLLELGITESQIHYECFGPHKVI

SEQ ID NO: 18733 - protein, 353 aa, Cryphonectria parasitica
MGCGMSTEEKEGKARNEEIENQLKRDRMQQRNEIKMLLLGAGESGKSTILKQMKLIHEGGYSRDERESFKEIIFSNTVQSMRVILEAMESLELPLEDQRMEYHVQTIFMQPAQIEGDVLPPEVGSAIEALWKDRGVQECFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 18734 - protein, 353 aa, Emericella nidulans
MGCGMSTEDKEGKARNEEIENQLKRDKMMQRNEIKMLLLGAGESGKSTILKQMKLIHEGGYSRDERESFKEIIYSNTVQSMRVILEAMESLELPLEDARNEYHVQTVFMQPAQIEGDSLPSEVGNAIAALWQDAGVQECFKRSREYQLNDSAKYYFDSIERIAQSDYLPTDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGADYAAACDYILNRFVSLNQAEQKQIYTHFTCATDTTQIRFVMAAVNDIIIQENLRLCGLI

SEQ ID NO: 18735 - protein, 353 aa, Ustilago maydis
MGCGASKVDKEGQARNDAIDAQLKKDRLAQKNEIKMLLLGAGESGKSTILKQMKLINHGSYSAEERESYKEIIFSNTVQSMRVLLDAMERLDIPLADATNAPRAEIILGLSPSIESSVLPRQVADAIHALWGDAGVQACFGRSREYQLNDSAKYYFDSIQRMAEPSYLPTDQDVLRSRVKTTGITETHFKIGELNYKLFDVGGQRSERKKWIHCFENVTAIIFLVAISEYDQLLYEDENVNRMQEALTLFDSICNSRWFVKTSIILFLNKIDLFKQKLPISPMADYFSDYTGGADYNSASEYIVNRFVSLNQSDAKTIYTHFTCATDTSQIKFVMSAVNDIIIQVNLRDCGLL

SEQ ID NO: 18736 - protein, 356 aa, Ustilago maydis
MGACLSAEQSHDTPEYKRSKALDRRIKEDEKNLSREVKLLLLGAGESGKSTILKSMRIIHHIPFTDEERENFRRLVFLNLVQGMKTILDVMEEWSIDFQDDSNIDHLLLFVSYPDISEDEPFPTNYLVALKDLWLDQGVQSVYRRGNEAAVPDNMSYYYTDLDRLFSPSYIPSEDDILRCRNKTTGIIETTFPLQDHVYRIFDVGGQRSERKKWIHCFENVTAVLFCVALSGYDSCLVEDKDSNQMQEALMLFDSICNSKWFARTSMILFLNKVDVFRQKIAYSSIKHYFPDYDGDDQDFNAARSYFKARFCRLNRSVNKEIYPSFTNATDVSLLKIVMASVTDIILTNNLRDIVL

SEQ ID NO: 18737 - protein, 354 aa, Ustilago maydis
MGNCLSSSDQKEAKDRSVAIDKQIEEDSRKFKKECKILLLGSGESGKSTIVKQMKIIHQNGYTKDELLLYRLTVIKNLVDSAQAMVLALRKFKMEPEMPENRENVDAILQYRVDADPGATLDHAMARKVDSLWKDPIVPAIMERSSEFYLMDSAAYFFDNVNRIGQSDYVPNENDVLRARSKTTGISETRFNMGQLSIHLFDVGGQRSERKKWIHCFEAVTSIIFCVALSEYDQVLLEESGQNRMAESLVLFESVVNSRWFLRTSVILFLNKIDIFKQKIPKQPLSKYFPEYSGGPDINKAAKYILWRFTQTNRARLSIYPHLTQATDTSNIRLVFAAVKETILTNALKDSGIL

SEQ ID NO: 18738 - protein, 580 aa, Ustilago maydis
MSPSVSSPQLRHTKSNRAISRIDRTDPLALALQPPANEAPADKYARLHQEKLAKQRSDEIDKFLKQHQEDRATHGLASSPSTSVDGANFKKGRVYKMVLLGQAGAGKTTVLKQMRLLYDPPAHERERRGWTKIVLLNLTSSVRVLLETLSLYHDQRLERKSSELSRLESSTSASTSTSASASSPKHVDTESQPNDATRLELAKQLGTTKKINTSSLPWLTHIPSVVQLERALRTELGAFGEEAVLSASSDEAAITNQKVRTRLDAQGSSSIRGEKSPLVLRPGWQERLFTYARRSLSLTQNGRAAAARRETDGGDSQSESEKDNSETLKLLRAIRPEVLALWNDDAGCRALRKRGLFLDGQSDAATSYFLDNYSRITDAAYRPTDEDILHSRVRTLGVTEDVFRVDRSLIYRIYDVGGSRSQRAAWAPFLDDIESIIFLAPLSAFDQPLVEDCSTNRLADTFTLFNQIVTNPLLEHATMILFLNKIDLLEKKLRQGVQLHKYWPEYVGDNDFEAVWRWFRAKFRDALRRAEDEVNLDQTSRRRLYVHTTVATSTVQIRAILMSVKDSILRENLKLTGLVG

SEQ ID NO: 18739 - protein, 350 aa, Canis familiaris
MGAGASAEEKHSRELEKKLKEDAEKDARTVKLLLLGAGESGKSTIVKQMKIIHQDGYSLEECLEFIAIIYGNTLQSILAIVRAMTTLNIQYGDSARQDDARKLMHMADTIEEGTMPKEMSDIIQRLWKDSGIQACFERASEYQLNDSAGYYLSDLERLVTPGYVPTEQDVLRSRVKTTGIIETQFSFKDLNFRMFDVGGQRSERKKWIHCFEGVTCIIFIAALSAYDMVLVEDDEVNRMHESLHLFNSICNHRYFATTSIVLFLNKKDVFSEKIKKAHLSICFPDYDGPNTYEDAGNYIKVQFLELNMRRDVKEIYSHMTCATDTQNVKFVFDAVTDIIIKENLKDCGLF

SEQ ID NO: 18740 - protein, 353 aa, Canis familiaris
MACCLSEEAKEARRINDEIERQLRRDKRDARRELKLLLLGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPAYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNLV

SEQ ID NO: 18741 - protein, 377 aa, Homo sapiens
MADFLPSRSVLSVCFPGCLLTSGEAEQQRKSKEIDKCLSREKTYVKRLVKILLLGAGESGKSTFLKQMRIIHGQDFDQRAREEFRPTIYSNVIKGMRVLVDAREKLHIPWGDNSNQQHGDKMMSFDTRAPMAAQGMVETRVFLQYLPAIRALWADSGIQNAYDRRREFQLGESVKYFLDNLDKLGEPDYIPSQQDILLARRPTKGIHEYDFEIKNVPFKMLDVGGQRSERKRWFECFDSVTSILFLVSSSEFDQVLMEDRLTNRLTESLNIFETIVNNRVFSNVSIILFLNKTDLLEEKVQIVSIKDYFLEFEGDPHCLRDVQKFLVECFRNKRRDQQQKPLYHHFTTAINTENIRLVFRDVKDTILHDNLKQLMLQ

SEQ ID NO: 18742 - protein, 340 aa, Canis familiaris
MGEMEQLRQEAEQLKKQIADARKACADTTLAELVSGLEVVGRVQMRTRRTLRGHLAKIYAMHWATDSKLLVSASQDGKLIVWDTYTTNKVHAIPLRSSWVMTCAYAPSGNFVACGGLDNMCSIYSLKSREGNVKVSRELSAHTGYLSCCRFLDDNNIVTSSGDTTCALWDIETGQQKTVFVGHTGDCMSLAVSPDFKLFISGACDASAKLWDVREGTCRQTFTGHESDINAICFFPNGEAICTGSDDASCRLFDLRADQELTAYSDESIICGITSVAFSLSGRLLFAGYDDFNCNIWDSMKGERVGILSGHDNRVSCLGVTADGMAVATGSWDSFLKVWN

SEQ ID NO: 18743 - protein, 514 aa, Candida albicans
MSMYPQRTQHQQRLTELLDAIKTEFDYASNEASSFKKVQEDYDSKYQQQAAEMQQIRQTVYDLELAHRKIKEAYEEEILRLKNELDTRDRQMKNGFQQQQQQQQQQQQQQQQQQQQIVAPPAAPPAPPTPVTSLSVIDKSQYIVNPTQRANHVKEIPPFLQDLDIAKANPEFKKQHLEYYVLYNPAFSKDLDIDMVHSLDHSSVVCCVRFSRDGKFIATGCNKTTQVFNVTTGELVAKLIDESSNENKDDNTTASGDLYIRSVCFSPDGKLLATGAEDKLIRIWDLSTKRIIKILRGHEQDIYSLDFFPDGDRLVSGSGDRSVRIWDLRTSQCSLTLSIEDGVTTVAVSPDGKLIAAGSLDRTVRVWDSTTGFLVERLDSGNENGNGHEDSVYSVAFSNNGEQIASGSLDRTVKLWHLEGKSDKKSTCEVTYIGHKDFVLSVCCTPDNEYILSGSKDRGVIFWDQASGNPLLMLQGHRNSVISVAVSLNSKGTEGIFATGSGDCKARIWKWTKK

SEQ ID NO: 18744 - protein, 682 aa, Kluyveromyces lactis
MSSVAASQNKINDLLEAIRQEFANVSQEANSYRLQNQKDYDFKINQQLAEMQQVRNTVYELELTHRKMKDAYEEEISRLKLELEQKDRQLASIAHGSTVGNVPGQVPQLSRNSGAQGNANIAPPNIPQPMVSQTVGTGMAPQMAPLNTQHPTQQTKSNAGEQAAANLAPVIQQQQQPQQQLPPQQQQQQQQQQQSNIPVTTAAPVQPAGGNLDQTVPNSISPQQQPTEQQQPASTATTAPATASTAPPTSAPSDQVGQDHYLVPADQRAVHAKPIPPFLLDLDSQLVPSHLKKQNNDYYVLHNPALPTDLDVELHKSLEHSSVVCCVRFSSDGEFLATGCNKTTQVYKVSTGELVARLSDDSASQPQPQPQNQTVTAETSTSNSNGSSAEDGTGNQNSAASTASSDLYIRSVCFSPDGKFLATGAEDKLIRIWDLETKKIVMTLKGHEQDIYSLDYFPSGNKLVSGSGDRTVRIWDLTTGTCSLTLSIEDGVTTVAVSPGEGKFIAAGSLDRTVRVWDSDTGFLVERLDSENELGTGHRDSVYSVVFTRDGKGVVSGSLDRSVKLWNLNGLSGQKSHAECEVTYTGHKDFVLSVATTQNDEYILSGSKDRGVLFWDTKSGNPLLMLQGHRNSVIYVTVANGHPLGPEYGVFATGSGDCKARIWKYSKKNGQQNSTQIKEIKE

SEQ ID NO: 18745 - protein, 316 aa, Biomphalaria glabrata
MTEQMTLRGTLQGHGGWVTQIATTPQYPDMILSASRDKSLIVWRLTRDESSYGVPQKSLHGHGHFVSDVILSSDGQFALSGSWDHTLRLWDLSTGQTTRRFVGHTKDVLSVAFSADNRQIVSGSRDKTIKLWNTLGVCKYTIQDDCHTDWTSCVRFSPNTQNPIIVSSGWDRLVKVWNLTNCKLKTNHYGHTGYVNTVTVSPDGSLCASGGKDSQAMLWDLNEGKHLYTLDGAGDTINALCFSPNRYWLCVASGPSIKIWDLEGKVVVDELKPEVMGTTSKAPTCLSLAWSADGQTLFAGYTDKLIRVWQVSMVSR

SEQ ID NO: 18746 - protein, 317 aa, Hydra vulgaris
MEQMTLRGTLKGHNGWVTQIATTPQNPDLILSASRDKTLIQWQLTRDDQTNYGFPKKCLTGHNHFVSDVVLSSDGQFALSCSWDKTLRLWDLNQGITTKQFVGHTKDVLSVAFSADNRQIVSGSRDNTIKLWNTLGQCKYTIQDESHSEWVSCVRFSPNTQNPIIVSCGWDKMVKVWNLTNCKLKTNHFGHTGYLNAVTVSPDGSLCASGGKDGNAMLWDLNEGKHLYTLDGGNVINALCFSPNRYWLCAATGPMIKIWDLEMKSVVDELKPGVIGISTKSRAADCISLAWSADGQTLFAGYTDNLIRVWQVTRSSQ

SEQ ID NO: 18747 - protein, 103 aa, Ascaris suum
MSGRGKGGKGLGKGGAKRHRKVLRDNIQGITKPAIRRLARRGGVKRISGLIYEETRSVLKVFLENVIRDAVTYCEHAKRKTVTAMDVVYALKHQGRTLYGFGG

SEQ ID NO: 18748 - protein, 47 aa, Blepharisma japonicum
GGKGGKGGKGLGKVGAKKRHSRRVIRENIQGITKPAIRRLARRGGVK

SEQ ID NO: 18749 - protein, 172 aa, Babesia bovis
MAKLYHSISKERKYWDKKLCSSPEEWNYRIQRSSTVYVGNLSFATPEERIHEIFSQAGRIHRIVLGLNSIEKKPCGFAFVIYDTIPAARRSIGMFNGCVIDGRIIRVDADTGDNVDTDRKLARGINGYQWRDVFRKEFDTSRGGQGLGVESTSFGYQDFRIHAPPTSALGTD

SEQ ID NO: 18750 - protein, 485 aa, Lycopersicon esculentum
MPGMEAENSNASRAEELKQLANEAFKGHKYSQAIDLYTQAIELNGENAVYYANRAFAHTKLEEYGSAIQDGTRAIEIDPRYSKGYYRRGAAYLAMGKFKDALKDFQQVKKLCPNDPDATKKLKECEKAVMKLKFEEAISVPESQRRSVADSIDYRSVEVEPQYAGARIEGDVVTLDFVKKMLDDFKNQKNLHKRYAYQIVLQTREMLRALPSLVDIVVPEGKHFTVCGDVHGQFYDLLNIFELNGLPSEDNPYLFNGDFVDRGSFSLEVILTLFAFKCMCPSAIHLARGNHESKSMNKIYGFEGEVRSKLSEIFVELFAEVFCCLPLAHVINEKVFVVHGGLFSVDGVKLSDIRAIDRFCEPPEEGLMCELLWSDPQPQPGRGPSKRGVGLSFGGDVTKRFLQENNLDLVVRSHEVKDEGYEIEHDGKLITVFSAPNYCDQMGNKGAFIRFEAPDMKPNIVTFSAVPHPDVKPMAYANNFLRMFS

SEQ ID NO: 18751 - protein, 222 aa, Lycopersicon esculentum
GKIEIKKIENLTNRQVTFSKRRNGIFKKRKELTVLCDAKISLIMLSSTRKYHEYTSPNTTTKKMIDQYQSALGVDIWSIHYEKMQENLKRLKEINNKLRREIRQRTGEDMSGLNLQELCHLQENITESVAEIRERKYHVIKNQTDTCKKKARNLEEQNGNLVLDLEAKCEDPKYGVVENEGHYHSAVAFANGVHNLYAFRLQPLHPNLQNEGGFGSRDLRLS

SEQ ID NO: 18752 - protein, 246 aa, Lycopersicon esculentum
MGRGRVELKRIENKINRQVTFAKRRNGLLKKAYELSVLCDAEVALLVFSNRGKLYEFCSTSNMLKTLDRYQKCSYGTLEVNRSIKDNEQSSYREYLKLKAKYESLQRYQRHLLGDELGPLTIDDLEHLEVQLDTSLKHIRSTRTQMMLDQLSDLQTKEKLWNEANKVLERKMEEIYAENNMQQAWGGGEQSLNYGQQQHPQSQGFFQPLECNSSLQIGYDPITTSSQITAVTNAQNVNGMIPGWML

SEQ ID NO: 18753 - protein, 1238 aa, Caenorhabditis elegans
MSMKRFGKAAYRIANELVAKGGRLPIFQRFLPRIFPATYNLGVHVVLKKAPFPRQNALRIARLVTRHGRVFRPFSSVIIERHRFQNQNDWRRKFQPIRKELPRNVDLVERIRQIFGNSLRYNEDLKSTEWPNRIDSYEFGEFLGQGCNAAVYSARLANSDAESSGNTHYGAGFNEVTNILAEIPPVSKVAQKKFPLAIKLMFNFEHDRDGDAHLLKSMGNELAPYPNAAKLLNGQMGTFRPLPAKHPNVVRIQTAFIDSLKVLPDAIERYPDALHTARWYESIASEPKTMYVVMRRYRQTLHEYVWTRHRNYWTGRVIIAQLLEACTYLHKHKVAQRDMKSDNILLEYDFDDEIPQLVVADFGCALACDNWQVDYESDEVSLGGNAKTKAPEIATAVPGKNVKVNFEMADTWAAGGLSYEVLTRSNPFYKLLDTATYQESELPALPSRVNFVARDVIFDLLKRDPNERVKPNIAANALNLSLFRMGEDVKQMMEKCGISQMTTLLAGSSKVLSQKINSRLDKVMNLITAETIMANLAPHLISRAERQLRATFLSRMNREDIWRSLQYFFPAGVQLDTPATSSDCLETISSLMSSFSNDSENYEKQQKPAKNGYNNVPLLLRNVIRTDADGINGIVHRISDPLTVTFRCMSSLYVPLVLRLEVRDRTKIVQSFIDDSKAGSESPLAGERTRQRLVKKGNTPPKKELKGREEDPPIGVMSSEPSHNYHKGRRTYSEVVIESLDGEKLVDSSSSVAGTSEKSGGRSVSEGPPDQVAYYSGNPLTEKTEGIMHFYKYNDEKLTKVAQCRMLCMYAVPAQVEVREIISFMCISLPMIVSIKVVRDPAPNQYMLIIKFKEHNDAVTFYEEFNNCPFNDLESYCCTLFFVDRIECTTSNDLFSSDDTSLTELPTCAVCLERMDDSVLAILCNHSFHARCLEQWADNTCPVCRYVQSPEVVAEQRCNDCGMSNDLWICLICGNIGCGRYAEQHAQRHWELTSHTYSLKVGGERVWDYAGDNYVHRLIENGADGKLVEYQRESNASFDDKNQKGGDKLEGIKLEYTLLLTSQLEDQRKYFEGLRHDMEQTMSKMEKTAYAQVENLEHQLTERSTELKSLKGDLDDTVTARKVAEKRATQTNEKVNKLANELKDEREINQMLRKDQQVWKGQVEKLIESQKTARTEYEKKIEDLQSQVNDLLMHFETQNKLKEQLDAGKITQEEITESQVELDSSSSSSRKLNRKKKK

SEQ ID NO: 18754 - protein, 454 aa, Pneumocystis carinii
MSSPMDTVTESDMAINLALLGGIGVIHHNCTIEEQTEMVRKVKKFENGFITSPIVLSLNHRVRDVRRIKEELGFSGIPITDTGQLNGKLLGIVTSRDIQFHNNDESFLSEVITKDLVTGSEGIRLEEANEILRSCKKGKLPIVDKEGNLTALLSRSDLMKNLHFPLASKLPDSKQLICAQAVGTRPDDRIRLKHLVEAGLDIVVLDSSQGNSIYQINMIKWNKKEFPNLEVIAGNVVTREQAANLISAGADALRVGMGSGSICITQEIMAVGRPQATAVYAVSEFASKFGVPTIADGGIENIGHITKALALGASAVMMGNLLAGTTESPGQYYYRDGQRLKSYRGMGSIDAMEHLSGKNKGDNAASSRYFGEADTIRVAQGVSGSVIDKGSLHVYVPYLRTGLQHSLQDIGVQNLTELRKQVKEKNIRFEFRTVASQLEGNVHGLDSYQKKLWS

SEQ ID NO: 18755 - protein, 521 aa, Candida albicans
MVFETSKATSYLKDYPKKDGLSVKELIDSTNFGGLTYNDFLILPGLINFPSSAVSLETKLTKKITLKSPFVSSPMDTVTEENMAIHMALLGGIGIIHHNCTSEEQAEMVRKVKKYENGFINDPVVISPEVTVGEVKKMGEVLGFTSFPVTENGKVGGKLVGIITSRDIQFHEDNKSPVSEVMTKDLVVGKKGISLTDGNELLRSSKKGKLPIVDAEGNLVSLISRTDLQKNQDYPNASKSFHSKQLLCGAAIGTIDADRERLDKLVEAGLDVVVLDSSNGSSVFQLNMIKWIKEKYPELQVIAGNVVTREQAALLIEAGADALRIGMGSGSICITQEVMACGRPQGTAVYGVTEFANKFGVPCIADGGIGNIGHITKALALGASCVMMGGLLAGTAETPGDYFYRDGKRLKTYRGMGSIDAMQQTNTNANASTSRYFSEADKVLVAQGVSGSVVDKGSITKFVPYLYNGLQHSLQDIGIKSIDELRENVDNGEIRFEFRTASAQFEGGVHGLHSYEKRLHN

SEQ ID NO: 18756 - protein, 375 aa, Mycobacterium leprae
MVEIGMGRVARRTYELREISIVPSRRTRSSKDVSTAWQLDAYRFEIPVVAHPTDALVSPEFAIELGRLGGLGVLNGEGLIGRHADVGAKVAQLIEAAEKEPEPATAVCLLQELHAAPLNPDLLGSAVARIREAGVTTAVRVSPQNAQVLTPVLLAAGIDLLVVQGSIVSAECVASGGEPLNLKTFISELDVPVVAGGVLDHRTALHLMRTGAAGVIVGYGSTRGATTSDEVLGISVPMATAIADAAAARREYLDETGGRYVHVLADGDIYTSGELAKAIACGADAVVLGTPLAQSAEALGGGWFWPAAAAHPSLPRGALLQTAVGERPSLQQVLNGPSDNPFGTLNLVGGLRRSMAKAGYCDLKEFQKVGLIVSI

SEQ ID NO: 18757 - protein, 287 aa, Pseudomonas fragi
MLQMAISNLDGVSSAKVEINCVIAPHKAQAQIPGLANVKNIVAVASGKGGVGKSTTAANLALALAREGARVGILDADIYGPSQGVMFGIAEGTRPKIRDQKWFVPIEAHGVEVMSMAFLTDDNTPMVWRGPMVSGALLQLVTQTAWNDLDYLVIDMPPGTGDIQLTLAQKVPVAGSVIVTTPQDLALLDARKGVEMFRKVNIPVLGVVENMAVHICSNCGHAEHLFGEGGGEKLATQYGVEVLASLPLAMEIREQADNGKPTAIADPNSPIALIYQELAVTSGRGLF

SEQ ID NO: 18758 - protein, 839 aa, Didelphis virginiana
MPLGVRGTRREFRFPVWGLLLLALWMLPRALGVEEIPGPDSHEKQGFQIVTFKWHHVQDPYIIALWILVASLAKIVFHLSHKVTSVVPESALLIVLGLILGGIVWAADHIASFTLTPTVFFFYLLPPIVLDAGYFMPNRLFFGNLGTILLYAVIGTVWNAATTGLSLYGVYLSGIMGDLSIGLLDFLLFGSLIAAVDPVAVLAVFEEVHVNDVLFIIVFGESLLNDAVTVVLYNVFDSFVSLGADKVTGVDCVKGIVSFFVVSLGGTLIGIIFAFLLSLVTRFTKHVRIIEPGFVFIISYLSYLTSEMLSLSAILAITFCGICCQKYVKANISEQSATTVRYTMKMLASGAETIIFMFLGISAVDPAIWTWNTAFILLTLVFISVYRAIGVVLQTWLLNKYRMVQLEIIDQVVMSYGGLRGAVAYALVVLLDEKKVKEKNLFVSTTIIVVFFTVIFQGLTIKPLVQWLKVKKSEHREPKLNEKLHGRAFDHILSAIEDISGQIGHNYLRDKWSNFDRKVLSKLLMRRSAQKSRDRILNVFHELNLKDAISYVAEGERRGSLAFIRSPSTDNIVNVDFSTPRPSTVEASVSYLLRENVSTVCLDMQALEQRRKSIRDTEDTVTHHTLQQYLYKPRQEYKHLYSRHELTSNEDEKQDKEIFHRTMRKRLESFKSTKLGINQTKKTAKLYKRERGQKRRNSSIPNGKIPMESPTRDFTFKEKELEFSDPEETNEYEAEEMSGGIEFLANVTQDTATDSTTGIDNPVFSPEEDQSIFTKVPPWLSPEETVVPSQRARVQIPYSPSNFRRLTPIRLSTKSVDSFLLADSPEERPRSFLPESTHM

SEQ ID NO: 18759 - protein, 491 aa, Homo sapiens
MLWTILTICILISWESHAAQLQILMEFLKVARRNKREQLEQIQKELSVLEEDIKRVEEMSGLYSPVSEDSTVPQFEAPSPSHSSIIDSTEYSQPPGFSGSSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYDTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALPDGESNVLIAANSQGTIKVLELV

SEQ ID NO: 18760 - protein, 269 aa, Phalaris aquatica
MMKMVCSSSSSSLLVVAALLAVFVGSAQGIAKVPPGPNITAEYGDKWLDAKSTWYGKPTGAGPKDNGGACGYKDVDKAPFNGMTGCGNTPIFKDGRGCGSCFELKCSKPESCSGEPITVHITDDNEEPIAPYHFDLSGHAFGSMAKKGEEENVRGAGELELQFRRVKCKYPDGTKPTFHVEKGSNPNYLALLVKYVDGDGDVVAVDIKEKGKDKWIELKESWGAIWRIDTPDKLTGPFTVRYTTEGGTKAEFEDVIPEGWKADTHDASK

SEQ ID NO: 18761 - protein, 270 aa, Sorghum bicolor
QLQQQEDDRILGLPGQPNGVAFGMYGGYVTIDDNNGRALYYWFQEADTADPAAAPLVLWLNGGPGCSSIGLGAMQELGAFRVHTNGESLLLNEYAWNKAANILFAESPAGVGFSYSNTSSDLSMGDDKMAQDTYTFLVKWFERFPHYNYREFYIAGESGHFIPQLSQVVYRNRNNSPFINFQGLLVSSGLTNDHEDMIGMFESWWHHGLISDETRDSGLKVCPGTSFMHPTPECTEVWNKALAEQGNINPYTIYTPTCDREPSPYQRRFW

SEQ ID NO: 18762 - protein, 158 aa, Sorghum bicolor
LPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVTVRGAGHLVPVHRPAQAFLLFKQFLKGEPMPAE

SEQ ID NO: 18763 - protein, 723 aa, Homo sapiens
KTSDANETEDHLESLICKVGEKSACSLESNLEGLAGVLEADLPNYKSKILRLLCTVARLLPEKLTIYTTLVGLLNARNYNFGGEFVEAMIRQLKESLKANNYNEAVYLVRFLSDLVNCHVIAAPSMVAMFENFVSVTQEEDVPQVRRDWYVYAFLSSLPWVGKELYEKKDAEMDRIFANTESYLKRRQKTHVPMLQVWTADKPHPQEEYLDCLWAQIQKLKKDRWQERHILRPYLAFDSILCEALQHNLPPFTPPPHTEDSVYPMPRVIFRMFDYTDDPEGPVMPGSHSVERFVIEENLHCIIKSHWKERKTCAAQLVSYPGKNKIPLNYHIVEVIFAELFQLPAPPHIDVMYTTLLIELCKLQPGSLPQVLAQATEMLYMRLDTMNTTCVDRFINWFSHHLSNFQFRWSWEDWSDCLSQDPESPKPKFVREVLEKCMRLSYHQRILDIVPPTFSALCPSNPTCIYKYGDESSNSLPGHSVALCLAVAFKSKATNDEIFSILKDVPNPNQDDDDDEGFSFNPLKIEVFVQTLLHLAAKSFSHSFSALAKFHEVFKTLAESDEGKLHVLRVMFEVWRNHPQMIAVLVDKMIRTQIVDCAAVANWIFSSELSRDFTRLFVWEILHSTIRKMNKHVGAQSEQKNLFLVIFQRFIMILTEHLVRCETDGTSVLTPWYKNCIERLQQIFLQHHQIIQQYMVTLENLLFTAELDPHILAVFQQFCALQA

SEQ ID NO: 18764 - protein, 771 aa, Homo sapiens
KTSDANETEDHLESLICKVGEKSACSLESNLEGLAGVLEADLPNYKSKILRLLCTVARLLPEKLTIYTTLVGLLNARNYNFGGEFVEAMIRQLKESLKANNYNEAVYLVRFLSDLVNCHVIAAPSMVAMFENFVSVTQEEDVPQVRRDWYVYAFLSSLPWVGKELYEKKDAEMDRIFANTESYLKRRQKTHVPMLQVWTADKPHPQEEYLDCLWAQIQKLKKDRWQERHILRPYLAFDSILCEALQHNLPPFTPPPHTEDSVYPMPRVIFRMFDYTDDPEGPVMPGSHSVERFVIEENLHCIIKSHWKERKTCAAQLVSYPGKNKIPLNYHIVEVIFAELFQLPAPPHIDVMYTTLLIELCKLQPGSLPQVLAQATEMLYMRLDTMNTTCVDRFINWFSHHLSNFQFRWSWEDWSDCLSQDPESPKPKFVREVLEKCMRLSYHQRILDIVPPTFSALCPSNPTCIYKYGDESSNSLPGHSVALCLAVAFKSKATNDEIFSILKDVPNPNQDDDDDEGFSFNPLKIEVFVQTLLHLAAKSFSHSFSALAKFHEVFKTLAESDEGKLHVLRVMFEVWRNHPQMIAVLVDKMIRTQIVDCAAVANWIFSSELSRDFTRLFVWEILHSTIRKMNKHVLKIQKELEEAKEKLARQHKRRSDDDDRSSDRKDGVLEEQIERLQEKVESAQSEQKNLFLVIFQRFIMILTEHLVRCETDGTSVLTPWYKNCIERLQQIFLQHHQIIQQYMVTLENLLFTAELDPHILAVFQQFCALQA

SEQ ID NO: 18765 - protein, 400 aa, Escherichia coli
  unsure (1)..(400): unsure at all Xaa locations
GKQLTILGSTGSIGCSTLDVVRHNPEHFRVVALVAGKNVTRXVEQCLEFSPRYAVXDDEASAKLLKTXLQQQGSRTEVLSGQQAACDXAALEDVDQVXAAIVGAAGLLPTLAAIRAGKTILLANKESLVTCGRLFXDAVKQSKAQLLPVDSEHNAIFQSLPQPIQHNLGYADLEQNGVVSILLTGSGGPFRETPLRDLATXTPDQACRHPNWSXGRKISVDSATXXNKGLEYIEARWLFNASASQXEVLIHPQSVIHSXVRYQDGSVLAQLGEPDXRTPIAHTXAWPNRVNSGVKPLDFCKLSALTFAAPDYDRYPCLKLAXEAFEQGQAATTALNAANEITVAAFLAQQIRFTDIAALNLSVLEKXDXREPQCVDDVLSVDANAREVARKEVXRLASSA

SEQ ID NO: 18766 - protein, 337 aa, Sus scrofa
TDQAAFDTNIVTLTRFVMEQGRKARGTGEMTQLLNSLCTAVKAISTAVRKAGIAHLYGIAGSTNVTGDQVKKLDVLSNDLVINVLKSSFATCVLVTEEDKNAIIVEPEKRGKYVVCFDPLDGSSNIDCLVSIGTIFGIYRKNSTDEPSEKDALQPGRNLVAAGYALYGSATMLVLAMVNGVNCFMLDPAIGEFILVDRNVKIKKKGSIYSINEGYAKEFDPAITEYIQRKKFPPDNSAPYGARYVGSMVADVHRTLVYGGIFMYPANKKSPKGKLRLLYECNPMAYVMEKAGGLATTGKEAVLDIVPTDIHQRAPIILGSPEDVTELLEIYQKHAAK

SEQ ID NO: 18767 - protein, 337 aa, Sus scrofa
TDQAAFDTNIVTLTRFVMEEGRKARGTGEMTQLLNSLCTAVKAISTAVRKAGIAHLYGIAGSTNVTGDQVKKLDVLSNDLVINVLKSSFATCVLVTEEDKNAIIVEPEKRGKYVVCFDPLDGSSNIDCLVSIGTIFGIYRKNSTDEPSEKDALQPGRNLVAAGYALYGSATMLVLAMVNGVNCFMLDPAIGEFILVDRDVKIKKKGSIYSINEGYAKEFDPAITEYIQRKKFPPDNSAPYGARYVGSMVADVHRTLVYGGIFMYPANKKSPKGKLRLLYECNPMAYVMEKAGGLATTGKEAVLDIVPTDIHQRAPIILGSPEDVTELLEIYQKHAAK

SEQ ID NO: 18768 - protein, 531 aa, Candida tropicalis
MPSDKDIKSPAQPKKEEEIPKSILTRISSPPPILNQPDANIIHHPQPQVPQSSLNIPGIKLSPQISTSLENREIVMAGGAYLKERMESPDSLNHKPTLLQPDKSESIPSIDYTLNPPKESQHHKSPSVHAHFYVEETLRPVRNRSRSGSNSNNNLTPITSPQHSEPSSILNKDAIKSQESLRATTNSISSAAASNQSTPRSIISGGGGGGGGANTATSSNSTTSNTALAAQGTTTTTTTTNSNSNTTTTKGEQNSNIDPRLPQDDGKFHVLIGVCGALSVGKVKLIVNKLLEIYTSDKISIQVILTKSSENFLLPETLNVLENVKKVRVWTDIDEWTTWKTRLDPVLHIELRRWADILLVCPLTANTLAKISLGICDNLLTNVIRAWNSSYPILLAPAMDSHSYSSSTTKRQLRLIADDMPWIEVLKPLEKVFGSYGDIGMGGMTDWNEIVNRIVMKLGGYPEDEDEDEADDSKDNIDESAIIDDDDDDDDDDDDDDDDDDDDDDDDDDDEEDPPQQQSTTDNSKDETTNL

SEQ ID NO: 18769 - protein, 473 aa, Candida albicans
MKHTIIENEPEIKLQNDLNHHIEISPNTKTTNGTTTTTTTLNVNKTLKAIDLIETSIKNHISTIDHENCLPNDEDSFFVCDLGEIINSVNQWQQILPMVQPYYAVKCNSNPQILTTLSELGVNFDCASKNEIDLVLSLGIHQAHERIIYANPCKTNSFIRHAADENVNLTTVDNVHELYKLAKFHPHCKILIRLITDDSTAQCQLSTKFGCDLNTAIGEILPKAKELGLQVHGVAFHVGSGAKDFSSIYQAIKDSRILFDEMLSMGFTPKLLDIGGGFERETFPQSSQMVKFALEKFFPIEFSQSNEIKFIAEPGRFMVANAFTLITHIIARRDLPTGGNNNNNDMTPSAMLYINDGVYGNLNCILFDHQTPKVYVLTNENQLFYKQEMMRSLSVNNNNNNNNKTDGFKFSIWGPTCDGLDCVSSLAKLSKNVQVGDWLFFENVGAYTSCASTKFNGLSSGETKTLYVNSNEE

SEQ ID NO: 18770 - protein, 416 aa, Pseudomonas fluorescens
MDAFNYRGGELFAEGVALSAIAERFGTPTYVYSRAHIEAQYRTFADALEGMPHLVCFAVKANSNLGVLNVLARLGAGFDIVSGGELERVLAAGGSADKIVFSGVGKTREDMRRALEVGVHCFNIESTDELGSRLQIVAAELGVRAPISLRVNPDVDAGTHPYISTGLKENKFGIAIADAEDVYVRAAQLPNLEVLGVDCHIGSQLTTLEPFIDALDRLLALVDRLGDCGIYLRHIDLGGGVGVRYRDEEPPLVADYIKAVRERLDGRDLALMFEPGRYIVANAGVLLTQVEYLKHTEHKDFAIVDAAMNDLIRPALYQAWMDVTAVRPRDTAARSYDIVGPICETGDFLAKGRELALEEGDLLAVHSAGAYGFVMSSNYNTRGRCAEVLVDGDQAFEVRRRETVAELFAGESLLPE

SEQ ID NO: 18771 - protein, 323 aa, Emericella nidulans
MENYQKIEKIGEGTYGVVYKARELTHPNRIVALKKIRLEAEDEGVPSTAIREISLLKEMNDPNIVRLLNIVHADGHKLYLVFEFLDLDLKKYMEALPVSEGGRGRALPDGSTLSRNLGLGDAMVKKFMAQLIEGIRFCHSHRVLHRDLKPQNLLIDRDGNLKLADFGLARAFGVPLRTYTHEVVTLWYRSPEILLGGRQYSTGVDMWSCGAIFAEMCTRKPLFPGDSEIDEIFKIFRILGTPDETIWPGVTSFPDFKPTFPKWKREDIQNVVPGLEEDGLDLLEALLEYDPARRISAKQACMHPYFQHGSSYYSGRARRNGFH

SEQ ID NO: 18772 - protein, 304 aa, Kluyveromyces lactis
MVAPSQFKQLEKVGNGTYATVYKGLNKTTGVYVALKEVKLDSEEGTPSTAIREISLMKELKHDNIVRLFDVIHTENKLTLVFEFMDNDLKKFMDNRNKGNPHKGLEMDLVKYFQWQLLQGVAFCHENRILHRDLKPQNLLINNRGQLKLGDFGLARAFGIPVNTFSSEVVTLWYRAPDVLMGSRNYCTLIDIWSCGCILAEMIMGKPLFPGSNDEEQLKLIFDTMGTPVEQTWPQVTQLAKYNPLLPPHMPRDLKQLLQNNTEEVLDDNVVDLLHGLLQLNPDARLSAKDALNHPWFAEYNHAN

SEQ ID NO: 18773 - protein, 377 aa, Candida albicans
MSADGEFTRTQIFGTVFEITNRYTELNPVGMGAFGLVCSAVDRLTGQNVAVKKVMKPFSTSVLAKRTYRELKLLKHLKHENLITLDDIFISPLEDIYFVNELQGTDLHRLLNSRPLEKQFIQYFTYQIMRGLKYIHSAGVIHRDLKPSNILINENCDLKICDFGLARLQDPQMTGYVSTRYYRAPEIMLTWQKYDTEVDLWSVGCILAEMIEGKPLFPGKDHVHQFSIITELLGSPPADVIDTICSENTLRFVQSLPHRDPIPFSERFASCTHVEPEAIDLLAKLLVFDPKKRISAVQGLTHPYMEAYHDPTDEPVCESKFDWSFNDADLPVDTWRVMMYSEILDFHQTVGVANETEGSEQPDSQVEQNNLDSANGA

SEQ ID NO: 18774 - protein, 815 aa, Homo sapiens
MAEPLKEEDGEDGSAEPPAREGRTRPHRCLCSAKNLALLKARSFDVTFDVGDEYEIIETIGNGAYGVVSSARRRLTGQQVAIKKIPNAFDVVTNAKRTLRELKILKHFKHDNIIAIKDILRPTVPYGEFKSVYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPLAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 18775 - protein, 361 aa, Cyprinus carpio
MSQKERPTFHRQEVNKTIWEVPVRYQNLSPVGSGAYGTVCSAYDEKTGLKVAVKKLSRPFQSIIHAKRTYRELRLLKHMKHENVIGLLDVFTPATSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNMTVDIWSVGCIMAELLTGRTLFPGTDHINQLQQIMRLTGTPPASLISRMPSHEARTYINSLPQMPKRNFSEVFIGANPQAVDLLEKMLVLDTDKRITAAEALAHPYFAQYHDPDDEPEAEPFDQSFESRELDIEEWKRQTYEEVISFEPPVFDGDEMES

SEQ ID NO: 18776 - protein, 372 aa, Homo sapiens
MSGPRAGFYRQELNKTVWEVPQRLQGLRPVGSGAYGSVCSAYDARLRQKVAVKKLSRPFQSLIHARRTYRELRLLKHLKHENVIGLLDVFTPATSIEDFSEVYLVTTLMGADLNNIVKCQAGAHQGARLALDEHVQFLVYQLLRGLKYIHSAGIIHRDLKPSNVAVNEDCELRILDFGLARQADEEMTGYVATRWYRAPEIMLNWMHYNQTVDIWSVGCIMAELLQGKALFPGSDYIDQLKRIMEVVGTPSPEVLAKISSEHARTYIQSLPPMPQKDLSSIFRGANPLAIDLLGRMLVLDSDQRVSAAEALAHAYFSQYHDPEDEPEAEPYDESVEAKERTLEEWKELTYQEVLSFKPPEPPKPPGSLEIEQ

SEQ ID NO: 18777 - protein, 464 aa, Mus musculus
MSLHFLYYCSEPTLDVKIAFCQGFDKHVDVSSIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRSYIDQWNKVIEQLGTPCPEFMKKLQPTVRNYVENRPKYAGLTFPKLFPDSLFPADSEHNKLKASQARDLLSKMLVIDPVKRISVDDALQHPYINVWYDPAEVEAPPPQIYDKQLDEREHTIEEWKELIYKEVMNSEEKTKNGVVKSQPSPSGAAVNSSESLPPSSAVNDISSMSTDQTLASDTDSSLEASAGPLGCCR

SEQ ID NO: 18778 - protein, 384 aa, Petunia x hybrida
MATPVEPPNGIRTPGKHYYSMWQSLFEIDTKYVPIKPIGRGAYGIVCSSVNRETNEKVAIKKINNAFENRIDALRTLRELKLLRHLRHENVIALKDVMMPIQRRSFKDVYLVYELMDTDLHQIIKSSQTLSNDHCQYFLFQLLRGLKYLHSANILHRDLKPGNLLINANCDLKICDFGLARTSSGKDQFMTEYVVTRWYRAPELLLCCDNYGTSIDVWSVGCIFADVLGRKPVFPGTECLNQLKLIINILGSQREEDIEFIDNPKARKYIKSLPYSPGTPFSRLYPNAHPLAIDLLQRMLVFDPSKRISVMEALQHPYMSPLYDPNTDPPAQVPINLDIDEDLVEETIREMMWEEILHYHPEAAVALLWKLFYELLLVPSRHRP

SEQ ID NO: 18779 - protein, 371 aa, Medicago sativa
MSVESAENNIRGVPTHGGRYLQYNIYGNLFEVSRKYVPPIRSVGRGAYGIVCAAVNAETREEVAIKKIGNAFDNRIDAKRTLREIKLLRHMDHENVMSIKDIIRPPQKENFNHVYIVSELMDTDLHQIIRSNQPMTDDHCRYFVYQLLRGLKYVHSANVLHRDLKPSNLLLNANCDLKIGDFGLARTTSETDFMTEYVVTRWYRAPELLLNCSDYTAAIDIWSVGCILGEIVTRQPLFPGRDYVHQLRLVTELIGSPDDASLGFLRSENARRYVRQLPQYPKQNFSARFPNMSPGAVDLLEKMLIFDPSKRIKVDEALCHPYMAPLHDINEEPVCARPFSFDFEEPMFTEEDIKELIWKESVRFNPDPPIN

SEQ ID NO: 18780 - protein, 372 aa, Nicotiana tabacum
MATPVEPPNGIRTPGKHYYSMWQSLFEIDTKYVPIKPIGRGAYGIVCSSVNRETNEKVAIKKINNAFENRIDALRTLRELKLLRHLRHENVIALKDVMMPIHRRSFKDVYLVYELMDTDLHQIIKSSQTLSNDHCQYFLFQLLRGLKYLHSANILHRDLKPGNLLINANCDLKICDFGLARTSSGKDQFMTEYVVTRWYRAPELLLCCDNYGTSIDVWSVGCIFAELLGRKPVFPGTECLNQLKLIINILGSQREEDIEFIDNPKARKYIKSLPYSPGTPFSRLYPHAHPLAIDLLQRMLVFDPSKRISVIEALQHPYMSPLYDPNTDPPAQVPINLDIDEDLGEETIREMMWSEILEYHPEAATAAMEVVL

SEQ ID NO: 18781 - protein, 393 aa, Nicotiana tabacum
MDGPAHQTDTVMSDAAGQQPAPPSQPVAGIDNIPATLSHGGRFIQYNIFGNIFEVTAKYKPPIMPIGKGAYGIVCSALNSETNEHVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEAEMEFLNENAKRYIRQLPLYRRQSFVEKFPHVNPAAIDLVEKMLTFDPRRRITVEDALAHPYLTSLHDISDEPVCMTPFNFDFEQHALTEEQMKELIYREGLAFNPEYQHM

SEQ ID NO: 18782 - protein, 611 aa, Candida glabrata
MENKEHHHHHHHHHHHHSNGSYVSNKVSSLADGSRVGNYQIVKTLGEGSFGKVKLAYHVTTGQKVALKSINKKVLAKSDMQGRIDREISYLRLLRHPHIIKLYDVIKSKDEIIMVIEYAGNELFDYIVQRNKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGASDLIKRMLIVNPLNRISIHEIMQDEWFKVDLAEYLVPQDLKQQEQFNKKSGNEENVEEIDDEMVVTLSKTMGYDKDEIYEALESSEDTPAYNEIRNAYILIKDNKSLIKDMKQDNNVTQELDTFLSQSPPTFQQNGDGMKASEDQKKKHSGRRLASSVTQQRTFHQPPFMDQSKEEDSTISIPTSLPQIHRANMLAQGLPAASKISPLVTKKSKTRWHFGIRSRSYPLDVMGHIYIALKNLGAEWANPSEEDLWTIRVRWKYDSDESRLIEDGVKKIPNLMKIVIQLFQIETNNYLVDFKFDGWESTYGDSTISTNMSEDEMSTFSAYPFLHLTTKLIMELAVNSQGN

SEQ ID NO: 18783 - protein, 1230 aa, Candida albicans
MSILSENNPTPTSITDPNKSSHLHNPELNSGTRVASGPGPGPEAESTPLAPPTEVMNTTSANTSSLSLGSPMHEKIKQFDQDEVDTGETNDRTIESGSGDIDDSQQSHNNNNNNNNNNNESNPESSEGDDEKTQGMPPRMPGTFNVKGLHQGDDSDNEKQYTELTKSINKRTSKDSYSPGTLESPGTLNALETNNVSPAVIEEEQHTSSLEDLSLSLQHQNENARLSAPRSAPPQVPTSKTSSFHDMSSVISSSTSVHKIPSNPTSTRGSHLSSYKSTLDPGKPAQAAAPPPPEIDIDNLLTKSELDSETDTLSSATNSPNLLRNDTLQGIPTRDDENIDDSPRQLSQNTSATSRNTSGTSTSTVVKNSRSGTSKSTSTSTAHNQTAAITPIIPSHNKFHQQVINTNATNSLSSLEPLGVGINSNSSPKSGKKRKSGSKVRGVFSSMFGKNKSTSSSSSSNSGSNSHSQEVNIKISTPFNAKHLAHVGIDDNGSYTGLPIEWERLLSASGITKKEQQQHPQAVMDIVAFYQDTSENPDDAAFKKFHFDNNKSSSSGWSNENTPPATPGGSNSGSGSGGGGAPSSPHRTPPSSIIEKNNVEQKVITPSQSMPTKTESKQSENQHPHEDNATQYTPRTPTSHVQEGQFIPSRPAPKPPSTPLSSMSVSHKTPSSQSLPRSDSQSDIRSSTPKSHQDVSPSKIKIRSISSKSLKSMRSRKSGDKFTHIAPAPPPPSLPSIPKSKSHSASLSSQLRPATNGSTTAPIPASAAFGGENNALPKQRINEFKAHRAPPPPPSAPPAPPVPPAPPANLLSEQTSEIPQQRTAPSQALADVTAPTNIYEIQQTKYQEAQQKLREKKARELEEIQRLREKNERQNRQQETGQNNADTASGGSNIAPPVPVPNKKPPSGSGGGRDAKQAALIAQKKREEKKRKNLQIIAKLKTICNPGDPNELYVDLVKIGQGASGGVFLAHDVRDKSNIVAIKQMNLEQQPKKELIINEILVMKGSSHPNIVNFIDSYLLKGDLWVIMEYMEGGSLTDIVTHSVMTEGQIGVVCRETLKGLKFLHSKGVIHRDIKSDNILLNMDGNIKITDFGFCAQINEINSKRITMVGTPYWMAPEIVSRKEYGPKVDVWSLGIMIIEMLEGEPPYLNETPLRALYLIATNGTPKLKDPESLSYDIRKFLAWCLQVDFNKRADADELLHDNFITECDDVSSLSPLVKIARLKKMSESD

SEQ ID NO: 18784 - protein, 361 aa, Homo sapiens
MENFVATLANGMSLQPPLEEVSCGQAESSEKPNAEDMTSKDYYFDSYAHFGIHEEMLKDEVRTLTYRNSMFHNRHLFKDKVVLDVGSGTGILCMFAAKAGARKVIGIVCSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 18785 - protein, 433 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALKSLAVKEFFSKPKYNHILKPEDCLSEPCTILQLDMRTVQISDLETLRGELRFDIRKAGTLHGFTAWFSVHFQSLQEGQPPQVLSTGPFHPTTHWKQTLFMMDDPVPVHTGDVVTGSVVLQRNPVWRRHMSVALSWAVTSRQDPTSQKVGEKVFPIWR

SEQ ID NO: 18786 - protein, 152 aa, Ovis aries
MDDREDLVYQAKLAEQAERYDEMVESMKKVAGMDVELTVEERNLLSVAYKNVIGARRASWRIISSIEQKEENKGGEDKLKMIREYRQMVETELKLICCDILDVLDKHLIPAANTGESKVFYYKMKGDYHRYLAEFATGNDRKEAAENSLVAY

SEQ ID NO: 18787 - protein, 125 aa, Sus scrofa
  unsure (1)..(125): unsure at all Xaa locations
MGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRLLNRFGMXKIYGGQVEV

SEQ ID NO: 18788 - protein, 295 aa, Styela clava
MGFVKVVKNKAYFKRYQVKYKRRRQGKTDYFARKRLVVQDKNKYNTPKYRMIVRFTNKDIVCQIAYARIEGDVVICAAYAHELPRYGVKVGLTNYAAAYCTGLLLSRRLLNKFGLDEIYEGQTEIDGDEFYVEDVDGKPGAFRAFLDVGLARTTTGAKVFGAMKGAADGGLDIPHSTKRFPGYDDESGDFSAEVHRSHIFGGHVSNYMKELEEEDEEAFKRQFSQYIKHGVTADTVEEMYTKAHAAIREDPTPKKKTDFAGKTKRWNRKKMTFSQRRDRVKQKKASFLRAKQQEG

SEQ ID NO: 18789 - protein, 527 aa, Emericella nidulans
MADAVIAGQRVEAPVTWKAYLMCVFAAFGGIFFGYDSGYINGVMGMDYFIQEFTGKVKSETPAAQFVISSSNKSLITSILSAGTFFGAIIAGDLAEWYGRRITIINGCGVFMAGVAFQIASTTVPMLVVGRLIAGVGVGFVSAIIILYMSEISPRRFRGAIVSGYQFCITIGLMLASCVNYGTENRNDSGSYRIPIALQLLWAIILGIGLFVLPESPRYYVRKNNLAEAAKTLARVRGQPPESEYITQELAEIVANNEYEMQVIPQGGYFATWLNCFRGGLRSPNSNLRRVILGTSLQMMQQWTGVNFVFYFGTTFFQNLGTIDDPFLISMITTIVNVFSTPISFYTMEKLGRRPLLLWGALGMVVCQFIVAIAGTVDGDNSKTVSAQISFICIYIFFFASTWGPGAWVVIGEIFPLPIRSRGVALSTASNWLWNCIIAVITPYMVDIDKGNLKSRVFFIWGSLCACAFVYVYFLIPETKGLTLEQVDKMMEETTPRTSAKWKPHSTFATEMGMTEKNASTTVESAA

SEQ ID NO: 18790 - protein, 136 aa, Streptomyces kasugaensis
MDKRERDQPRVVLGVSGGIAAYKACELLRRLTESGHDVRVVPTAASLHFIGEATWSALSGNPAGTEVWESVHEVPHVRIGQGADLVVVAPATADLLAKAAHGLADDLLTNTLLTARCPVVFAPAMHTEMWENPATR

SEQ ID NO: 18791 - protein, 320 aa, Macaca mulatta
MSKSESPKEPEQLRKLFIGGLSFETTDESLRSHFEQWGTLTDCVVMRDPNTKRSRGFGFVTYATVEKVDAAMNARPHKVDGRVVEPKRAVSREDSQRPGAHLTVKKIFVGGIKEDTEEHHLRDYFEQYGKIEVIEIMTDRGSGKKRGFAFVTFDDHNSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSLGPYGGGGQYFAKPRNQGGYGGSSSSSSYGSGRRF

SEQ ID NO: 18792 - protein, 362 aa, Phytophthora infestans
MPRIETEVRLDFKDVLIRPKRSTLKSRSQVDVQREFRFLNSKRTWSGVPVIAANMDTVGTFEMAVELAKLEFITCVHKHYTPQDWATFAAKHPDVLPTVAVSGGSSAADVEKITAILKSHPDIRFICLDVANGYSEVFVQAVRNVRSAFPEHTIIAGNVVTGEMVEELLLSGADIIKVGIGPGSVCTTRKQTGVGYPQLSAVLECADAAHGLNGHVISDGGCTCPGDVAKAFGAGADFVMLGGMLAGHDESGGDKIEINGKLLKKFYGMSSSEAMKKHNGGVAEYRASEGKSVTVPYRGPVSGTCKEILGGVRSTCTYVGASKLKEISKRTTFIRVSQQLNEVFGRAPNEQEEQVSKKQKTG

SEQ ID NO: 18793 - protein, 364 aa, Onchocerca volvulus
MPTIENEPKLDFKDVLLRPKRSTLKSRADVDLVREFVFRNSKKKYVGIPIVASNMDTVGTFEVAESLSKKRLFTTIHKHYSVDQWMEFVNRISSNQDILSQIGISSGISDYDFTKLKKICGLIPELQYICLDVANGYSEVFVDFIRRVREEFPRHTIFAGNVVTGEMTEELILSGADVVKVGIGSGSVCTTRKKAGVGYPQLSAVLECADASHGLNGHVMSDGGCTNPGDVAKALGAGADFVMIGGLFAGHDQCGGDTVEKDGQKYKLFYGMSSDTAMEKHEGSVAEYRASEGKTITVPYRGDISKTVQDLLGGLRSACTYTGAKKLKELSKRATFVRVTQQTNEQYATFEISPSELQNLNIAV

SEQ ID NO: 18794 - protein, 509 aa, Bos taurus
MPSGFQQIGSEDGEPPRQRVTGTLVLGVFSAVLGSLQFGYNIGVINAPQKVIEQSYNETWLGRQGPEGPGSIPPGTLTTLWALSVAIFSVGGMISSFLIGIISQWLGRKRAMLFNNALAVLGGTLMGLAKAAASYEMLILGRFFIGAYSGLTSGLVPMYVGEIAPTHLRGALGTLNQLAIVTGILIAQVLGLESMLGTATLWPLLLGITVLPALLQMVLLPLCPESPRYLYIIRNLEGPARKSLKRLTGWADVSEVLAELKEEKRKLERERSLSLLQLLGSHTHRQPLVIAIVLQLSQQLSGINAVFYYSTSIFESAGVEKPAYATIGAGVVNTVFTLVSVFLVERAGHRTLHLLGLAGMCACAILMTVALLLLERVPAMSYVSIVAIFGFVAFFEIGPGPIPCFIVAELFSQGPRPAAMAVAGFSNWTCNFIIGMGFQYVADAMGPYVFLLFAVLLLGFFIFTFLKVPETRGRTFDQISAVFHRTPSLLEQEVKPSTELEYLGPDEHD

SEQ ID NO: 18795 - protein, 575 aa, Schizosaccharomyces pombe
MSISSKDFQNVTSAGFADDTFAADTFAADKKSPFESSVFENKTQVLPVDSVSRLSNGARSRSNSNISLSEPHALNDTVEDQPVSKWVWVLAFAAGIGGLLFGYDTGVISGALVVIGTSLGGHELTNGGKEFITSATSLGALLGGIIAGALADFFGRKPVIAIASIIIIVGSIVQVTAHHLWHMIVGRFVIGWGVGIASLIIPLYLSEIAPSKIRGRLVIIYVLLITAGQVIAYGIDTAFEHVHNGWRWMVGLAMVPAAFQLFILIWLPESPRLLVKKERSQEAYNTLARIYPTAHPYEIKTKLYLIQEGVRDPFSGSRWQKIVKTFKELYFNPSNFRALILACGLQAMQQLSGFNSLMYFSSTIFEVVGFNNPTATGLIIAATNFVFTIVAFGVIDFFGRRILLLLTVWGMIAALIVCAVAFHFLPKDENGNYTSGQSNAWAIVVLISMIVYVASYASGLGNLPWQQSELFPMSVRGLGTGMSTAVNWAGNLGIGASFLTLMSEITPTGTFALYGGLCFLGWLGALFCYPDLTDYTIEEIGELLKHGFGVRESMRHLKRVRQERAWSREDKEQNN

SEQ ID NO: 18796 - protein, 426 aa, Streptococcus agalactiae NEM316
MRYSKEIIQLAIPAMIENILQMLMGVVDNYLVAQLGVVAVSGVSVANNIITVYQAIFIALGASIASLLAKSLAGSEKDDAISVCSQAIFLTLLIGAVLGIISIVFGQTFFKLLGTTKSVAQVGGLYLAIVGGGVVTLGMLTTLGSFLRVQGQPRLPMYVSIFVNFLNAVLSGFAIFEWRYGLVGVAVSTLIARLIGICILAKYLPIKKIIKRMTWKISAQIWNLALPSAGERLMMRAGDVVIVAIVVQLGTNVVAGNAIGETLTQFNYMPGLGIATATIILTAKYVGQKNRESIEETIQSSYYIGLVLMILISSFMLLAGKPLTQLFTNNPSAIKGSLIVILLSFVGVPATIGTLVYTAAWQGLGNAKLPFYTTTIGMWLIRVVLGYLLGIVFELGLLGVWMATIADNIFRWLFLKVHYHRYIQKM

SEQ ID NO: 18797 - protein, 309 aa, Streptococcus agalactiae NEM316
MRCSTKEMRLVYRDFLLQANQENKQITVLEADLSSSMSTNVLASEFGKRYINLGIMEAEMVGLAAGLAIKGYKPYLHTFGPFASRRVFDQVFLSLGYSQLSATIIGSDAGVSAEMNGGTHMPFEELGLLRLIPKATIFEVSDDIQFEAILKQTLSIDGLKYIRTIRKAPTAVYEGCEDFSKGFIQLRQGKDIALVASGIMVSRAIEAADYLKELGIEASVIDLFKIKPLPEELKPLLIDQSIVTIENHNRIGGIGSALCEWLSMEKDTTVSRMGIDERFGQVGQMKYLLEEYGLAVKDIVEHCKSIYKS

SEQ ID NO: 18798 - protein, 127 aa, Streptococcus agalactiae NEM316
MTDTMILNDNHKIPTLGLGTWMINNDRVAQVVKDAIELGYRHINTAQAYNNEKGVGVGIKESGITRESLFVTTKIAAEHKNYESATKSIDQSLEALGLDCIDLMIIHSPQPWKEWRETDKHFDQGNL

SEQ ID NO: 18799 - protein, 240 aa, Streptococcus agalactiae NEM316
MKVAIVTGGTRGIGRAITKELYKEGYKVIAIYNSNDAKARALQEELPKLDVYKCNISDAKAVQKLVTKIFREYGGIDCLVNNAGIVRDGFFLMMSEEKWMDVININIMGLVNMSKAVLKIMKAKRIQGKVINISSTSGIAGQIGQANYSATKGAIISITKTLAKEFASDGITINCVSPGFIETDMTNELQNKEELKEHLIPLKRFGQPEEVAWLVSFLASEKANYITGKNIVIDGGMIND

SEQ ID NO: 18800 - protein, 449 aa, Streptococcus agalactiae NEM316
MNNSAANIRSFELALLFLLVFVAVYFVYLAVRDFKMSKNIRLLNWKVRDLIAGNYSDSILIQGDADLVELGESLNDLSDVFRMAHDNLEQEKNRLASILTYMTDGVLATDRSGKIVMINETAQQQFNLAYDEALSMNIVDMLGSGSPYSFQDLVSKTPEVVLNRRDENGEFVTLRIRFALNRRESGFISGLVAVSHDATEQEKEERERRLFVSNVSHELRTPLTSVKSYLEALDEGALNEEVAPSFIKVSLDETNRMMRMISDLLSLSRIDNEVTHLDVEMTNFTAFMTSILNRFDQIRNQKTVTGKVYEIVRDYPLKSIWVEIDTDKMTQVIDNILNNAVKYSPDGGKITVNLRTTKTQMILSISDQGLGIPKKDLPLIFDRFYRVDKARSRQQGGTGLGLSIAKEIVKQHKGFIWAKSEYGKGSTFTIVLPYDKDAVTYEEWEDVED

SEQ ID NO: 18801 - protein, 577 aa, Streptococcus agalactiae NEM316
MTEMLKGIAASDGVAVARAYLLVQPDLSFETVTVEDTNAEEARLDVALQASQDELSVIREKAVESLGEEAAAVFDAHLMVLSDPEMINQIKETIRAKQVNAETGLKEVTDMFITIFEGMEDNPYMQERAADIRDVAKRVLAHLLGVKLPNPATINEESIVIAHDLTPSDTAQLNKQFVKAFVTNIGGRTSHSAIMARTLEIAAVLGTNDITERVQDGQLIAVNGITGEVIIEPTEAQISAFKAAGEAYAKQKAEWALLKDAQTVTADGKHFELAANIGTPKDVEGVNENGAEAVGLYRTEFLYMDSQDFPTEDEQYEAYKAVLEGMNGKPVVVRTMDIGGDKELPYFDLPKEMNPFLGFRALRISISETGDAMFRTQIRALLRASVHGQLRIMFPMVALLKEFRAAKAIFEEEKANLLADGVAVAEGIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSVLRTRSLMKKLDTAKMEEYANRALSECSTMEEVIELQKEYVDFD

SEQ ID NO: 18802 - protein, 327 aa, Streptococcus agalactiae NEM316
MFNDIPVFDYEDIQLIPNKCIISSRSQADTSVKLGNYTFKLPVIPANMQTIIDEEVAETLACEGYFYIMHRFNEEERKPFIKRMHDKGLIASISVGVKDYEYDFVTSLKEDAPEFITIDIAHGHSNSVIEMIQHIKQELPETFVIAGNVGTPEAVRELENAGADATKVGIGPGKVCITKVKTGFGTGGWQLAALRWCSKAARKPIIADGGIRTHGDIAKSIRFGASMVMIGSLFAGHLESPGKLVEVDGQQFKEYYGSASEYQKGEHKNVEGKKILLPVKGRLEDTLTEMQQDLQSSISYAGGKELDSLRHVDYVIVKNSIWNGDSI

SEQ ID NO: 18803 - protein, 181 aa, Streptococcus agalactiae NEM316
MSKKHITPVFTGSLIVSLILVLLGIIVPRGFQSWTQILREQVSTNFGWLYLLLVTSILALCVFFIMSPLGQIRLGRPHSRPEYSTVSWIAMMFSAGMGIGLVFYGAAEPSSHFAISTPGAPKESQTALADAFRFTFFHWGIHAWAVYALVALALAYFGFRKQEKYLLSVTLKPLFGDKTDG

SEQ ID NO: 18804 - protein, 314 aa, Streptococcus agalactiae NEM316
MGRFKELLESKKALILHGALGTELESRGCDVSGKLWSDKYLIEDPAAIQTIHEDYIRAGADIVTTSTYQATLQGLAQVGVSESQAEDLIRLTVQLAKAVREQVWKSLTKEEKSERIYPLISGDVGPYAAFLADGSEYTGLYDIYKEGLKNFHRHRIELLLDEGVDLLALETIPNAQEAEALIELLVEDFPQVEAYMSFTSQDGKTISDGSAVAGLAKAIDVSPQVVALGINCSSPSLVADFLQAIAEQTDKPLVTYPNSGEIYDGASQSWQSSRDHSHTLLENTSDWQKLGAQVVGGCCRTRPADIADLSEHLT

SEQ ID NO: 18805 - protein, 490 aa, Streptococcus agalactiae NEM316
MEKTKSFFGHPRGLSTLFFTEMWERFSYYGMRAILLYYMYYSVSQGGLGMDKTVAASIMAVYGSLVYLSSVIGGFVSDRILGSRKTVLYGGILIMLGHIALATPFGQTALFISIALIILGTGLLKPNVSEMVGNLYGENDSRRDAGFSIFVFGINLGAFISPIVVGYLGQEVNFHLGFSLAAIGMFFGLLQYTLDGKKYLTEESLRPNDPLSPEEKSSLYKKVGLILIGIVIVLILLHLMHMLTIEVIIDIFSIIAIAIPIIYFIKILSSKKISSVERSRVWAYIPLFIASILFWSIEEQGSVVLALFADEQTKLYLNFFGHHINFPSSYFQSMNPLFIMLYVPFFAWLWAKWGSKQPSSPKKFAYGLFFAGASFLWMMLPGLLFGVNAKVSPLWLTMSWAIVIVGEMLISPVGLSATSKLAPKAFQAQMMSIWFLSNAAAQAINAQIVKLYTPDTQILYYGVVGGITVVFGFILLFYVPRIEKLMSGVK

SEQ ID NO: 18806 - protein, 280 aa, Streptococcus agalactiae NEM316
METYTLSNTLNIPKIGFGTWQLTEGEEAYKAVTHALKVGYTHIDTAQIYGNEHSVGRAIRDSGLARESIFLTTKIWNDKHDYHLAKASIDESLQKLGVDYIDLLLIHWPNPKALRENDAWKAGNAGTWKAMEEAYKEGKVKAIGVSNFMKHHLEALFETAEIKPMVNQIILAPGCAQEDLVRFCKGNDILLEAYSPFGTGAIFENESIKAIAEKYGKSVAQVALRWSLDNGFLPLPKSATPKNIEANLDIFDFQLNEDDITTLIQLDSGIKPKDPDNVSF

SEQ ID NO: 18807 - protein, 881 aa, Streptococcus agalactiae NEM316
METKFVYHFDEGCKEMKELLGGKGANLAEMTSIGLPVPQGFTITTQACNDYYDNACHIRESILSQIDQAMAQLEVEQNKQLGSVDDPLLVSVRSGAVFSMPGMMDTVLNLGLNDRSVQGLVKKTEDERFAYDSYRRFIQMFADVVTGIPKYKFDTILDRLKTDKCYQDDTELTGSDLQRLVEFYKELYQKEAGEKFPQDPKRQLLLAIEAVFKSWNNPRAKIYRKLNDISETLGTAVNIQAMVFGNMGNNSGTGVAFTRNPSTGAANLFGEYLINAQGEDVVAGIRTPQSISKLAEQMPIIYQEFVSVTQKLEAHYRDMQDMEFTIENGNLYMLQTRSGKRTAKAAIKIAVDQVNEGLISKEEAILRIEPKQLDQLLHPSFDLESLKKAILLTTGLPASPGAAYGKVYFHAEDVVQEMKKGNPVLLVRQETSPEDIEGMVSANGIITARGGMTSHAAVVARGMGKPCVAGCSQLLVDEVRREISIGHQTIKEGEMLSIDGATGNVYIGQVPMAETSVDCDFEIFMKWVDENRDMMVCSNADNPRDAQKALDFGAEGIGLCRTEHMFFDDERIPVVREMILADDVLSRRKALERLLSFQRDDFYQIFKVLKGKTCTIRLLDPPLHEFLPHDKESIESMARQMGISTLAIEKRIQTLEEFNPMLGHRGCRLAITYPEIYQMQMRALVQGAILAMKEGYEAKPEIMIPLVSAHEEISIIRDLIEETIIEESKSKKINLSFPIGTMIETPRACMIADDIAKFADFFSFGTNDLTQMSFGFSRDDAGKFLGEYVDKGLLKKDPFQALDQKGIGRFIEQAVRLGKEVKPNLKIGICGEHGGEPSSIEFCYQQGLHYVSCSPFRIPIAKLAAAQAKIKQSRNDITIDK

SEQ ID NO: 18808 - protein, 172 aa, Drosophila melanogaster
VKLLFRRLDFHRFCKGKTGFKRRTAMSDYFEELGHEPTGPLGANDLARNLKRLQVLAIMNGIDMEIEVPEASKRAILELPVHEIVKSDEGGDLECSVCKEPAEEGQKYRILPCKHEFHEECILLWLKKTNSCPLCRYELETDDPVYEELRRFRQDEANRRERENTLLDSMFG

SEQ ID NO: 18809 - protein, 345 aa, Drosophila melanogaster
MSVTDVQSPMSVDRSILGVIQSSDISVGTETGVSPTGRVKELPPRNDRQRFLEVVQYQMDILEYFRESEKKHRAKPLYMRRQKDISHNMRSILIDWLVEVSEEYKLDTETLYLSVFYLDRFLSQMAVVRSKLQLVGTAAMYIAAKYEEIYPPEVGEFVFLTDDSYTKAQVLRMEQVILKILSFDLCTPTAYVFINTYAVLCDMPEKLKYMTLYISELSLMEGETYLQYLPSLMSSASVALARHILGMEMWTPRLEEITTYKLEDLKTVVLHLCHTHKTAKELNTQAMREKYNRDTYKKVAMMESVEMSKDDFDQLCEAYNCKQKEDEHQQPDINTKSNVNLFYKF

SEQ ID NO: 18810 - protein, 302 aa, Drosophila melanogaster
MKIIHESGFTAEDFKQYRPVVYSNTIQSLVAILRAMPTLSIQYSNNERESDAKMVFDVCQRMHDTEPFSEELLAAMKRLWQDAGVQECFSRSNEYQLNDSAKYFLDDLDRLGAKDYQPTEQDILRTRVKTTGIVEVHFSFKNLNFKLFDVGGQRSERKKWIHCFEDVTAIIFCVAMSEYDQVLHEDETTNRMQESLKLFDSICNNKWFTDTSIILFLNKKDLFEEKIRKSPLTICFPEYTGGQEYGEAAAYIQAQFEAKNKSTSKEIYCHMTCATDTNNIQFVFDAVTDVIIANNLRGCGLY

SEQ ID NO: 18811 - protein, 269 aa, Drosophila melanogaster
LSLRSPYIILDRIMNFAGKVVLITGASSGIGAATAIKFAKYGACLALNGRNVENLKKVAAECSKVSQSQPALVVGDIAKEADTQRIWSETLQQYGKLDVLVNNAGIIETGTIETTSLEQYDRVMNTNLRAIYHLTMLATPELVKTKGNIVNVSSVNGIRSFPGVLAYNISKMGVDQFTRCVALELAAKGVRVNCVNPGVTVTNLHARGGMDAETYKKFLEHSKTTHALGRPGDVKEVAAAIAFLASDEASFSTGVSLPVDGGRHAMCPR

SEQ ID NO: 18812 - protein, 248 aa, Drosophila melanogaster
MSTVDKEELVQKAKLAEQSERYDDMAQAMKSVTETGVELSNEERNLLSVAYKNVVGARRSSWRVISSIEQKTEASARKQQLAREYRERVEKELREICYEVLGLLDKYLIPKASNPESKVFYLKMKGDYYRYLAEVATGDARNTVVEDSEKAYQEAFDIAKTKMQPTHPIRLGLALNFSVFYYEIINSPARACHLAKQAFDDAIAELDTLNEDSYKDSTLIMQLLRDNLTLWTSDTQGDEAEPQEGGDN

SEQ ID NO: 18813 - protein, 514 aa, Homo sapiens
MADYLISGGTGYVPEDGLTAQQLFASADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 18814 - protein, 1083 aa, Mus musculus
MDTNKEDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTAHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAASAAAATSTEGSNSESEAESNENSPTPSPLQKKVTEDLSKTLLLYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRTTCHTVMEVLREHKDSVMAVLEAFVYDPLLNWRLMDTNTKGNKRSRTRTDSYSAGQSVEILDGVELGEPAHKKAGTTVPESIHSFIGDGLVKPEALNKKAIQIINRVRDKLTGRDFSHDDTLDVPTQVELLIKQATSHENLCQCYIGWCPFW

SEQ ID NO: 18815 - protein, 298 aa, Mus musculus
MTDAAVSFAKDFLAGGVATAISKTAVAPIERVKLLLQVQHASKQITADKHYKGIKDCVVRIPKEQGVLSFWRGNLANVIRYFPTQALNFSFKDKYKQIFLGGVDKRTQFWRYFARNLASGGAAGATSLCFVHPLDFARTRLAADVGKAGAEREFKGLGDCLVKIYKSDGIKGLYQGFNVSVQGIIIYRAAYFGIYDTAKGMLPDPKNTHIFISWMIAQSVTAVVGQTSYPFDTVRRRMMMQSGRKGTDIMYTGTLDCWRKIARDEGSKAFFKGARSNVLRGMGGAFVLVLYDEIKKFT

SEQ ID NO: 18816 - protein, 499 aa, Corynebacterium efficiens YS-314
MRLWGAGGLAEAMSTENFVSNQIFINGWVDGTSERSTTTLNPFNGEEVATIRNASQEDVDKAYATAAEVQKEWAAVPPVKKARILNKAAQVIEDNRDAIVELIRRESGSTALKANIEAGLAMASLREAATFPARITGQILPSNTPGKSNYVFREPLGVVGVISPWNFPFALSMRSVAPALACGNGVVLKPASDTPIVGGTLLAHIFEAAGLPTGLFNVVVGAGSEIGDYFVEHRIPRLISFTGSTPVGKQVGATATGGKYIKKVALELGGNAPMVVLSDADINKAVAAASMGSFLHQGQICMAVNRIIVEAPVYDQFLEGFAARVSKVAYGDQLDDATMVGPIVNDSQVESVSGKIDLAREQGARAVVSGPIEGRVIAPHVFADVTPDMELFREEIFGPVVGVVKADNEEHALELANDTEFGLSSAVFTEDLQRGINFARRVEAGMTHINDITVNDEAHVMFGGEKNSGLGRFNGEWAIDEFTTDHWVSVTTGTDAYPI

SEQ ID NO: 18817 - protein, 245 aa, Corynebacterium efficiens YS-314
MESAPPERRKAWALPPPKRAQWEDMNTFDPTPYASFDRMSSGKWYLAVSDELGDLAGRAALLYHEYNQLGPTNPQRSGEILRELLNPASGQCTIKAPAIIEYGINTTIGEGVFINFGLTILDIAPVHIGARSLLGPNCQILTAGHPVDDVEMRSGGWENGAPVHIGEDVWLGGGVTVVGGVSIGDWAVIGAGAVVTRDIPADAIAVGSPARVIRMRDETRLERADLPDGVPVDALAELREHMDDH

SEQ ID NO: 18818 - protein, 488 aa, Corynebacterium efficiens YS-314
MNSSNGMSSTGTSAGASGALPLEARTLTGWGRTAPTTAEVLTTPDLDVIVDAVRRVAEQNDSKPAYLRRGVIARGMGRSYGDPAQNAGGLVIDMQPLNKIHSIDPESAIVDVDGGVTLDQLMKAALPYGLWIPVLPGTRQVTIGGAIGPDIHGKNHHSAGSFGDHVVSMELLVADGRILHLEPEGTAEDPDGTLFWATVGGMGLTGIIVRARIRMTKTETAYFIADTDRTDNLDETVEFHSDGSEHNYTYSSAWFDVISPEPKLGRSTISRGSLATLAQLEELSPKLAKDPLKFNAPQLLTVPDIFPSFTINKYSLMAIGEAYYAMGAPARNQVKNLTQFYQPLDLIGEWNRGYGSKGFLQYQFVVPMDAVEPFKDIIRDMQKSGHYSALNVFKLFGPGNRAPLSYPMPGWNVCVDFPIRRGLGAFLDELDERVMEFGGRLYLAKESRTSAEKFHSMYPGMEGWLKTRNEIDPTGVFASDMSRRLELH

SEQ ID NO: 18819 - protein, 160 aa, Corynebacterium efficiens YS-314
MMGVLPTPRRVLQDERRMRHALEIARQTPPGDVPVGAVIYAPDGQILATATNRRETDRDPTAHAEIIALRCAARRFTDGWRLTDCTLVVTLEPCSMCAGALVGARVGRLVFGAFEPRTGACGSVFDVVRDPAVLHRAEVTGGVLEEDCAKLMTDFFSGQR

SEQ ID NO: 18820 - protein, 380 aa, Corynebacterium efficiens YS-314
MVTASANYRGVTMSFTVPGIIARSKGAPVEKVNVVVPDPGANDVIVDIQACGVCHTDLAYRDGDISDEFPYLLGHEAAGVVSVVGENVTHVEVGDFVVLNWRAVCGECRACKKGEPKYCFNTHNASKKMTLEDGTELSPALGIGAFIEKTLVHEGQCTKVNPDEDPAAAGLLGCGIMAGLGAAVNTADIQLGESVAVFGLGGVGMAAVAGAKLAGASKIIAVDIDERKLEWAREFGATDVINSSGLSGEGEESEVVAKIRELTGGFGTDVTIDAVGIMPTWQQAFYSRDHAGRMVMVGVPNLTSHIDIPAIDFYGRGGSLRPAWYGDCLPERDFPAYVELHLQGRFPLDKFVSERIGLDDVEEAFNTMKAGDVLRSVVEL

SEQ ID NO: 18821 - protein, 424 aa, Corynebacterium efficiens YS-314
MRVAMISMHTSPLQQPGVGDSGGMNVYILSTGTELARQGVEVDIFTRATRPSQGEVVQVAPNLRVINIVAGPYEGLAKEELSTQLAAFAGGVLEFTRRGGIEYDLIHSHYWLSGQVGWLMRDLWRIPLVHTAHTLAAVKNSYRADEDTPESEARRICEQQLVDNADVLAVNTQEELADLVHHYDADPDRISVVSPGADIALYTPGNDRATERSRRELGVPLHAKVVAFVGRLQPFKGPQVLIHAVAELLERDPQRNLRVLICGGPSGPSATPETYRNLAVELGVDKRIRFLDPRPPEELVAVYRAADIIAVPSYNESFGLVAMEAQATGTPVVAARVGGLPVAVAEGETGLLVDGHDPALWADTLATLLDDDETRIRMGQDAVEHARNFSWAATATQLSSLYSEATTAECDGGIPRRADGARWD

SEQ ID NO: 18822 - protein, 246 aa, Corynebacterium efficiens YS-314
MVSAIRTGYRLIDTAYNYENEGAVGVAIRESGVPREELIVTSKLPGRFHEFELARPRIEESLYRLGLDHIDLLLIHWPNPNRDLYVQAWQALIDARDRGLVRHIGVSNFLPEHIDRLEAETGELPVVNQIELHPYFPQVEQVEWHNARGIVTEAWSPLSNGRGLVDEPLLTDIGRRYGVGGGEVALAWHHARGIVPIPRSTNPERQKSNLEAVHLTLSDEEVSAITALGRPDGRIKDQDPAVYEEF

SEQ ID NO: 18823 - protein, 502 aa, Corynebacterium efficiens YS-314
MTAVIPAALQRREQLNLPYTHVDDFYINGAWVTATGEKRNPVVDPATGQEWGSVPEAGQVELDHAVGAAREALPGWGSLTAADRAEYLVRIAEEIEKRAEVLALTNTRENGSPISETRGAAANAAGIFRYFATLAPFLDDPDIRPFPAGGAESLVDKDPIGVCALIAPWNFPINLVVIKLAPALLAGCSVVIKPASPTPLSIRFIIEAVEAAGVPAGVINLLTGSGRFGDAMVRHPGVNKVAFTGSTPVGRKIASACGELLRPVTLELGGKSSAIVLPDADMSVLSARLIRSCMRNTGQTCYISTRIIAPASRYEEVVQVVADTIAAGRQGDPLDEDTIFGPVATASQYATVMEYIESGHAEGARAVTGGAATAGLTGGLENGVFIEPTVFADVTPDMRIAAEEIFGPVISILRYDDSAGVEEAIAIANNTEFGLGGLVFGADEDRALDVARRVDSGSVGINFFGSNHSAPFGGRHDSGMGVEYGIEGLSAYLSYKSIHRMV

SEQ ID NO: 18824 - protein, 260 aa, Corynebacterium efficiens YS-314
MSNPTPETGSHGSHAPRTVLITGAAGGLGRAFAEGFAAAGDRVAVADINLAGAQETAELLTTSGAQAKAFQVDVTSPESTEALAAAVAEFGGGTIDVVVNNAAIYATVTRSPLEEIDPAEWDLVMGVNLKGPWLVTRAVSPHLSENARIVNLSSATVMSGSAQWAHYVASKGGVIALTRVMAKELGTRGITVNAVAPGFTLTEASLNLMDDAATYGVDRGSIKRASQPEDIVGATLFLASPQAGYITGQTLVVDGGRQFI

SEQ ID NO: 18825 - protein, 522 aa, Corynebacterium efficiens YS-314
MERMYPPRLTPGPLPRELEEHLRGLITSEATPTIPVEAPFDATTIGHVPEGGQSCVDKAFSLAREAQRGWEDTPHATRRSIVRTFHSLVLKHRELLMDMVQLETGKNRAAAFDEVMDVASTARYYAARAEKLLTPRRRQGTIPVLSSTVEHRYPLGVIGQISPWNYPLTLAISDAIPALLAGNAVVSKPDERTPFTALLVTSLLYDAGLPRDIFHTVTGPGPVVGGAIAEHCDYLMFTGSTNTGRILGETAGRRLIGFSAELGGKNPLIIAEDADLDKAVDGAVHGTISNSGQLCVSIERIFVVGSMYPRFVDAYVQRLQSIRMEAGFDWDVEMGSLASQQQLDTVTRMVDEAVSKGAEVLTGGRARPDLGPYFYEPTVLTGVTKKMELYRHEVFGPVVYVEAVADLAEAIVYANDTDYGLNAGIFAARDTALAAAPLIRVGGVNINDSYSATWGNIDTPLGGAKDSGLSARHGEEGLLKYTQTQNISEQRYLQLRGPRSLKRKTYASLMTAGLKALAVMRR

SEQ ID NO: 18826 - protein, 513 aa, Corynebacterium efficiens YS-314
MRRNCRKMTTQSRVSTGGDDPNKVALVGLTFDDVLLLPDASDIVPSDVDTSTQVTRNIRLSTPIISAAMDTVTEARMAIAMARQGGLGVLHRNLSIEEQAENVELVKRSESGMVTDPVTCTPDMTIEEVDNLCARFRISGLPVVDKDGTLLGICTNRDMRFESDPNRLVTDVMTPMPLIVAEEGVAKEDALQLLSTHKVEKLPIVDKNNKLVGLITVKDFVKTEQFPNSSKDASGRLLVAAGIGTGDESYQRAGSLVDAGVDILVVDSAHAHSRGVLEMVSRVKKDFPGVEIIGGNLATREAAKAMIEAGADAIKVGIGPGSICTTRVVAGVGAPQITAIMEAAVPAREAGIPIIADGGMQFSGDIAKALAAGASSVMLGSMLAGTAEAPGDTITINGKQYKRYRGMGSMGAMQGRGLSGEKRSYSKDRYFQADVRSEEKLVPEGIEGRVPFRGSIENIIHQQVGGLRAAMGYTGSATIADLQRARFVQITSAGLKESHPHHIQQTVEAPNYH

SEQ ID NO: 18827 - protein, 415 aa, Corynebacterium efficiens YS-314
MAGCLRICPGARVMSLGYTNFKGGLSQMRDYVEIGIGREARRTYSLDDIAVVASRRTRSSKDVDTNWHIDAYKFELPFMNHPTDALASPEFVIEMGRQGGLGVINAEGLWGRHADLDAAIATVLAAYEGDGGREGALEIIGGGDQAAATRALQQLHAAPLDTDLLAERIGQVRDSGEIVAVRVSPQNARELAPVVARAGADLLVIQGTLISAEHVNTGGEPLNLKEFIGSIELPVIAGGVYDYTTALHMMRTGAVGIIVGGGENTNDLALGMEVPMATAIADVAAARRDYLDETGGRYVHIIADGEIDNSGDVVKAIACGADAVVLGSPLARAKEAAGKGYFWPAVAAHPRFPRGLVTDSGYLTDEVPSLEQILKGPSTLPWGVENFSGGLKRAMAKCGFTDLKSFQKVPLHFNG

SEQ ID NO: 18828 - protein, 433 aa, Corynebacterium efficiens YS-314
MCGGDTRKFYPLFYCRSAHAGLNCDSQHQLSMSLDSSLDSHSSRLTFPQKAEAPMTTTSAASSTASSTTTAKILPHPLNAWYVAAWDHEVTSKGIISRTIANKPLALYRTQDGRAVALADACWHRLAPLSKGKLTGRDGIQCPYHGLVYNSAGRCMSMPAQETLNPSAAVASFPVVEQYRYIWVWLGDPTLADPTTVPDMHQMTHPEWTGDGKTIAAACNYQLVLDNLMDLTHEEFVHSSSIGQDELSEADFEVTHTEDSVTVSRWMRDIDPPPFWQKNMNDKFPGYEGKVDRWQIIHYYYPSTICIDVGVAKAGTGAPEGDRSQGVNGYVMNTITPETDRSSHYFWSFQRNYRLDSQLITTQLRDGVHGVFGEDEEMLTAQQEAIDANPDYEFYNLNIDAGGMWVRRILEKALEAENRLHIPTTSAPVRKES

SEQ ID NO: 18829 - protein, 587 aa, Corynebacterium efficiens YS-314
MMTAQNHLVDTTTRSVPPDMKNRAADSDDLSSFGYEQQLQRNLGRFASFAAGFSFVSILTTIFQLFGLGFGFGGPAFFWTWVAVFIGQYMVALCFAELAARFPVSGAIYQWSRRMGGEFIGWFAGWFMILAQIVTAAAAAIALQVVLPNIWSGFQIIGDDPTLTSPSGAANAVLLGSVLIVLTTVINCIGVRWMSYVTTIGVVCELVGVVAIIGVLFAHAQRGPQVVFETNWTGDSSGYIGAWIASALMAAYVMVGFGSAGELAEETRNPRAVAPKTIRQALSVSALGGGLLILGALMAAPSLTDGRLSVEGLPYVLNTVLESPWGTVLLIDVAIAILICTLAIQTAASRLMFSMARDHRLPASRMLSRVNTTTGTPILPSIVVGVACILILLINVGNDALFATITSVCIILIYLAYLLVTAPLLLRRIQGWPYDRGTSTDANGKQLFTLGRWGLPVNICAVVYGTVMVVNLSWPRAEIYNPSGDTPIMQWAGPIAVGAVIILGLMAFPRNRAHPHPVALESPRNSHTAAAPPATMTITPDPTDVVTGTEATGIHAESARTSTRTSTGTSTGAVVPQSAIPDRSTHF

SEQ ID NO: 18830 - protein, 478 aa, Corynebacterium efficiens YS-314
MAKVTDFKVADLSLAEAGRHQIRLAEYEMPGLMQLRREYAEEQPLKGARIAGSIHMTVQTAVLIETLTALGAEVRWASCNIFSTQDEAAAAIVVGDGTPEDPQGVPVFAWKGETLDEYWWCINQIFSWEGELPNMILDDGGDATMAVIRGREYEKAGVVPQPEANDSDEYIAFLGMLREVLAEEPDKWTRLADSIKGVTEETTTGVHRLYHFAEEGVLPFPAMNVNDAVTKSKFDNKYGTRHSLIDGINRATDMLMGGKNVLVCGYGDVGKGCAEAFDGQGARVRVTEADPINALQALMDGYSVVTVDEAIADADIVITATGNKDIISYEQMLKMKDHALLGNIGHFDNEIDMHSLLHRDDVIRTTIKPQVDEFTFPNGKSIIVLSEGRLLNLGNATGHPSFVMSTSFADQTIAQIELFQNEGQYENQVYRLPKILDEKVARIHVEALGGKLTELTKEQAEYIGVDVAGPFKPEHYRY

SEQ ID NO: 18831 - protein, 284 aa, Corynebacterium efficiens YS-314
MSPTPSPTLSLSDGSEIPQIGLGTWQMHGEEAYRTVREAIGMGYRHIDTAKLYDNEVEVGRAVTDAIRSGEVTRDELFITSKVWNDDQGREQAARAFQASLARLGLDYLDLYLVHWPCPRKGLYNETFEAVARIQGLGQVQSIGVANFYAGVLEDLVVTTGIVPAVNQVELHPGFSQAPLRALHDRLGVVTTAWAPLARGGVLSHPVIKGIAGRYGVPASAVVLRWLVQLGVVAIPKSSDPGRLRSNLDVHGFQLSVEEVERITALDEGPGMGRLFHDPEEFPA

SEQ ID NO: 18832 - protein, 598 aa, Corynebacterium efficiens YS-314
MVSMTTPDPYSHQPPVDDEAEELTATEELAGLLESSRTAEVDTADSPAGFPPESEKQDFSLNWGVIIPALVVVLIAVAWGIGLPDSFSSFAETALTLVVDSLGWAFVFFGTVFVFFAIVIAASKFGQIRLGHQDEAPEFRTVSWIAMMFAAGMGIGLMFYGTTEPLTFYRNGVPAHQPQEVGTAMASTLFHWTLHPWAIYAIVGLAIAYSTFRVGRRQLLSSAFVPLIGEKGATGWLGRLIDILSIIATVFGTACSLGLGALQIGAGLSAAGIIEDPSQWTVLGIVSVLTLAFILSALSGVGKGIQYLSNGNMVLAAILAIFVFVVGPTVSILNMIPTSIGAYFSSFFEMASRTAVSADGTAGEWLSGWTIFYWAWWISWSPFVGMFLARISRGRTIREFIIGVMLVPAGVSTVWFSIFGGTAITKEQGGESIWGEGVAEEQLFSLLQSLPGGQVVSIVAMILLSTFFITSADSASTVMGILSQRGKLDANRWVSASWGVATAAIGLTLLLSGGDNALNNLQNVTIVAATPFLFVIIGLMFAIVKDLRNDIIYVDYREQQRFAARLARERRIHAEAQRRAELARKKRERQAERMARRR

SEQ ID NO: 18833 - protein, 425 aa, Corynebacterium efficiens YS-314 [sequence omitted]

SEQ ID NO: 18834 - protein, 387 aa, Corynebacterium efficiens YS-314
MGSVPHNRGVPTPGMRSPAFPTPVSRPGPGCSLRYRRYRQKIFNVFHRLQEAPTMNALHPEQPDRNLAMELVRVTEAAALAAGRWVGRGMKNEGDGAAVDAMRQLINSVSMKGVIVIGEGEKDEAPMLYNGEEVGTGFGPEVDIAVDPVDGTTLMAEGRPNAITVLAASERGSMYDPSAVFYMKKLAVGREAAGKVDIEAPVAHNINAVAKAKGISASDVTVVVLDRPRHTDLIADIRRAGAKVRLISDGDVAGAVAAAQDTNSVDIMMGTGGTPEGIITACAMKCMGGEIQGILAPMNDFERRKALDAGLELDRVLHTNDLVTSDNCYFVATGLTNGDMLRGVSYRANGATTRSLVMRSKSGTIRHIESVHQLSKLQEYSVVDYTV

SEQ ID NO: 18835 - protein, 312 aa, Corynebacterium efficiens YS-314
MTETNGSTTDNAHHETTDQLTFQNPVTRYPEIEPPIQDQPEPGLDADLVPKTDRGEFSYRGTGRLKGRRALITGGDSGIGAAVAIAFAREGADIALNYLPDEEEDAQWVRDVVEKDGRKITLLPGDLADAEFCRQLVTDAVDTLGGLDILVNNAGRQIAQDSLEDLTDEQLEDTFNVNILAMFRITREALKHLEPGSSIVNTTSIQAYQPSANLLDYASTKAAINNFTKGLGQQLAPKGIRVNAVAPGPFWTPLQVSDGQNKEDLPEFGKNTPLGRAGQPTELAPAYVFLASSESSYVIGETLNVNGGTPAP

SEQ ID NO: 18836 - protein, 390 aa, Corynebacterium efficiens YS-314
MKVGMMTREYPPEVYGGAGVHVTELTRFMREIAEVDVHCMGAPRDAEGVYVHGVDPALDNANPAIKTLSTGLRMAEAANNVDVVHSHTWYAGLGGHLAARLHGIPHVATAHSLEPDRPWKREQLGGGYDVSSWSEKNTMEYADAVIAVSARMKDSILAAYPRIEPDNVRIVLNGIDTELWQPRPTFDDAEESVLRKLGVDPQRPIVAFVGRITRQKGVEHLVKAAAHFDEGVQLVLCAGAPDTPEIAERTRALVEALQSQRDGIFWVQEMLDKKGIQEILTAADTFVCPSIYEPLGIVNLEAMACNTAVVASDVGGIPEVVVDGETGTLVHYDENDTETFERDIAEAVNKMVADREVAKKFGIAGRERAINEFSWATIAQQTVDVYKSLM

SEQ ID NO: 18837 - protein, 375 aa, Corynebacterium efficiens YS-314
MMSQVTESAVRSALSRVEDPEIGKPITELGMVKSVAIDGSDVQVEVYLTIAACPMKTTIVSNTEAAIKDIEGVGDVQVTTDVMSDEQRRELRVSLRGNTADPVIPFAQPGSTTRVYAVASGKGGVGKSSMTVNLATALAAKGLSVGILDADIYGHSVPGMLGSDARPHQVDDMIMPPQAHGVKMISIAHFVEGNAPVVWRGPMLHRAIQQFLSDVFWGDLDILLLDLPPGTGDIAITIAQLLPNAELLIVTTPQAAAADVAERAGSISLQTNQKVAGVIENMSAMVMPDGSTMEVFGSGGGEKIAQRLSMLTGEDVPVLGSVPLDPSLRVGGDVGNPIAISEPYSPTTAAINAIADTLAKRKVSIVGKTLGLGVK

SEQ ID NO: 18838 - protein, 293 aa, Corynebacterium efficiens YS-314
MEAVSKLLDALQIDRSDEAQPIQPIATISVTEDMATAMQLHSQGWRSVYHHEILARGLAPDDLRTMLTQRLRWAQGTLQVMLRDNPMVKKGLSAGQRLMYFATMWSYLSGFTAVIYLAAPVIYLVFGVMPVTAWSGDFFVRFLPYFIINQLLFLFVARGMRTWRGQQYSLALFPVWIKACWTATLNVWFGRPLDFAVTKKDGRDERGIPFRQIWPQLTAMVVLVLAMAIGVGRVIVGVADSMGTIVNVLWVIYDLVVLSVILQAAFYRGFTEPAEPEPESVGAAEISKKPEGE

SEQ ID NO: 18839 - protein, 459 aa, Corynebacterium efficiens YS-314
MTAETETGIPGVPGTQAADQFNELPAHVWPRNAVRQEDGVVTVAGVPLPDLAEEYGTPLFVVDEDDFRARCRDMASAFGGPDRVHYASKAFLSKTVARWVDEEGLSLDIASENELGIALAADFPGERITAHGNNKDASFLRACVRNNLGHVVLDSAQELELLDYIAAGEGKVQPVLIRVKPGIEAHTHEFIATSHEDQKFGFSLASGAAFDAARAAVNAENLELVGLHCHVGSQVFDAQGFSLAAERVLELYSRIHDELGVTLAELDLGGGYGIAYTAAEEPLNVVEVAHDLLTAVGKTAAELGIEAPTVLVEPGRAIAGPSTVTVYEVGTIKDVDVDDETTRRYISVDGGMSDNIRPALYGAEYDARVVSRFTEGETTNTRVVGSHCESGDILINEATYPSDIHTGDLLALAATGAYCYAMSSRYNAFARPAVVSVRAGAAKLMLRRETLDDILSLEV

SEQ ID NO: 18840 - protein, 433 aa, Corynebacterium efficiens YS-314
MTNARDHHTPLTTDPPVATSPTRETPGAYRVLTMATLGFTLMFAAWMMFGVLGIPIQEEFGLTDVQLSLISSVAILNGSLWRLPAGIIADRLGGRIVMTVLLVASAVFSYMVSLADSYSMLLGLAFAVGLAGNSFSVGNTWVAAWFSKRRNGLAMGVFGAGNVGASVTKFIGPVIIAATAGSLYFGGLVEGGWRLVPVIYAVALLATAVMLWFITPAQDKKPGQGRKLSEMLAPLKQGRVWRFSLYYVAVFGAYVALSSWMPKYYIDMYGVSTSTAALLTALFIFPASLMRPVGGSLSDRFGARQTTIFALLIMLTASGILALPLTINIVLFTLLLFTLGVGMGIGKASVFKYIPDYFPGNVGSVGGLVGMFGGLGGAFLPPLFAGVKTATGLEQATFLVIFVLVAFCLAWLLRAISLMKRTSPDPLWRRFGI

SEQ ID NO: 18841 - protein, 309 aa, Corynebacterium efficiens YS-314
MTDIPGSPGSIVVVGSINADLTTTVHRHPHPGETLLGGGGEISAGGKGANQAVAAAQLGAEVHMVGAVGSDTMADSALVHMRASGADMSAVHTVDGPTGLAVITVADDGENTIIVVPGANASVDADYVDRHARLIEQAGIVLLQGEIPADGFNRAVDLAQGRVVINLAPVVPVGHEQLRQADPLLVNEHEGALVLEMLGAPTTETDPSTLVAVLLGQGFPTVVMTLGADGALVGDAEGLTAIPTPTVEAVDTTGSGDAFAGALVAKLADGHSLVEAARFAARVGAFAATRRGAQASYPTLVDDLPTVTA

SEQ ID NO: 18842 - protein, 540 aa, Corynebacterium efficiens YS-314
MGVFPGGFCMPAGIPPISRWHPRTINPGAPVPVAWWGQSHLSRKDTPMTDPLDVSALLTKVPTGLLIGDTWRDSSDGSTYTVDNPATGQTIATLASATSDDALAALDAACEVQSSWARTPARERSEILRRAFDLINERAEEFATLMTLEMGKPIAEARGEVTYGNEFMRWFSEEAVRTYGRHGQTPEGTHRMLTVRKPVGPCLLITPWNFPLAMATRKVAPAIAAGCTMVLKPARLTPLTAQYFAQTMLDAGLPAGVLNVVSGASASAISNPIMEDDRLRKVSFTGSTPVGKQLLKKAADKVLRTSMELGGNAPFIIFEDADLDLAVEGAMGAKMRNIGEACTAANRFLVHDSIAQDFSRRLAERFNQLTLGNGLDDGVTVGPLVEAKARENVAKLVDDAVTEGATVLTGGTAGEGEGYFYQPTVLVDVAPGARILTEEIFGPVAPIITFTTEEEAIQLANDTEYGLASYLFTRDYARMFRISDQLEFGLLGFNSGVISNAAAPFGGVKQSGIGREGGTEGIDEYTQLQYIGIRDPYTDR

SEQ ID NO: 18843 - protein, 456 aa, Corynebacterium efficiens YS-314
MVTGCFKHARIMLPARVWEENQSPASRRKTTGMTQQRVSEQVQSIPESTRRVVVGVAGGIAAYKACHIIRAFKEAGDDVRVVPTEAALSFVGRATFEALSGNPVSTTVFDDVDQVQHVRVGQEADLIVIAPATADLMARLAMGRADDLLTATVLVATCPVVLAPAMHTEMWFNPATVANVATLRERNITVIEPAHGRLTGKDTGPGRLPDPEQIVEIANAAAGGVTFNQDLAGKRVLITAGGTQEHIDPVRYIGNSSSGRQGYALGEVAAQRGARVTIIAGNTVELPTPAGAEIVDVTSTGDMFTEVQERAGESDIIIMAAAVADFRPDTQADSKLKKGADEGALTTVHLVENLDILKTTVRRREEGELASDPVIVGFAAETGDAETSALDYARAKLERKGCDLLMCNEVGHGKVFGQTRNEGWILTADGGVTEVPQGTKLEVAARILDAAVAVER

SEQ ID NO: 18844 - protein, 636 aa, Corynebacterium efficiens YS-314
MGILNSISTPADLKALAEEDLEVLAGEIRSFLVDKVAATGGHLGPNLGVVELTIGLHRVFDSPREPIIFDTSHQSYVHKILTGRGDAFDTLRQKGGLSGYTSRAESEHDWTESSHASAALSYADGMSKAFQLDGDTNRNVVAVVGDGALTGGMCWEALNNIAAGKDRNVVVVVNDNGRSYSPTIGGFAENLAQLRMEPFYDRVMEQGKSTLKSMGWVGERTFEALHAFKEGVKSTVIPTEMFPELGMKYIGPVNGHDQKAVDNALAYARDFKGPIIVHVVTEKGRGYAPAERDLDELMHATGVMDPRTGIPVAASKPGWTAAFSEELVKLGGRREDIVAITAAMAGPTGLAKFAANFPSRFYDVGIAEQHALTSAAGLALAGKHPVVAIYSTFLNRAFDQLLMDVALLNLPVTVVLDRSGVTGSDGASHNGVWDLALTSIVPGIRVAAPRDEDTLRELLGEAVDINDGPSVVRFPKGDLPAPIEAIETLEDGVDILAYLEASPASEDAPDLLIVAVGERATLALELGERLVAAGANVTVVDPRWVIPIPQSLVALAADHDLVITIEDGVIHGGVGSLLSDALNAAEVDTPRRQVAVPQKFLDHASRGQVLLDHDLDIDSVEKTALGWMDRLFGGGN

SEQ ID NO: 18845 - protein, 506 aa, Corynebacterium efficiens YS-314
MESSMVENNVAKKTVAKKTARKTARKAAPRAAAPLGSQDIPASSTPAATSPVTPAPAAIDATVDAATPASTDTTAGEAETSTGTAPAAKKTVAKKTARKTTAKKTTARKTTAKKAAPAKAAPKVIDPELEDEDDDLIVDEEDPAFIPGDELEQDDEVAPLGEEEEEEEEDDGSSVWDEDESATLRQARKDAELTASADSVRAYLKQIGKVALLNAEQEVSLAKRIEAGLYATHKMEEMEAAYAAGDKDAKLTPAVKRDLRAIARDGRKAKNHLLEANLRLVVSLAKRYTGRGMAFLDLIQEGNLGLIRAVEKFDYSKGYKFSTYATWWIRQAITRAMADQARTIRIPVHMVEVINKLGRIQRELLQELGREPTPQELSKEMDISEEKVLEIQQYAREPISLDQTIGDEGDSQLGDFIEDSEAVVAVDAVSFTLLQDQLQDVLETLSEREAGVVKLRFGLTDGMPRTLDEIGQVYGVTRERIRQIESKTMSKLRHPSRSQVLRDYLD

SEQ ID NO: 18846 - protein, 333 aa, Corynebacterium efficiens YS-314
MTQPSTQDLNLTGDDREVDLGSRRGQTNDNPSQDLVRVYLNGIGKTALLTAEDEVELAQTIEVGLYAEYKLKHSDEPLTRAMKRDLKVLAKEGKKARAHLLEANLRLVVSLAKRYTGRGMPLLDLIQEGNLGLIRAMEKFDYTKGFKFSTYATWWIRQAITRGMADQSRTIRLPVHLVEQVNKLSRIKREMYQHLGREATNEELAEESGIEESKIEMLLRQSRDPVSLDMPVGADEEAPLGDFIEDSEATDAETAVVASMRHSDIRSVLSTLEQREQDVIRLRYGLEDGVPRTLDQIGRRFGLSRERVRQIEREVMSKLRDGERAAKLREYAV

SEQ ID NO: 18847 - protein, 570 aa, Corynebacterium efficiens YS-314
MANVADVSHDTSFKGTGVVGGVRYARAVWITPRPALPTAGAEIPEDGRENEQSRFTVAADTVSSRLLARSESVTGAASEVLKATAGMVDDRGWRRAVAKNIKGGHPAEYATVLATDKFIEMFEKAGGIIAERITDLRDIRDRVIAELRGEPEPGLPAVDGQVILFAEDLSPADTAALDTDLFIGLVTELGGPTSHTAIIARQLNVPCIVAAGAGIKRISSGTKVLIDGSLGTVLVNPDEDMALAQVEESRARAAKIAQWTGPAQTRDGHRVQLLANVQDGATARTASTTVAEGIGLFRTELCFLSSTEEPSVEEQADIYARVLEAFPESKVVVRTLDAGSDKPVPFTSMPEEMNPSLGVRGLRIAFDNEGLLTRQLDAIARAATELGRDDTAPTWVMAPMVATVGEAKWFARLCRERGLIPGAMIEVPAAALMADKIMPHLDFVSIGTNDLTQYAMAADRMAPSLASLTDPWQPAVLRLIKMTCDEGQRQDVPVGICGEAAADPLLAVVLTGLGVNSLSAASTALAGVGAQLAEVDLATCRQAAVAALDAEDALRAREAVRAAIAAGQPG

SEQ ID NO: 18848 - protein, 504 aa, Corynebacterium efficiens YS-314
MVYFRSCSHISPGDAKKPLWRMSLHAALSCRNGLRLPGFPRTPSLVLPQTGVPGHPPRPVPPHRGPGSSVSIVGMSRPSPSRSPWTVHRGPYTVHHGPPGNPPNPGVDVTMVSVTTKILILGSTGSIGTQALEVIADNPDLFTLVGIAAGGSNPGLVIEQARAFNLRPHQVAVAGKQAAGEVGEALGGTVIDGPDAAQTLVESVQATDPADAVLNALVGSMGLGATLATLRSGAHLALANKESLVAGGEFVMAQARPGQIIPVDSEHSAMAQCLRSGTEGEVARIVLTASGGPFRGWTREQMWEVTPEQAAAHPTWSMGQMNTLNSATLINKGLELIEATLLFDTDADLIDVTVHPQSIIHSMITFRDGCTIAQASPPSMKLPIALAMNWPHRVPGAQPALDFTQAHTWTFEPVDDAAFPAVQLARDVAKQKGTFPAVYNAANEEAAAAFLAGRIRFPQIVDVVSEILQGASQFAGVSSDVDDILATESEARARANQLIDRLAR

SEQ ID NO: 18849 - protein, 112 aa, Corynebacterium efficiens YS-314
MKLITAIVKPFTLTDVKEALEQVGVQGMTVTETQGFGQQKGHTEVYRGAEYAVDFVPKIKIEVVVSDAQLDEVVEAIVTTARTGKMGDGKVWVTHVEELIRVRTGERGDEAL

SEQ ID NO: 18850 - protein, 323 aa, Corynebacterium efficiens YS-314
MQKRYGSLGWLPMNLLITALTPVIWATTYYVTTEFLPPGRPILAGVLRALPAGLIILAWFRVLPRGQWWWKATVLGVVNIGAFFGFLFWTAYLLPGGVAAVVTNTAPLWVIGLAPLILGTRLKGMQVIAGVVAIIGVAALVLGPGVQLNTLGVLTGLGGSLCMAFGIILAKKFGTPEGVPGLAVTGWQLTIGGLFLVPFLLIEGLPDHLTATNIGGYAYLGLIGGAFAYGIWFRGIALLDPVQVAMLGILSPLTATLIGVVFNDERLSPVQWAGGVAVVVALLLANLASVPGRGGRGRRQPGVDKLIPELTPGAEAPPRRSDR

SEQ ID NO: 18851 - protein, 615 aa, Corynebacterium efficiens YS-314
MSQKITLSQDPEEKHFLGLKSDPFIFLLSVGIIVTFVVATVILGDTARDGFSAMAGWLLENLGWMYVGGVSLILVFLIGIFASRYGRVKLGDDDDEPEHRLLVWFAMLFAGGVGAVLMFWGVAEPINHAFNVPMVNEEPMSEAAIEQAFAFTFYHFGIHMWVVMTLPGLALGYFIYKRKLPPRLSSVFAPLLGRHIYSTPGKLIDVLAIVGTTFGIAVSVGLGVLQINSGMNKLWGTPIASWTQLLVILVITVVACISVASGLEKGIKLLSNINIATAVALMVFILLTGPTLTLIRFVVEAFGIYAGWLPDIMFWTDSFQDNPGWQGKWTVFYWAWTICWSPYVGMFIARISRGRTVREFIGGALALPAIFGVIWFAIFGRAGIELELNSPGYLTDPVVVEGDVPAALFNLLAAYPLTGIVSALALAIIVIFFITSIDSAALVNDMFATGEENKTPTSYRIMWACTIGAVAGSLLIISPESGIATLQEVVIIVAFPFFLVQFIMMYSLLKGMSEDAAATRRVQTRKWEKTDTPEKLEEHQSRPAPGYDEDGNPLPIPALEHDEDGNIRIPGNVVIGGDLGVVGDVVDDPNEAQDMEDRFKIVEQTRPQSRDDYKG

SEQ ID NO: 18852 - protein, 305 aa, Corynebacterium efficiens YS-314
MSIVGTGNFFGSPEEERDRLVQALQGGKRQTTKPAEIPTVRLNDGNKIPQLGFGVFKVDPAETERVVSEALEAGYRHIDTAAFYNNEEGVGRAIAASGIPREELFVTTKLWPTRFDDAEAGFNESLEKLGMEYVDLFLLHWPAPRNNNFVQAWKVLEQLGERARSIGVCNFLPEHLRQLIDETTIVPAVNQFELHPALQQRDIQEASKAAGIAIESWGPLGQGKYDLSKEAPIAAAARSHGKTLAQVVIRWHLQHGFIVFPKTVNPERMRENLDVLDFELTAEEMVAIDNLERGARGGSHPNDIN

SEQ ID NO: 18853 - protein, 361 aa, Corynebacterium efficiens YS-314
MRHRFDVLSPGATPMSNLDPHPDEYDLPSAQPGTPMNPQCEGGADVEIITAREVPLGGPRAMTVYRTLPQRQRTLIGAWCFVDHYGPDNVSQTGGMDVPPHPHTGLQTVTWLFEGEVTHHDSGGNHAVVLPGEVNLMTAGAGICHSEVSATPVTTLHGVQLWTVLPDKDRHGPRRFDHYEPPQISVEGGTARVFLGDLLGESSPVTTFTPLIGAELHVNPGETMSLEVNPDHEHGLLVDSGDIQLEGVTVAPRELAYTGVGATVLRIRNTGDTPALLVLIGGEPFTEDIVMWWNFIGRDHAEIEQFREQWESHDERFGTTHGYVSHHTDGLHRLPAPKLPNASIKARVNPDPTARPDLRIN

SEQ ID NO: 18854 - protein, 188 aa, Corynebacterium efficiens YS-314
MLLVVKMIREDLANARDHDPAARGDLENAIVYSGLHAIWAHRIAHAWWKAGFRGPARILSQLNRFFTGIEIHPGATIGRRFFIDHGMGVVIGETAEIGDGVMLYHGVTLGGQVLTQTKRHPTIEDNVTIGAGAKVLGPITVGAGSAIGSNAVVTKDVPANHIAVGIPAKARPRGKDETIKLVDPDYYI

SEQ ID NO: 18855 - protein, 475 aa, Corynebacterium efficiens YS-314
MTASMTAPENPHAQVTPVGRFRQAARGVPLRTRIILLVVGIAGLGLLVNAIAVSSLMREVSYSRMDQELESAMNSWAQTAELFGSITLGPPSDYYVVRIFPDGSHMVFNQSDSAPDLGETTIGIGPHTASAAPGSSSSVPWRVIAISDNGTITVVGKSLAPESMLLYRLVIVQLVIGMLIVVAILLSSLYLVNRSLRPLREVEKTAKSIAGGDLDRRVPQWPMTTEVGQLANALNIMLEQLQASILSAQEKESQMRRFVGDASHELRTPLTSVKGYSELYHSGATRDADWVLSKISGEAQRMSVLVEDLLSLTRAEGQQMEKRPVDVLELSLSVASSMRAAWPERSITVVNKTGSLPVVEGDATRLHQVLTNLVNNGLNHGGPDASVEIEISAEGGSVLVRVVDDGVGMTAEDAQHIFERFYRTDTSRSRASGGSGLGLAITKSLVEGHRGTITVDSEVGEGTVFTITLPSRMED

SEQ ID NO: 18856 - protein, 519 aa, Corynebacterium efficiens YS-314
MALYACSEQRRVRGFGRASTSKNGGSGYPSGRSDRRPQGACTMRFLNDSTPPYELTYADVFMVPSRSDVGSRMSVDLRTVDGTGTTIPLVVSNMTAVAGRRMAETIARRGGIAILPQDVPAEIAAETIGKVKEADLVFDTPITIKPHHTVGYARNLLHKRAHGAAIVVEGETPIGLITDKDLRAVDNFTQVGTLMSTSLLTLPDDIAPEEAFGILHGASRKLAPVVSSSGRLRGILTRAGALRATMYDPAVDSSGRLRVGAAIGINGDIEGRTRTLIDAGADVLVVDTAHGHQEGMIDALRRVRAVGVDVPVVAGNVVTAAGVRDLVAAGADIVKVGVGPGAMCTTRMQTGVGRPQFSAVLECAAAARELGAHVWADGGVRDPRDVALALAAGASNVMVGSWFSGTYESPGDLHVESDGRMYKESFGMASRRAVENRNQKVEAFEKARRAMFEEGISTARIYIDEKNGGVEDLVDDIIAGVRSAFTYAGADSIPSFAERAVVGVQSTEGYAEGKPRASR

SEQ ID NO: 18857 - protein, 561 aa, Corynebacterium efficiens YS-314
MCPLSQRLIRCHLAHNTDPWWGTVTLRSSLLSPPAVARDPLCGRLICDFPSEGDTMTVYANPGTEGSIVNYEKRYDNYIGGQWVPPVEGQYMDNITPVTGEVFCEVARSTAADVEAALDAAHKAAPAWGRTSVAERALILHRIADRMEEHLEEIAVAETWENGKAVRETLAADIPLAIDHFRYFAGAIRAQEDRSSQIDHNTVAYHYNEPIGVVGQIIPWNFPILMATWKIAPALAAGNAIVMKPAEQTPASILYLMNIVGDLIPDGVLNIVNGLGEEAGTALSSSDRIGKIAFTGSTQVGKIINRAASDKIIPVTLELGGKSPSIFFADVMAQDDAFREKAVEGFAMFALNQGEVCTCPSRALVHESIADEFLELGVKRVQNIKLGNPLDTETMMGAQASQEQMDKISSYLKIGPDEGAETLTGGKVNKIDGLDNGYYIEPTVFRGTNDMRIFREEIFGPVLSVATFSDFDEAIQIANDTNYGLGAGVWSRDQNTVYRAGRAIQAGRVWVNQYHNYPAHSAFGGYKESGIGRENHLMMLAHYQQTKNLLVSYDPNPTGLF

SEQ ID NO: 18858 - protein, 404 aa, Corynebacterium efficiens YS-314
MIGVSRPTPQNSYPGGSTVIVSTKPLTDRSRLSEAHAEMIKATLPLVGSKINDITPVFYNRMFTAHPELLRSTFNRANQKQGDQQKALAASIATFATMLVDPEAPDPVDMLARIGHKHVSLGITADQYNIVHEHLFGAIVEVLGADVVTPPVAEAWDAVYWLMANVLIDLESDLYASNDLAPGDVFRHVTVTGKKQLSDKVWEYTFEGDLVTPAPGQYTSIGVKLPDGARQLRQYSLLSGTDSQYRIAVEDNGEVSTFLRDNVEVGDTIEASVAAGDLVMNDDVNPVVLISQGIGSTPMVGMLNQVAADRHVTVLHADQSEKDHAQREEMVALVGGLANGALYTFYRDADQWLNVAGHIPSDASVYLCGGNEFLQNVRGQLENLEEQPREIRFELFSPNDWLIS

SEQ ID NO: 18859 - protein, 602 aa, Corynebacterium efficiens YS-314
MLTRLAQALRLKTDPAVFFSSVGIMVAFVIITIVAGDTVSDVFGTASDWLLTNLGWFYVLGVTVFLIFLVLIAVSRFGHVRLGADDERPEYSTPVWFSMLFAAGIGTILMFWGVAEPISHFANPPIGNTEPESVEAANQAIALTHYHFALHTWTIFALPALCFAYFIYKRKMPPRVSSIFSPLLGSKVYGPIGKTIDVVALIGTVFGVATSVGLGTLQINAGLGELFDVEVSPMAQLVIIVAVTSVASVSVALGLDRGIKVLSNINILMAIALLIFVILAGPTVLILKGTFESVGTYLRWLPELAFWNNTIPNSPENETWQNTWTVFYWAWTITWSPFVGIFIARISRGRTIREFVAGVLGLPVMFSLLWFGAFGTAAFNIERNGEGGLVNRVVTEGDIPGALFEFLSNYPAATFVSGVAILIVIIFFTTSVDSAAMVTDMIASGQEPRFAPTHQKLIWTVLMGTVAAVLLVATGAGGLTALQQTIIVVGLPFFVMGFIQMYSLWVALKNDAGVAVPVVTRQWEPATDPEAWEKNEAVASPEPIGPIHHIPDRDVEDPVNPAVIGAVLEQIQHGDEDDYDNRVKYVEISSPRVPEDDKDQDR

SEQ ID NO: 18860 - protein, 641 aa, Corynebacterium efficiens YS-314
MTTPGCSEDTTMPETPRQPTDSFTRRLRRSRKTTAVGLYPHDLHPGLVPGISVEEQRQRFGLDKMVFFTTATIIIAFIIWGVTNPVSVSTVSSTAYSWAMGNAAWLLNLVMGLGLFVMLFLAFSRFGHIPLGKDDEKPEFSRYSWVAMMFGAGLGVGIFFFGPSEPLAHYLSPPPNTVEAGTPEALHQAMAQSHFHWGLSIWALYALVGGALAYSTYRRGRPSLISSVFRPLLGTRHAEGPVARVIDILAIIATLFGTAATLGLSALQIGRGVEIVSGVGPLANNAIIMIIGLLGVGFIISAVSGVARGIRYLSNINITLTLGLIAFVFISGPSLFLLNLIPSGVMTYLDELLPMMGKSLSWGEDTLEFQGWWTAFYWAWWIAWTPFVGMFIARISRGRTLREFALVTIAVPSFILILAFTIFGGAAIHFHREGVQDFDGTADNEQVLFALFDQLPLNTLTPFLLIGVLAIFFITSADSASVVMGTMSSKGDPAPSKVVVVFWGLCMMGIAVVMLLAGGETTLTALQNLTILIALPFSIVLILMTVAFLRDLTTDPAAIRRTYATAAVRSAVVRGLEEHGDDFELAVSASPAGQGAGAGFDSTADRVTEWYQRTDEEGNNIEYNYATGEWADGWTPDQEKR

SEQ ID NO: 18861 - protein, 249 aa, Corynebacterium efficiens YS-314
MNSLNGRICIVTGAAQGIGKGIAERLAAEGATVVVADLNGEAASATAAELGNDSIGVTVDISDRTAVDAMVAEAKDKYGRIDVLVNNAGWDKIGPFLEIEPEIWDRIININLYGTLHCSQSVARIMVEQEGGGTIINIGSDAARVGSSGEAVYSACKGGVVSFTKTLARELARYGVTANAICPGPADTPLFAQISEENPKLRTALEKAIPLRRLAQPEDLANAVAFFASPESSYITGQTLSVSGGLTMI

SEQ ID NO: 18862 - protein, 535 aa, Corynebacterium efficiens YS-314
MAVLYGKVCKRGGQDWFCIPACGTIFRMNTDITNDGVPPEPAGSSTGVAVADAHREKKFFGQPWGLANLFGVEMWERFSFYGMQSILAFYLYYSVTDGGLGMDQAAALSIVGAYGGFVYMTSLVASFLADRVFGSERTLFYSAIIVMAGHVALALIPGYVGLAIGLVLIGLGSGGVKTAAQVVLGQLYSRTDTRRDAGFSIFYMGVNIGGLFGPLITNAVWGWGGFHWGFGIAAIGMAAGLIQYVAMRKTTIGAAGHDIPNPLPKSEYPKWIGGTLAVVAIVVTLIATGVIRLEWLSNITAAIALIAAVGLLVQMYASPLTIAAEKSRLLGFIPMFIGGVLFFAIFQTQFTVLAVYSDARLDRNFLGIELPPGLINSFNPIFIIIFSGIFATLWTKLGSRQWSTAVKFGVANIVIGCALFFFLPFAGGEANSTPMLLIIWVYFLFTIAELLLSPVGNSLATKVAPQAFQSRMFAVWLMAVSMGTSLSGTLGGYYDPTNADAEKTFFITVGVVTILIGLVIIASKNWVAKKFIDVR

SEQ ID NO: 18863 - protein, 518 aa, Mus musculus
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 18864 - protein, 306 aa, Mus musculus
MSSFTKDEFDCHILDEGFTAKDILDQKINEVSSSDDKDAFYVADLGDILKKQQRWLKALPRFTPFYAVKCNDSRAIVSTLAAIGTGFDCASKTEKQLVQGPGVPPERIIYANPCKQVSQIKYAASNGVQMMTFDSEIELMKVARAHPKAKLVLRIATDDSKAVCRLSVKFGATLKTSRLLLERAKELNIDVIGVSFHVGSGCTDPDTFVQAVSDARCVFDMATEVGFSMHLLDIGGGFPRSEDTKLKFEEITSVITPALDKYFPSDSGVRIRAEPGKYYVASAFTLAVNIIAKKKKKKHVEGAARL

SEQ ID NO: 18865 - protein, 391 aa, Mus musculus
MSGPVPSRARVYTDVNTHRPREYWDYESHVVEWGNQDDYQLVRKLGRGKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMSSTSMAGGSTPVSSANMMSGISSVPTPSPLGPLAGSPVIAAANSLGIPVPAAAGAQQ

SEQ ID NO: 18866 - protein, 97 aa, Mus musculus
MVLELLDKYVIAKATNSKSKVFYLKMKGDYFWYLAEVAYGNDRKQTIENSQGAYQEAFDISKKEMQPTHPIRLGLALNFSVFYYESLNNSELALHTG

SEQ ID NO: 18867 - protein, 386 aa, Mus musculus
MAVPHHLQETSYLLPPDPEDWEKQGIPDFVYGQEDLVGKEVQWPRDSPSAVDTVPLSRFDSALRSAWRQRLELGLFRYRLEDLQTQILPGSVGFVAQLNIERGIQRRRPQNIRSVRQEFDPEQFNFNKIRPGEVLFRMQREPKGPATPKQEDDVLVVINVSPLEWGHVLLVPAPAQGLPQRLLPGVLRVGLEAVLLSLHPGFRVGFNSLGGLASVNHLHLHCYYLAHPLPVEGAPSTPLDPKGCIHLLQALPAPGFLFYTSGPGPDLEVLISRVCRATDYLSDREIAHNLFVTRGAPPGPTSSTSDLSGIRVILWARKSSFGIKESGAFNVALCELAGHLPVKTSQDFSSLTEAAAVALIQDCLLPETQAGEVRAALVALMAQEEL

SEQ ID NO: 18868 - protein, 276 aa, Yarrowia lipolytica
MSSERETKTFLARLCEQADRYDEMVNYMKDVAKSGEELTVDERNLLSVAYKNVIGARRASWRVIFPIEQKEEAKGATHHLELLKTYRAKIEAELEDICSDVLDILTNHLLPKAENAESKVFYYKMKGDYHRYLAEFTSGEKRKEAATAAHESYKSATDVAQTELSSTHPIRLGLALNFSVFYYEILNSPDRACHLAKQAFDDAIAELDTLSEESFRDSTVIMQLLRDNLTLWKNDLEESLQAQQSEETPATDAAAASTEAAAPKEEAKPAAEEPKE

SEQ ID NO: 18869 - protein, 256 aa, Yarrowia lipolytica
MTREDNIYLARLSEQAGRYEDMVEYMKEIATGDQELSVEERNLLSVAYKNVIGAHRAWWRVVSSCEQKEEQKGKETKIIDDFRQKIEAGLQDICHDILNVLEKHLIPKLEKPSAEATEAAAKDGADPSELSESIVFYYKMKGDYYRYLAEFTTDDKRKEAAEKSLQAYQFASDEATSKLPPTHHIRLGLALNFSVFYYEILNSPERACQLAKQAFDDAIADIDSITEERSKDYALIMQLLRDNLTLWTNNDEPEQA

SEQ ID NO: 18870 - protein, 371 aa, Helianthus annuus
MAGVVKEFDSSHDMFKVREEPKVVFNNKDLSEEMMKIKEEPMLVFDEHEDFVGGEEAPKPIEGLRDGGPPPFLKKTFEMVDDPTTDSIISWSSSKNSFILWDPHKFSTDLLPQRFKHNNFSSFVRQLNTYRFKKIDPDRWEFANEFFQKGKKHLLRDIKRRTNQPQNTQKQEEIRKQEQQQCCGHQTNSTMETELKNLRKERITLKQEILKMKQQQENTEKHLEMVEERMLRMEFKQQQLLVFMSKAFRNPIFVKLLQHLVQKQKTGSVEMCKKRKLEQMLNTDDLDRFQEMWNMIEPDAYTVLSSDGSVSPPEDQNTSDKSGSNGSDYNSESFILWEKLMEDELIFGGEQSGKDQTETYLQEWEELIPKA

SEQ ID NO: 18871 - protein, 387 aa, Petroselinum crispum
MDGSTQPSDTVMSDAAPASQTAGIENIPASLSHGGRFIQYNIFGNIFEVTAKYKPPILPIGKGAYGIVCSALNLETNEHVAIKKIANAFDNKVDAKRTLREIKLLRHMDHENVVAIRDIIPPPQRGSFNDVYIAYELMDTDLHQIIRSNQGLSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEAELEFLNENAKRYIRQLPLYRRQSLTEKFPNVHPSAIDLVEKMLTFDPRRRLTVEDALAHPYLTSLHDISDEPVCAAPFSFDFEQHALTEEQMRELIYREALAFNPEHQQM

SEQ ID NO: 18872 - protein, 374 aa, Petroselinum crispum
MESSSAATADHTHIKGVPTHGGRYVQYNVYGNLFEVSRKYVPPIRPVGRGAYGIVCAAMNSDTREEVAIKKIGNAFDNRIDAKRTLREIKLLRHMNHENVIAIKDIIRPPQIESFNDVYIVYELMDTDLHQIIRSNQQLTDDHCRYFLYQLLRGLKYVHSANVLHRDLKPSNLLLNANCDLKIGDFGLARTTSETDFMTEYVVTRWYRAPELLLNCSEYTAAIDIWSVGCILGEVMTRQPLFPGKDYVHQLRLITELIGSPDDASLGFLRSDNARRYVRQLPQYPKQQFSARFLNKSPGALDLLEKMLIFDPNRRITVDEALCHPYLAALHDINEEPVCPRPFSFDFEQPTCTEENIKELIWKESVKFNPDPIL

SEQ ID NO: 18873 - protein, 469 aa, Mus musculus
MLKVTVPSCPSSPCSSVTASTENLVPDYWIDGSNRDPLGDFFEVESELGRGATSIVYRCKQKGTQKPYALKVLKKTVDKKIVRTEIGVLLRLSHPNIIKLKEIFETPTEISLVLELVTGGELFDRIVEKGYYSERDAADAVKQILEAVAYLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVKKLIVLDPKKRLTTFQALQHPWVTGKAANFVHMDTAQKKLQEFNARRKLKAAVKAVVASSRLGSASSSHTSIQENHKASSDPPSTQDAKDSTDLLGKKMQEEDQEEDQVEAEASADEMRKLQSEEVEKDAGVKEEETSSMVPQDPEDELETDDPEMKRDSEEKLKSVEEEMDPMTEEEAPDAGLGVPQQDAIQPEY

SEQ ID NO: 18874 - protein, 128 aa, Mus musculus
MVVRVTNRYIICQIAYARIEGDMIICAAYAHELPKYGLKVGLTNYAATYCTGLLLVPRLLNRFGMDKIYGGQVEVNGGEYNVESIDGQPGAFTCYLDAGLARTTTGNKVLGALKGTVDGDLSIPHSTK

SEQ ID NO: 18875 - protein, 291 aa, Mus musculus
MAAAAAAGPEMVRGQVFDVGPRYTNLSYIGEGAYGMVCSAYDNLNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLELYNKFKARTILLSLPHKNKVPWNRLSQMLTPKLWIYWIKC

SEQ ID NO: 18876 - protein, 296 aa, Pseudomonas putida
MAGKSPLINLNNGVKMPALGLGVFAASAEETASAIASAISSGYRLIDTARSYNNEAQVGEGIRNSGVDRAEMFVTTKLFNCDYGYERALRAFDESLGRLGLDYVDLYLLHWPTKDWNATIQSWKAAEKILGDGRARAIGVCNFLEDQLDELIAASDVVPAVNQIELHPYFAQKPLLAKNRALGIVTEAWSPIGGAINDGDGDNHGGRKHPLTDPVITTIAEAHGRSAAQVILRWHFQNDVVAIPKSVNPERIAKNIDVFDFALSDAEMAQLDELDTGVRIGPDPRDVDTSSFAEFV

SEQ ID NO: 18877 - protein, 548 aa, Pseudomonas stutzeri
MSHILRAAVLAAMLLPLPSMADQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFDFVRGYAPERVNSWMTDSADNSFCVGELWKGPSEYPNWDWRNTASWQQIIKDWSDRAKCPVFDFALKERMQNGSIADWKHGLNGNPDPRWREVAVTFVDNHDTGYSPGQNGGQHHWALQDGLIRQAYAYILTSPGTPVVYWSHMYDWGYGDFIRQLIQVRRAAGVRADSAISFHSGYSGLVATVSGSQQTLVVALNSDLGNPGQVASGSFSEAVNASNGQVRVWRSGTGSGGGEPGALVSVSFRCDNGATQMGDSVYAVGNVSQLGNWSPAAALRLTDTSGYPTWKGSIALPAGQNEEWKCLIRNEANATQVRQWQGGANNSLTPSEGATTVGRL

SEQ ID NO: 18878 - protein, 499 aa, Escherichia coli
MTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADHLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPDWLDGWCETKSVCVRY

SEQ ID NO: 18879 - protein, 407 aa, Pisum sativum
MAAATASSQLIFSKPYSPSRLCPFQLCVFDAKSVLSSSRRKHVNGSGVRCMAVKEATSETKKRSGYEIITLTSWLLQQEQKGIIDAELTIVLSSISMACKQIASLVQRANISNLTGTQGAVNIQGEDQKKLDVISNEVFSNCLRSSGRTGIIASEEEDVAVAVEESYSGNYIVVFDPLDGSSNLDAAVSTGSIFGIYSPNDECLPDFGDDSDDNTLGTEEQRCIVNVCQPGSNLLAAGYCMYSSSVAFVLTIGKGVFVFTLDPLYGEFVLTQENLQIPKSGEIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 18880 - protein, 353 aa, Homo sapiens
MACCLSEEAKEARRINDEIERQLRRDKRDARRELKLLLLGTGESGKSTFIKQMRIIHGSGYSDEDKRGFTKLVYQNIFTAMQAMIRAMDTLKIPYKYEHNKAHAQLVREVDVEKVSAFENPYVDAIKSLWNDPGIQECYDRRREYQLSDSTKYYLNDLDRVADPAYLPTQQDVLRVRVPTTGIIEYPFDLQSVIFRMVDVGGQRSERRKWIHCFENVTSIMFLVALSEYDQVLVESDNENRMEESKALFRTIITYPWFQNSSVILFLNKKDLLEEKIMYSHLVDYFPEYDGPQRDAQAAREFILKMFVDLNPDSDKIIYSHFTCATDTENIRFVFAAVKDTILQLNLKEYNAV

SEQ ID NO: 18881 - protein, 2549 aa, Mus musculus
MLGTGPAVATASAATSSNVSVLQQFASGLKSRNEETRAKAAKELQHYVTMELREMSQEESTRFYDQLNHHIFELVSSSDANERKGGILAIASLIGVEGGNSTRIGRFANYLRNLLPSSDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQPNALVGLLGYSSPQGLMGFGTSPSPAKSTLVESRCCRDLMEEKFDQVCQWVLKCRSSKNSLIQMTILNLLPRLAAFRPSAFTDTQYLQDTMNHVLSCVKKEKERTAAFQALGLLSVAVRSEFKVYLPRVLDIIRAALPPKDFAHKRQKTVQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVASITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSQGRIVSIKLLAAIQLFGANLDDYLHLLLPPIVKLFDAPEVPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSSQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAASGVLEYAMKHFGELEIQATWYEKLHEWEDALVAYDKKMDTNKEDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTAHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAASAAAATSTEGSNSESEAESNENSPTPSPLQKKVTEDLSKTLLLYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRTTCHTVMEVLREHKDSVMAVLEAFVYDPLLNWRLMDTNTKGNKRSRTRTDSYSAGQSVEILDGVELGEPAHKKAGTTVPESIHSFIGDGLVKPEALNKKAIQIINRVRDKLTGRDFSHDDTLDVPTQVELLIKQATSHENLCQCYIGWCPFW

SEQ ID NO: 18882 - protein, 570 aa, Bacillus subtilis
MQELKGIGASAGIAIAKAYRLEEPDLTVEKKNISDSEAEVSRFDEAIARSKEELEKIKEHALKELGQDKADIFSAHLLVLSDPELLNPVKEKISTDSVNAEFALKETSSMFVTMFESMDNEYMKERAADIRDVTKRVTGHLLGVEIPNPSMISEEVIIVAEDLTPSDTAQLNREFVKGFTTDIGGRTSHSAIMARSLEIPAVVGTKAATGTIQNGVTVIVDGINGDVIIDPSAETVKEYEEKHNAYLAQKAEWAKLVNEPTVSKDGHHVELAANIGTPDDVKGVLENGGEAVGLYRTEFLYMGRDQLPTEDEQFDAYKTVLERMEGKSVVVRTLDIGGDKELPYLQLPKEMNPFLGYRAIRLCLEEQEIFRTQLRALLRASTYGNLKIMFPMIATVNEFKEAKAILLEEKEKLVKAGQAVSDDIEVGMMVEIPSTAVIADQFAKEVDFFSIGTNDLIQYTMAADRMNERVSYLYQPYNPAILRLITLVIEAAHKEGKWVGMCGEMAGDEIAIPILLGLGLDEFSMSATSILPARTQISKLSKQEAESFKEKILSMSTTEEVVAFVKETFK

SEQ ID NO: 18883 - protein, 720 aa, Rattus norvegicus
MAEKFESLMNIHGFDLGSRYMDLKPLGCGGNGLVFSAVDNDCDKRVAIKKIVLTDPQSVKHALREIKIIRRLDHDNIVKVFEILGPSGSQLTDDVGSLTELNSVYIVQEYMETDLANVLEQGPLLEEHARLFMYQLLRGLKYIHSANVLHRDLKPANLFINTEDLVLKIGDFGLARIMDPHYSHKGHLSEGLVTKWYRSPRLLLSPNNYTKAIDMWAAGCIFAEMLTGKTLFAGAHELEQMQLILESIPVVHEEDRQELLSVIPVYIRNDMTEPHKPLTQLLPGISREALDFLEQILTFSPMDRLTAEEALSHPYMSIYSFPTDEPISSHPFHIEDEVDDILLMDETHSHIYNWERYHDCQFSEHDWPIHNNFDIDEVQLDPRALSDVTDEEEVQVDPRKYLDGDREKYLEDPAFDTSYSAEPCWQYPDHHENKYCDLECSHTCNYKTRSPSYLDNLVWRESEVNHYYEPKLIIDLSNWKEQSKDKSDKRGKSKCERNGLVKAQIALEEASQQLAERERGQGFDFDAFIAGTVQLSAQRESADVVDKLNDLNSSVSQLEMKSLISKSVSREKQEKGRANLAQLGALYQPSWESQFVSGGEECFLISQFCCEVRKDEHVEKENTYTSYLDKFFSRKEDSEMLETEPVEEGKRGERGREAGLLSSGGEFLLSRQLESIGTPQFHSPGGSPLKSIQATLTPSAMKSSPQIPHKTYSNILKHLN

SEQ ID NO: 18884 - protein, 464 aa, Rattus norvegicus
MSLHFLYYCSEPTLDVKIAFCQGFDKHVDVSSVVKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLSAIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 18885 - protein, 620 aa, Candida albicans
MSEQAQPQASADQQQHQHNHHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYMPAPEVISGKLYAGPEVDVWSAGVILYVMLCGRLPFDDEFIPALFKKISNGVYTLPNYLSAGAKHLLTRMLVVNPLNRITIHEIMEDDWFKQDMPDYLLPPDLSKNKNSKIDVDEDVIRALSVTMGYDRDCKIVNVIEKANKQVAAGNSSSQQSKSSNEILDAYLLMKENHALVKDLKKSKSENIESFLSQSPPPSPFPNRGSTSSAPGVQQSLTYQTLATVPDLSTLPNSTIAILPTSLPSIHRAYMAETKQNGDPSQQHAPPPTKKSKTRWHFGIRSRSYPLDVMGEIYRALKNLGAEWAKPTEEELWTIRVRWKYDTSAQFECGSAPNLMKMQIQLFQLEPNNYLVSFKFSGWESAHGNAGTDSPQSHRQQDLDEVGSFSAYPFLHLATRLIMELAVNSQSG

SEQ ID NO: 18886 - protein, 457 aa, Escherichia coli
MQKYISEARLLLALAIPVILAQIAQTAMGFVDTVMAGGYSATDMAAVAIGTSIWLPAILFGHGLLLALTPVIAQLNGSGRRERIAHQVRQGFWLAGFVSVLIMLVLWNAGYIIRSMENIDPALADKAVGYLRALLWGAPGYLFFQVARNQCEGLAKTKPGMVMGFIGLLVNIPVNYIFIYGHFGMPELGGVGCGVATAAVYWVMFLAMVSYIKRARSMRDIRNEKGTAKPDPAVMKRLIQLGLPIALALFFEVTLFAVVALLVSPLGIVDVAGHQIALNFSSLMFVLPMSLAAAVTIRVGYRLGQGSTLDAQTAARTGLMVGVCMATLTAIFTVSLREQIALLYNDNPEVVTLAAHLMLLAAVYQISDSIQVIGSGILRGYKDTRSIFYITFTAYWVLGLPSGYILALTDLVVEPMGPAGFWIGFIIGLTSAAIMMMLRMRFLQRLPSAIILQRASR

SEQ ID NO: 18887 - protein, 315 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFS

SEQ ID NO: 18888 - protein, 886 aa, Emericella nidulans
MLTSKAYAGPLGLPSSQTPTASYHTTTQKSSTFSESQTGTVYTSPTKSEFSEADDGLDAVRSWDENQVISWLHSINCQQYEPLFRANNFNGNNLIECDQKILQEMGIKKIGDRVRIFVAIKQLRNKSVVNKKQKNLRQLAALEAAHQQASPDSARSYSARQQTSSAGHASRTGDYSYGRPTSRPGSPLRPHRYVANSPMDSGRKDYLSAGSGAGRNPGTPVERIGTHSRQNPSLDGMTMGSLLSNAPVIRVIYSGGQTKVLDIKHCKTPDEIILCVLKKLQLPEHQYRNYCFYVLDGLDPDPSNCRRLSDHELMEICEGFHRSERGRLILRKIHAGEPDAEEVHRAAQLALDESQQAHMNALSSSNARNQMKIQQLTGESWHNIRQPMSPVSSRHNTTPSDHEIRPPQVSERVSKLRSFFGARPPSEMIIHEISSYFPGHQREDIEKTMRMSVRRSQRLSRAASRLSVVSNTSYASSLRDAPPIPSIADTWLNNGTPPTRAARPLSVLSTRPGLPSTSYRDSIASSSLHPLQEESPVEPNRKSYVSFDSGSDDPNNSRHSLLDENASVAATDGGSFNERLSVLVAEDGEEEDDGLAEFLAGNNFVNWMKGSLIGEGSFGSVFLALHSITGELMAVKQVEIPSATKGTEFDKRKNSMVEALKHEIDLLQGLHHPNIVQYLGTTADDQYLNIFLEYVPGGSIATMLKQYNTFQEPLIKNFVRQILAGLSYLHSKDIIHRDIKGANVLVDNKGGIKISDFGISKRVEASTVLGSRASNGGGHIHRPSLQGSVYWMAPEVVRQTAHTKKADIWSLGCLVIEMFIGSHPFPDCSQLQAIFAIGSNKARPPAPEHASKDAVAFLDMTFQLDHEKRPDADELLKSPFLATTLT

SEQ ID NO: 18889 - protein, 518 aa, Pycnoporus cinnabarinus
MSRFQSLLSFVLVSLAAVANAAIGPVADLTLTNAAVSPDGFSREAVVVNGITPAPLIAGQKGDRFQLNVIDNLTNHTMLKTTSIHWHGFFQHGTNWADGVSFVNQCPIASGHSFLYDFQVPDQAGTFWYHSHLSTQYCDGLRGPFVVYDPNDPQASLYDIDNDDTVITLADWYHVAAKLGPRFPLGADATLINGLGRSPGTTTADLAVIKVTQGKRYRFRLVSLSCDPNHTFSIDGHTMTVIEADSVNTQPLEVDSIQIFAAQRYSFVLDASQPVDNYWIRANPAFGNVGFAGGINSAILRYDGAPEVEPTTTQTTSTKPLNEADLHPLTPMPVPGRPEAGGVDKPLSMVFNFNGTNFFINNHSFVPPSVPVLLQILSGAQAAQDLVPDGSVYVLPSNSSIEISFPATANAPGTPHPFHLHGHTFAVVRSAGSSEYNYDNPIFRDVVSTGQPGDNVTIRFQTNNPGPWFLHCHIDFHLEAGFAVVLAEDTPDTAAVNPVPQSWSDLCPIYDALDPSDL

SEQ ID NO: 18890 - protein, 175 aa, Lycopersicon esculentum
  unsure (1)..(175): unsure at all Xaa locations
IKGSPYPRGYYRCSSSKGCSAKKQVERCSKDASLFIITYTSSHNHPGPNLPKDSVKQEPVVDQHVSLEDNNDEDDDDDDDNDTQSCKTPLNSTTTSTSIPQGILEENLFTDNFLGTISYDDFLPLSYPQLMKFPKSELSEENDFYDELGELELPPSSSTSFAGIFEEAILVXPSS

SEQ ID NO: 18891 - protein, 60 aa, Lycopersicon esculentum
IKGSPHPRGYYKCSSVRVCPARKHVERALDDPTMLIVTYEGEHNHSLSVAETSSLILESS

SEQ ID NO: 18892 - protein, 725 aa, Pan troglodytes
MEGERKNNKRWYFTREQLENSPSRRFGVDPDKELSYRQQAANLLQDMGQRLNVSQLTINTAIVYMHRFYMIQSFTQFPGNSVAPAALFLAAKVEEQPKKLEHVIKVAHTCLHPQESLPDTRSEAYLQQVQDLVILESIILQTLGFELTIDHPHTHVVKCTQLVRASKDLAQTSYFMATNSLHLTTFSLQYTPPVVACVCIHLACKWSNWEIPVSTDGKHWWEYVDATVTLELLDELTHEFLQILEKTPNRLKRIWNWRACEAAKKTKADDRGTDEKTSEQTILNMISQSSSDTTIAGLMSMSTSTTSAVPSLPVSEESSSNLTSVEMLPGKRWLSSQPSFKLEPTQGHRTSENLALTGVDHSLPQDGSNAFISQKQNSKSVPSAKVSLKEYRAKHAEELAAQKRQLENMEANVKSQYAYAAQNLLSHHDSHSSVILKMPIEGSENPERPFLEKADKTALKMRIPVAGGDKAASSKPEEIKMRIKVHAAADKHNSVEDSVTKSREHKEKHKTHPSNHHHHHNHHSHKHSHSQLPVGTGNKRPGDPKHSSQTSNLAHKTYSLSSSFSSSSSTRKRGPSEETGGAVFDHPAKIAKSTKSSSLNFSFPSLPTMAQMPGHSSDTSGLSFSQPSCKTRVPHSKLDKGPTGANGHNTTQTIDYQDTVNMLHSLLSAQGVQPTQPTAFEFVRPYSDYLNPRAGGISSRSGNTDKPRPPPLPSEPPPPLPPLPK

SEQ ID NO: 18893 - protein, 378 aa, Caenorhabditis elegans
MRLMGCVGAGADAEGREARKVNKQIEEQLAKDKQVMRATHRLLLLGAGESGKSTIVKQMRILHINGFNEAEKREKITDIRRNVRDAMQVILRAMDEIVPKVSLDDPSTAISRDYILRITNDPEDNYPSEFYDHILTCWKDKGVMACYERSSEYQLIDCAQYFLDKVDVVRQNNYDPSEQDILRCRVMTTGIFETKFEVDKVRFHMFDVGGQRDERRKWIQCFNDVTAIIFVCASSSYNLVLWEDNTQNRLRESLALFKNIWNNRWLKTISVILFLNKQDLLSEKIKAKRYLLESFFPEFEGYNLPNDAVFDNQEDKDVVRAKYFIRGEFLRISTANSDGRHHCYPHFTCAVDTENIRRVFNDCRDIIQRIHLRQYELL

SEQ ID NO: 18894 - protein, 551 aa, Caenorhabditis elegans
MDLKSTKKTWKIPSFNQMWGKITSHIGVWFGLEEAERPMRASCSLSMIHHPQLTAVRSSKSSENLHRITTMSPQRIQDVDGSPSTRKPSSSIFTLRRSRNKEKKYKNNGGGGSTKSPISKNGTNEMTQSWHSNHVNGASSGSGSGSTPEHHNKNIFSFLSRQSRSRSNNPSETMSTVPLNKNSPSMPPPPSSNTVADFTHLRRRRPRSAHYDPNTITLPAKEEVTPQDVNDLYKRIDKLGEGSYATVYKCESKLDGSIVALKEIKLQFQEGLPFTAIREASLLRNLRHANIVSLHDIFYQHHQLTFVFEYMKMDLSKYLEQNVYGLDSIDIKLLLFQLLRGLDFCHRKKILHRDLKPQNLLLDEDGVLKLADFGLARAKSVPSRTYSHEVVTLWYRPPDVLMGSTDYSTSLDMWGVGCIFAEICTGAALFPGSKDSHYPGTKDQLDMIFSIRGTPDEKKWPEVKTLPGYTPELFPRYRELSFIAVNPMFTKILKTGQELLGMLLQLRPESRVSAASAMLHPYFASFPREVHLLAPSQSIFRLKELKDLRSL

SEQ ID NO: 18895 - protein, 605 aa, Caenorhabditis elegans
MSARTTLYRAPNYYSTNIIEHKTYSISKNTVNKSKMAAPAESHARLDGRFWLEGTPYLAEENVGAGAYGVVCKAMDTRNKKQVAIKKIPRAFTAHTLAKRSLREVRILRELLHENIIAVLDMFTAEGAHGKDIYLVMDLMETDLHQILHSRQTLMEQHFQYFFYQLLRGLKYLHSAGIIHRDLKPSNLLLNGDCLLRIADFGMARAYASASTVRDDANVGGHMTQYVSTRWYRAPEILFSMVEYDTKVDLWSAGCIFAEMLLRRQLFPGKDSVSQIKMIVYYLGSPEEEVINRITSDLVRDSIEACGRKTPLPFSAIFPKASPEARNMVSYLLQISPWKRYSADQILQHPFMAQYHNDQYEPLCPPRVQVDVDAIERFEGAQVVAGLDEEARIFEMRRGTNYDTRKTPPPYLDDKSNQTFEPDKEGKMGPREDPTDYLGVIRQFQKTREQKDDDISDSDETPTSLSSAETIDTVREVELHRKCSEENYSSDSGMEPSTSNANLIVQEIFKNGINWPLDVTSISSAPPMLSGGIPPSKKSKNHLDRRNIDRIREGYSEKRRFIPKIRDKRASSDSSSKLDDKDRIVRLRKSRQELRKTSKDDDRGV

SEQ ID NO: 18896 - protein, 477 aa, Caenorhabditis elegans
MVRHRLPSSTYYTPAGEPEWSREMFGEQSIAVLSGAYRNPIEMARHVAARCGSYQPFFVMDVAAIERRLEALRVMLPRVRPNYAVACNADPVLARVLSNNIDVNFEVSNTAELELVSMNVEPSRAVFCSQLMTRKAIKNAVLAGCSTFVVESEKQVTDVMNASPEAEIILAVCLPYSTGEVPFGCSVDEIEEILDMAHLLGANVTGIYLELGLRATLEDYITSVHDARSIFETADQKFLTLRRVCFGNLSVPTGADGAVNNEFMSFCNSLNNVIDDLFESNIDFSASIGRFLVTNAFTLCTNVIGKRAMDAKFITNDDFDDGVGFVYQTNDGVYGSFGCKQMDIKPLCKPLDVENDSEEQLHFGTILGPTLDGTDVAQRLMKSRQLRVGEWLVWEQMGAFTIPVDSEHSVPPVYYYSGKECWQKLIHKDEQRRSPSPSVSDNEDIGSDGEGGYASSCEDSEAEMALEPLIEDLNEFF

SEQ ID NO: 18897 - protein, 263 aa, Caenorhabditis elegans
MVRHRLPSSTYYTPAGEPEWSREMFGEQSIAVLSGAYRNPIEMARHVAARCGSYQPFFVMDVAAIERRLEALRVMLPRVRPNYAVACNADPVLARVLSNNIDVNFEVSNTAELELVSMNVEPSRAVFCSQLMTRKAIKNAVLAGCSTFVVESEKQVTDVMNASPEAEIILAVCLPYSTGEVPFGCSVDEIEEILDMAHLLGANVTGIYLELGLRATLEDYITSVHDARSIFETADQKFLTLRRVCFGNLSVPITILEKNAGKN

SEQ ID NO: 18898 - protein, 266 aa, Caenorhabditis elegans
MSSGAEQHNTNGKKCYMNKRYDDAVDHYSKAIKVNPLPKYYQNRAMCYFQLNNLKMTEEDCKRALELSPNEVKPLYFLGNVFLQSKKYSEAISCLSKALYHNAVITNAPDIENALKRARHQKYEEEESKRIVQDVEFHTYLESLIEKDRQENSENPEELQRADMAKKRLTELTLATQEKRQNREVPEMLCGKITLELMKEPVIVPSGITYDREEIVQHLRRIGHFDPVTRKPLTENEIIPNYALKEVIEKFLDDNPWAKYEPGGMV

SEQ ID NO: 18899 - protein, 313 aa, Caenorhabditis elegans
MSDVPDDANAGCPGTGSAGAGKASGCAGCPNQGSCATGQGPPPDADVPKIQDRFSRIKHKILILSGKGGVGKSTLTSNLARALASDPSKQVAILDVDICGPSQPRMMGVEDEEVHNSADGWTPVGIQPNLTLMSIAFLLGDKNDAVIWRGARKNGMIKQFLKDVDWGEVDYLLIDTPPGTSDEHISLVQFLLQAGPLDGALIVSTPQEVSLLDVRKEVSFCVKTKVPILGVVENMARFVCPNCAHTTLLFPTSTGGAEQMCKDSNLELLAQLPLEPALAKALDNGEDFFETNPDSTLAKSFLDLAEKVKAKLV

SEQ ID NO: 18900 - protein, 681 aa, Caenorhabditis elegans
MKILANGVTWQLWESTLNQGTATSGIMRFALKTALSICIFLLIFQTVDSDSSDSSASASVVSGAVKSEDTVVAVNKTDVLGEAIDANATSLEQHGAAIVGNVSEEKKRSLAIFFILFVIMLATLVVHMLIVSKIHWMPESLAIVALGALIGSILSYSRRDWSEIEALSPDVFFLVLLPPIIFENAYNLNKGYFFSNFVPILTFAIFGTTISAMVIGAGLYILGAIGLIFEFTFFECFAFAAMISAVDPVGTLAIFQAVKVESLLYMLVFGESMLNDAVSIVLAATALRHAKPSFNSLPASEIITSAFVTFTEMFFFSACLGVGIGLLSALLFKHVDLRKTPSLEFALLLIFSYIPYGFAEALDLSGIMAILFCGISMSQFTRHNVSPIAQITFRHTFRTISFVAETSTFAYIGMAFFTIKLNFAPWLIFWSVVLCLLGRACNVFPLAYLVNQCRKDVQISMKNQIIMWFSGMRGAVCFALVLYMDLDKEKKSILLTTVLFLILFTTIFLGGSALPFISFINRCYPNERQRKRRRTPRNKESTGNSSALMMSKTQEMSFFGSDDWGPKKSALDATSSAGRIMRQLFVRKFTAIERLENRDKLAALTKRALASDQMTDSDDVEFGGGGGVGGGGRMKDDVTPTRGRSGSRNSSDVIISAGGGGVSGEHHLLISSGSDSSTNEF

SEQ ID NO: 18901 - protein, 655 aa, Caenorhabditis elegans
MRFALKTALSICIFLLIFQTVDSDSSDSSASASVVSGAVKSEDTVVAVNKTDVLGEAIDANATSLEQHGAAIVGNVSEEKKRSLAIFFILFVIMLATLVVHMLIVSKIHWMPESLAIVALGALIGSILSYSRRDWSEIEALSPDVFFLVLLPPIIFENAYNLNKGYFFSNFVPILTFAIFGTTISAMVIGAGLYILGAIGLIFEFTFFECFAFAAMISAVDPVGTLAIFQAVKVESLLYMLVFGESMLNDAVSIVLAATALRHAKPSFNSLPASEIITSAFVTFTEMFFFSACLGVGIGLLSALLFKHVDLRKTPSLEFALLLIFSYIPYGFAEALDLSGIMAILFCGISMSQFTRHNVSPIAQITFRHTFRTISFVAETSTFAYIGMAFFTIKLNFAPWLIFWSVVLCLLGRACNVFPLAYLVNQCRKDVQISMKNQIIMWFSGMRGAVCFALVLYMDLDKEKKSILLTTVLFLILFTTIFLGGSALPFISFINRCYPNERQRKRRRTPRNKESTGNSSALMMSKTQEMSFFGSDDWGPKKSALDATSSAGRIMRQLFVRKFTAIERLENRDKLAALTKRALASDQMTDSDDVEFGGGGGVGGGGRMKDDVTPTRGRSGSRNSSDVIISAGGGGVSGEHHLLISSGSDSSTNEF

SEQ ID NO: 18902 - protein, 701 aa, Caenorhabditis elegans
MEEKSLLQKLRSYPPAVFFMLGNEFCERFSFYGMKTILFIYLITEHEFSPSKATFIYHLFTCIAYLTPLIGSIMADSVFGRFKVILYGSSIYVVGHVLLSLGAVPFLSYPIRSSLDFSGLFVIAFATGCIKPCVSAFAADQFTEDQKDLRSQFFSFFYFAINGGSLFAIIITPILRGRVQCFGNAHCFPLAFGVPGVLMLLALIQFLMGWSMYKKHPPSKENVGSKVVAVIYTSLRKMVGGASRDKPVTHWLDHAAPEHSQKMIDSTRGLLNVAVIFCPLIFFWALFDQQGSTWVLQARRLDGRVGHFSILPEQIHAINPVCVLILVPIFEGWVYPALRKITRVTPLRKMAVGGLLTAFSFAIAGVLQLKVNETMEFPPSLGRIYLQRVGNESLISDFRYKSDGRLIGDGMLPKGRTELDAGIYTFNTGLKNESQEIDISTPNKGYVMAVFRLKDAVEVVKFDYKVEKTDNGATRVFVVTAREDADTLVYAINKKGKILSSCELKSGSYVDVIPGIISDPNVRLYWGPKNSCSGVDCPNTVTLNAQMGAVHVLHIHPSTTEGDFNLLVRPNSVSILWSLPQYIIITLGEVLLSVTGLEFAYSQAAPNMKSVLTAMWLLTVFAGNLIDMMISGTRLIPHPALEFFFYSTLMVIVMGVFILLAMQYTYVEDNDDEITITESEKKDVIALTEIESGTATSDKKE

SEQ ID NO: 18903 - protein, 489 aa, Caenorhabditis elegans
MTNCGAESTSAPPQANGHLRPPGIQPHRNPFTPPPLPSPDEFDDAINCSPCCDDPNVSRTFKALILGQILSLCLCGTGVSSQLLVNQNVNAPAAQAFSNYFLLCFVYCISLACKNDENGLVVVLRKRGWRYLILAIIDVEANYMIVKAYQYTNLTSVQLLDCATIPTVLFLSWLFLSVRYLASHILGGFLRFEKKNLNKKVKISEKAKTLLTNICHFTKKKGFKDYITVQITIFQELLPLGKNNGKCVTICIIGIACVIWADALGDKGALDGGSNKVLGDILCLAAAVMYAICNVAEEFLVKQHSRTEYLGMLGLFGCIVSGVQTAVFEQEALSKIVWDGTIVSYFALFAFSMFIFYSLVTVVLQKTSALMFNLSTLTADFYSLLFGIFMFKDTFHYLYFVSFIVCIIGSVIYSMKETQVRDADEPRRVCPCLFVCCCCCGCCFEEGDSTEGSIDVSPSPNERMQMGLNPRGSMSPCPVHGGSQQLSHL

SEQ ID NO: 18904 - protein, 869 aa, Caenorhabditis elegans
MKILWESDWQGARIEQTITHLSWIQQQDKPDHGLLGVGTETGSVGVTLTDFKPTPDDLTRYNFNLRGHHNAIRMVTWNKSQSKLASCDASGIIYVWVRNDDRWSVELVNDRGVKVSDLSWSPCGGSALICYDDNFVLIGSANGQRVWSNSFPLPAAVTCGVWAPDSRQLVLGFSTGTIQVLSNAGVNITSRSFTEDKLTQMAFSPLRTKVREVEWTLAMLSSANKIYMISAYDQLHPAIYRSKFQVIRMEWNTDGTILALINANNELVMIDTTCRVIHRERIPIADKEKTLIPNPPPTQKLTAFTWAHNGNVVIIAAGGCLTVGRILFGVPSLFEIVTYDLWKMMGCSSKKVDKLPIPLKEMNALRELDHHVIRCRIPRSQDMCSYVCSVVDARCYCTIRPLARGSHTYVLCFEHLGGLVPLLLGRQVNRFLPQFQIFMYQSKPPTSSPPSGSSAQVEDVNSIFRYSTGRNSLWRRSKRQIRALMSRHVRPTRPDTRLLQVTSNVWCTRFNISSLSPSLLPTFLGQVIYKTSVLHLQPRQMTIDLAVLQRKDGKELPEASVDGTTHMTSSPDQGLTSEERQFFQKILAECLSLRAVINSSNFGKPPPPAAASTISLPCQPSTSKEPDSSAHTTPISTRTVESKHDVTSMASSVSTWHEEIEALAFIDGDADEKAMLVQPALKTGWAAMEQASKKDAEVIRSHVDKLASIAEQLSKRHGDFNVKRDKASINKMRSQMKTLLRRVNEIEQKVANGDVKTEVRQLLNTLNEMKKALGEGVPKSGRSLNSTCKIETMTNKTPFWNEQNQVYQLDFGGRVTQESAKNFQIELDSKQVLQFGRIEGGSYTLDFRYPFSAAQAFAVALASITQRLK

SEQ ID NO: 18905 - protein, 254 aa, Caenorhabditis elegans
MPVAIVTGASSGIGRAAALLLARNNYKLSLTGRNVAALNELAGQIVSAGSDKNDVLVTAVELASEEAPKTIVDATVQKFGRIDTLINSAGILRAGPVLDSGIEVYDELMNVNVRSLIRLTRAALPHIITTKGTVVNVSSINGPCPFPNVTYYCMSKSAVDQFTKCLALEMAPNGVRVNAVCPGVTVTNLHRTSGQDETTYSAFLERSKTTHALGRPGDANEVAEAIYFLASEKSSFTTGELLRVDGGRGIMHPR

SEQ ID NO: 18906 - protein, 687 aa, Caenorhabditis elegans
MLKPGDVVFYSRGTESTDFCDAVEKVVPDNTYYHVAIVSERGTIVEATGDGVLEYSLQKSIEENRPGCLEILEVANCCEKVLEAAATWSWTKLGLPYNDLFAADLINSDGKESYYCSQLITAAFEFAGVDMKWPAHTLNFNDKNVNQISFWNEYFEKRGKSQVPQGEEGSHPAQLRRSPRLLLKMRIFPNLINLNSLTETKLLELSSHFVAGNHVEFPSDRKFEVIEPRSGKPMATWHYATRDQVDLTVKEAKKAQKQWAKSSWMERSEILKKTGDLLKTHCNDIAYWECISNGKPIAEAKADVLSCVDTFYFYSGIASDLLGQHVPLDASRYAYTRRLPVGVVAAIGAWNYPIQTCSWKTAPALACGNAVIYKPSPLSPVTALILAEILKSAGLPDGVFNVIQGDAETAQDLIHHDGVSKVSFTGSIPTGKKIMKACADRNIKPVTLELGGKSALIVFDDADIDSAVSCAMMANFYSQGQVCSNASKVLVHKSVLKEFTKKLVDHTQKMKIGDPLKEDTQVGSHISAEHRNKVEGYISTAIAEGATKLCGGDRVAVHGLENGFYLSPCILTGITPKMTVYREEIFGSVLLIIPFDTEDEAIKIANDTDMGLAAGLVTKDLSRSYRVSEQLNAGNVYVNTYNDVSPLVPFGGVGESGFGRENGTAVLEHYTHLKSVFVNTGTCPNPF

SEQ ID NO: 18907 - protein, 503 aa, Caenorhabditis elegans
MRIFPNLINLNSLTETKLLELSSHFVAGNHVEFPSDRKFEVIEPRSGKPMATWHYATRDQVDLTVKEAKKAQKQWAKSSWMERSEILKKTGDLLKTHCNDIAYWECISNGKPIAEAKADVLSCVDTFYFYSGIASDLLGQHVPLDASRYAYTRRLPVGVVAAIGAWNYPIQTCSWKTAPALACGNAVIYKPSPLSPVTALILAEILKSAGLPDGVFNVIQGDAETAQDLIHHDGVSKVSFTGSIPTGKKIMKACADRNIKPVTLELGGKSALIVFDDADIDSAVSCAMMANFYSQGQVCSNASKVLVHKSVLKEFTKKLVDHTQKMKIGDPLKEDTQVGSHISAEHRNKVEGYISTAIAEGATKLCGGDRVAVHGLENGFYLSPCILTGITPKMTVYREEIFGSVLLIIPFDTEDEAIKIANDTDMGLAAGLVTKDLSRSYRVSEQLNAGNVYVNTYNDVSPLVPFGGVGESGFGRENGTAVLEHYTHLKSVFVNTGTCPNPF

SEQ ID NO: 18908 - protein, 470 aa, Caenorhabditis elegans
MTDDVDTHIHEKFDLQKRLGKGAYGIVWKAYDKRSRETVALKKIFDAFRNPTDSQRTFREVMFLQEFGKHPNVIKLYNIFRADNDRDIYLAFEFMEADLHNVIKKGSILKDVHKQYIMCQLFRAIRFLHSGNVLHRDLKPSNVLLDADCRVKLADFGLARSLSSLEDYPEGQKMPDLTEYVATRWYRSPEILLAAKRYTKGVDMWSLGCILAEMLIGRALFPGSSTINQIERIMNTIAKPSRADIASIGSHYAASVLEKMPQRPRKPLDLIITQSQTAAIDMVQRLLIFAPQKRLTVEQCLVHPYVVQFHNPSEEPVLNYEVYPPLPDHIQLSIDDYRDRLYEMIDEKKASFKRIQHEKIRPYGEDKSRAPIAQAECSDTDYDTARSLQRTTSMDKNNSSSHDSSSGTLRERAASAESRTSKDSNGEMRNGNGNTPSSIKQRRRSVERARLFANIKPSKILHPHKLISNY

SEQ ID NO: 18909 - protein, 367 aa, Caenorhabditis elegans
MTDDVDTHIHEKFDLQKRLGKGAYGIVWKAYDKRSRETVALKKIFDAFRNPTDSQRTFREVMFLQEFGKHPNVIKLYNIFRADNDRDIYLAFEFMEADLHNVIKKGSILKDVHKQYIMCQLFRAIRFLHSGNVLHRDLKPSNVLLDADCRVKLADFGLARSLSSLEDYPEGQKMPDLTEYVATRWYRSPEILLAAKRYTKGVDMWSLGCILAEMLIGRALFPGSSTINQIERIMNTIAKPSRADIASIGSHYAASVLEKMPQRPRKPLDLIITQSQTAAIDMVQRLLIFAPQKRLTVEQCLVHPYVVQFHNPSEEPVLNYEVYPPLPDHIQLSIDDYRDRLYEMIDEKKASFKRIQHEKIRPVVRRR

SEQ ID NO: 18910 - protein, 622 aa, Caenorhabditis elegans
MPPSGRFDRTIALAGTGHLKIGNFVIKETIGKGAFGAVKRGTHIQTGYDVAIKILNRGRMKGLGTVNKTRNEIDNLQKLTHPHITRLFRVISTPSDIFLVMELVSGGELFSYITRKGALPIRESRRYFQQIISGVSYCHNHMIVHRDLKPENLLLDANKNIKIADFGLSNYMTDGDLLSTACGSPNYAAPELISNKLYVGPEVDLWSCGVILYAMLCGTLPFDDQNVPTLFAKIKSGRYTVPYSMEKQAADLISTMLQVDPVKRADVKRIVNHSWFRIDLPYYLFPECENESSIVDIDVVQSVAEKTPPEKIIYFFIFRHFLKFDVKEEDVTGALLAEDHHHFLCIAYRLEVNHKRNADESSQKAMEDFWEIGKTMKMGSTSLPVGATTKSEKSERNVAKVVGKFSANVGRKILEGLKKEQKKLTWNLGIRACLDPVETMKHVFLSLKSVDMEWKVLSMYHIIVRSKPTPINPDPVKVSLQLFALDKKENNKGYLLDFKGLTEDEEAVPPSRCRSRAASVSVTLAKSKSDLNGNSSKVPMSPLSPMSPISPSVNIPKVRVDDADASLKSSLNSSIYMADIENSMESLDEVSTQSSEPEAPIRSQTMEFFATCHIIMQALLAE

SEQ ID NO: 18911 - protein, 798 aa, Caenorhabditis elegans
MSRRRQFDDEDEVQMKRRRGAPLIEDVEKKLQGVIGKVGENTGSSIECNLDKLTAFLHDDLEKYRASIIDIIAGCAIYLPNRVTVYTTLVGLLNSKNFNFGGDVVEKLISEQQDLLSKQKYQEAQNLAIFLCDLGNSGVLTAQSIGEYLESFIAAAFEENMPQVRNDYYIQTVLRCLPWIGKELTEKAPEQMENIGEAIGKYLELRNKNHVALLQVWREGSTDQKQEDYLESLSAQIEALRNADWVENHIPRHYSGFETTLQDALQHNLPSFQSPEHTSDMIYPYPLVVFRLFQDADCSAFSSKPLPGDSSIDRFLFEGEIAWIIEKNQFNRKACARELLAFAEENPSVPIGFLIFETIFGQMLRLPHAPYPAIFHCSLVLELLKLKPDDYPQILVQTVECIYRRADSMQPVCIDRMVDWFSFHLSNFQYRYTWTDWKDCLNKDAFSGSQIFVREVIEKCRRFGSYEKIIAALPQDFVKIHPCSPEVRYLIDEEDTALVQRAETFTQMFQERQPAEAFLNELKSNDENDELPYNINEFGLFVMVMLKMASKTYSHNFSALFRYQTTLKTVCDASELYQEKLLETLYSCWKTNQQMLMILTDKLLKMQVIDCSAVVGWLFDEKMWQEHDRQWLFEVLNQALEKLTRQINVVEKDIKELTEKTENKIKEEDDEESDIKMDEDETKEEKFKQDLEDLENNKEKLERMVTFQKGLFNDFLIAFIEEIKNAATSNTSEMDGSGDTPGTQTPKFMWLRGRFCHVLLAHAETLLKHSSNIADEVFSEGTDPSIIECFNQFQSLRL

SEQ ID NO: 18912 - protein, 510 aa, Caenorhabditis elegans
MLRSALRATVQARNASGVPPGLSNMKPQYTGIFINNEFVPAKSGKTFETINPANGKVLAQVAEGDKTDVNIAVKAAQNAFRIGSEWRRMDASQRGVLLNRLADLMERDRVILASLESLDNGKPYAVAYNADLPLSIKTLRYYAGWADKNHGKTIPIEGDYFTYTRHEPVGVCGQIIPWNFPLLMQAWKLGPALAMGNTVVMKVAEQTPLSALHVAALTKEAGFPDGVVNIIPGYGHTAGQAISSHMDVDKVAFTGSTEVGRLVMKAAAESNVKKVTLELGGKSPNIIFADADLNDSVHQANHGLFFNQGQCCCAGSRTFVEGKIYDDFVARSKELAEKAVIGDPFDLKTTQGPQVDGKQVETILKYIAAGKKDGAQLVTGGAKHGDQGHFVKPTIFANVKDQMTIAQEEIFGPVMTIIRFDTMEELVEKANNTIYGLAAGVMTKDIDKALHIANATRAGSVWVNCYDVFDAAAPFGGFKQSGIGRELGEYGLEAYTEVKTVTIKVPQKNS

SEQ ID NO: 18913 - protein, 359 aa, Caenorhabditis elegans
MGCFHSTGSEAKKRSKLIDEQLRHDHERCVGEIKLLLLGAGESGKSTIVRQMRILHETGFNKQEQMAYRPVVFSNMVQSMLAILKAMQPLNISFTDAAREEDARMFISHFLHVNNAELSEAFSLELSDLMKQLWMDEGVKKCVKRAHEYQLNDSAEYYFNALDRISSSSYLPTQDDILRARVKSTGIVETTFMYKDLCFKMFDVGGQRSERKKWIHCFDSVTAVIFCVALSEYDLRLAEDQTMNRMHESMQLFDSIVNNCWFTETSIILFLNKMDIFEERIRYTPLTVCFPEYQGGMTITETSTFIQSRFEILNKRQTPAQKEIYSHFTCATDTNNIRFVFDAVTDIIIRNNLYLCGLY

SEQ ID NO: 18914 - protein, 419 aa, Caenorhabditis elegans
MGMSATMGDSASIPGVFFADFGPAPPEITPEGYHEVELNKTKWVLPQWYNSLKPLGEGAYGVVCTAEYEPTGDRVAIKKFFRPFQSTIHAKRTYRELKLLRTLQHDNVLEMIDVFTPDPDASSLNNVYFVSVLMGSDLQNIMKIQRLTDEQIQLLIYQVLRGLKYIHSAGIIHRDLKPSNIAVNERCEVKVFLSFSQLSFLILSFFKILDFGLARAQDAEMTGYVATRWYRAPEIMLNWMHYTQTVDVWSVGCILAELVSGRPLFPGDDHIDQLTKIMSVVGTPKEEFWSKIQSEEARNYIKNRSPIIRQDFVTLFPMASPYALELLEMMLILDPDRRISVSSALRHDYLREYSVPNDEPVAMDTVINSIVTIDPAEERATTLSDWRELIWNEIRLFQNSARRLSFVSCTDTEEEPMKI

SEQ ID NO: 18915 - protein, 414 aa, Caenorhabditis elegans
MGMSATMGDSASIPGVFFADFGPAPPEITPEGYHEVELNKTKWVLPQWYNSLKPLGEGAYGVVCTAEYEPTGDRVAIKKFFRPFQSTIHAKRTYRELKLLRTLQHDNVLEMIDVFTPDPDASSLNNVYFVSVLMGSDLQNIMKIQRLTDEQIQLLIYQVLRGLKYIHSAGIIHRDLKPSNIAVNERCEVKVFLSFSQLSFLILSFFKILDFGLARAQDAEMTGYVATRWYRAPEIMLNWMHYTQTVDVWSVGCILAELVSGRPLFPGDDHIDQLTKIMSVVGTPKEEFWSKIQSEEARNYIKNRSPIIRQDFVTLFPMASPYALELLEMMLILDPDRRISVSSALRHDYLREYSVPNDEPVAMDTVTIDPAEERATTLSDWRELIWNEIRLFQNSARRLSFVSCTDTEEEPMKI

SEQ ID NO: 18916 - protein, 179 aa, Caenorhabditis elegans
MDAKVYVGGLPSDATSQELEEIFDRFGRIRKVWVARRPPGFAFVEYDDVRDAEDAVRALDGSRICGVRARVELSTGQRRGGGGRGGGFGGRGGGGRDRSPYRGDRGRSRSRSRDRGRDRSRDRSRDRSRDRSRDRSRERSRERERTRSRSRSPQERDRSHSKSRSRSRSRSRSRSASPH

SEQ ID NO: 18917 - protein, 153 aa, Caenorhabditis elegans
MDAKVYVGGLPSDATSQELEEIFDRFGRIRKVWVARRPPGFAFVEYDDVRDAEDAVRALDGSRICGVRARVELSTGQRRGGGGRGGGFGGRGGGGRDSGLRSSASPSAIPNITIFHSSPSSVFTTHSSLPHRYAPFTSPKIIAPELFLTLFIS

SEQ ID NO: 18918 - protein, 118 aa, Caenorhabditis elegans
MDAKVYVGGLPSDATSQELEEIFDRFGRIRKVWVARRPPGFAFVEYDDVRDAEDAVRALDGSRICGVRARVELSTGQRRGGGGRGGGFGGRGGGGRDRLVENNLIVKGKESCIKNFIR

SEQ ID NO: 18919 - protein, 1075 aa, Caenorhabditis elegans
MSSCVCLEPEEQLCPIFGLHYIFFTLYFHMDFFGKTLRSSIIKHGGRAKSPAGTGSGRKTVSFSSKNSDAKISNVSDCWNYMQTGSDFVKLRGTNRQFRRFFSLDADLSYIRWTPTNKKPHKARIAIDEIREIRLGKNTELLRSSDEVFTDLQEECLFSIIYGDNYETLDLIASSGDDANIWVTGLMALTSNKYECKPSSSQFATLRERWIESVFDEFDTKKNGHLDEQTAFKAILHINSRISHHRLTNKLKEVTIGAEESERGKIEKSHFVDLYKEIGTRPEVYFLMVRYANKDYLSCQDLRLFLETEQGMVGVTTDNCETLIEQYEPCSEARENNLMTVDGFTSFLFSPDCGVFDPNHRVVTMDMKQPFSRYFISSSRKSYLVEDQLGPSSSDGFSSALKRNCRFLEFDIWDPNEADGDTEPMVQNGQTATSKITISSALRIIREFAFERSRYPLLLKVSVHCSTDWQKVAAMLIVTHLGTRLYLPKNDPTNWDDEKNCPTPWDFQNRILIVGKKLDNPDTDSGEVSEEDDSLASTTRRKSKRIQLCKELSDLVPVFFNVKTLNDLLSTAPGSTTMSSRKNLASVTESTCLRLMHTYATEFGQATRNYCVRVFPNPSRVDSSNLNPQEFWNNGVQMVCLNYQTPGLMMDLQEGKFSDNGGCGYVLKPQVMKDDMFVPSDRVPTSPQILHLRILSGQQLPRPRGSNAKGDSADPFVVVEVFGLPGDCAEERTRTVRNDSINPSFDESFQFQVSVPELALVRFLVLDDDYIGDDFIGQYTIPFECLQPGYRHIYLLNNEGDPLEHATLFVHVAITNRRGGGKAKKRGMSVKRKNSRISSGMKLVGIKSVDDQFKVAVVPLAESTAIRNRLENAMIDWQEECGLGPAGTIRQGIRLIHSRMITLAVNSSPPPSPTTSSAESSVTPLFIIDSDEHGYPAIVTMGTLPDQLQRSFNKLKNLIAHCVTTLSQSDQLLSKIEDSIRRISECHEELSKLCAEAGLKGQKATRAAENFTWNLRLLKAQLNLMNKSQEEAQDVVTQVFDTGGVLGVLSQKLIIRKNGRRFSRVIADPVKDSVL

SEQ ID NO: 18920 - protein, 1068 aa, Caenorhabditis elegans
MTMAESDPENESADTTPRSLDVPFAKRKTLRSSIIKHGGRAKSPAGTGSGRKTVSFSSKNSDAKISNVSDCWNYMQTGSDFVKLRGTNRQFRRFFSLDADLSYIRWTPTNKKPHKARIAIDEIREIRLGKNTELLRSSDEVFTDLQEECLFSIIYGDNYETLDLIASSGDDANIWVTGLMALTSNKYECKPSSSQFATLRERWIESVFDEFDTKKNGHLDEQTAFKAILHINSRISHHRLTNKLKEVTIGAEESERGKIEKSHFVDLYKEIGTRPEVYFLMVRYANKDYLSCQDLRLFLETEQGMVGVTTDNCETLIEQYEPCSEARENNLMTVDGFTSFLFSPDCGVFDPNHRVVTMDMKQPFSRYFISSSRKSYLVEDQLGPSSSDGFSSALKRNCRFLEFDIWDPNEADGDTEPMVQNGQTATSKITISSALRIIREFAFERSRYPLLLKVSVHCSTDWQKVAAMLIVTHLGTRLYLPKNDPTNWDDEKNCPTPWDFQNRILIVGKKLDNPDTDSGEVSEEDDSLASTTRRKSKRIQLCKELSDLVPVFFNVKTLNDLLSTAPGSTTMSSRKNLASVTESTCLRLMHTYATEFGQATRNYCVRVFPNPSRVDSSNLNPQEFWNNGVQMVCLNYQTPGLMMDLQEGKFSDNGGCGYVLKPQVMKDDMFVPSDRVPTSPQILHLRILSGQQLPRPRGSNAKGDSADPFVVVEVFGLPGDCAEERTRTVRNDSINPSFDESFQFQVSVPELALVRFLVLDDDYIGDDFIGQYTIPFECLQPGYRHIYLLNNEGDPLEHATLFVHVAITNRRGGGKAKKRGMSVKRKNSRISSGMKLVGIKSVDDQFKVAVVPLAESTAIRNRLENAMIDWQEECGLGPAGTIRQGIRLIHSRMITLAVNSSPPPSPTTSSAESSVTPLFIIDSDEHGYPAIVTMGTLPDQLQRSFNKLKNLIAHCVTTLSQSDQLLSKIEDSIRRISECHEELSKLCAEAGLKGQKATRAAENFTWNLRLLKAQLNLMNKSQEEAQDVVTQVFDTGGVLGVLSQKLIIRKNGRRFSRVIADPVKDSVL

SEQ ID NO: 18921 - protein, 463 aa, Caenorhabditis elegans
MEERLSTTSSYPSHPGRSVEEDHNTLLASSSISSIIRGTRGHLNNFIESVGNWLVPSSSGRDDDAVSLDSCQSVYSPVRHHINSGTGGGILMEPSSIHVPENYYSVTIGEAQMVVLKRYQNLRLIGSGAQGIVCSAFDTVRNEQVAIKKLSRPFQNVTHAKRAYRELKLMSLVNHKNIIGILNCFTPQKKLDEFNDLYIVMELMDANLCQVIQMDLDHERLSYLLYQMLCGIRHLHSAGIIHRDLKPSNIVVRSDCTLKILDFGLARTAIEAFMMTPYVVTRYYRAPEVILGMGYKENVDVWSIGCIFGELIRGRVLFPGGDHIDQWTRIIEQLGTPDRSFLERLQPTVRNYVENRPRYQATPFEVLFSDNMFPMTADSSRLTGAQARDLLSRMLVIDPERRISVDDALRHPYVNVWFDEIEVYAPPPLPYDHNMDVEQNVDSWREHIFRELTDYARTHDIYS

SEQ ID NO: 18922 - protein, 350 aa, Caenorhabditis elegans
MMNASTKFSDNYDVKEELGKGAFSVVRRCVHKTTGLEFAAKIINTKKLSARDFQKLEREARICRKLQHPNIVRLHDSIQEESFHYLVFDLVTGGELFEDIVAREFYSEADASHCIQQILESIAYCHSNGIVHRDLKPENLLLASKAKGAAVKLADFGLAIEVNDSEAWHGFAGTPGYLSPEVLKKDPYSKPVDIWACGVILYILLVGYPPFWDEDQHRLYAQIKAGAYDYPSPEWDTVTPEAKSLIDSMLTVNPKKRITADQALKVPWICNRERVASAIHRQDTVDCLKKFNARRKLKGAILTTMIATRNLSNLGRNLLNKKEQGPPSTIKESSESSQTIDDNDSEKGNE

SEQ ID NO: 18923 - protein, 1725 aa, Caenorhabditis elegans
MFSLLNERAFVIDSGDDDDDEPRFSDNSRQDALQLLQSAIHKKFLRDRDVLNLPMEHYASMLFEHFSLDSGKDQIFPKFLNFPGATNAFKATQQLFRLANDTNDIGDRVIGMVREILAYVGNEQPSVRGAALEILGAPHLLMRIVVELGIEQSISKEILVRIHVARHDPIEAVSEIAERLWIENHLQVKQVIGAMLVVKNLQFLLGETEFPTIFNRKIPKKSLNYTNFADECVSPSPLVRQSAAHAMVTFIEEHPNEMPAILTKFDETYKDLVLIREPIYDDVGRLQREAIDESDRRSGIGQTLVLLAGLCRQEEAEQLIRIVAPDGLSDRAQECRNELRNAAVETIRRHGAACMLRLLPLLEKLSDETPAQDDNRRQGLVVLLGTLAQYIDSTEKVKGIVARLVEALGTPSQTVQESVSRCLAPLVPKIRQDAKDLVSKLQWTLFEAETYGERRGAAYGIAGLMKGMGIIALKDTDLLGSIHKNMEDKKSPKHREGGLLALEILCCTIGKLFEPYILKALPSLLITFGDTDSNVRQSAEDTARAMMASMTVYGTKLVLPVLIVAIDDDSWRTKCAATELLGSMAFCAPRQLSACLPNIVPKLIEILADSSSKVQKSGEKALQQIARVVRNPEILGVTNQLMAGLLDPANKTSAALQAVLNTKFIHYIDAPSLALMMPIVRRAFEDRLSETRRVAAQIISNIYSLTENKDMEPYLAHMVPGLQRSLLDPVPEIRAVSARALGAVVSKSGGSTSENLRAQVIPWLKEKLVSPQSTVDRSGAAQGLCEVLAGAGTEQLEYVMPEIIHATESTDVSAETRDGYILMYIYLPMTFGDRFVPYLPQVVPPILKALADENEYVRASALKAGQRLISQYCSHARKLLLPQLQLALMDENWRIRYASVQLIGDFLFNISGITGKSTSSTADEDDTMGMEQAGKVIVRALGQKDRDRVLAGLYLTRSDVALVVRQAAGHVWKMVVSNTPRTLREVTKILFEMVVDSLASTCDERQQMGARCLGELVRKMGDKVINDILPVLDANQKSEEVAKRVGVAIALHEIIGNMSKEVTNHYLGAIVAPVRRAICDESELVREAAADTFTVLYHVVGNEALDEIICPLLEQLTPEQDHILAGLCDVMRQNSRSMLPYLLPKLTKPPVNVHALCSLASVSGDSLSRQLPKVLDALLAACETNDESDPMIESCEKVVIAVTDEDGIPVLVDYLIQKASQDENVPAAVLLSTFIAKSGVSLAEMAEEVLPGLLNLYTSPNPQIVDHAIAAAVALTQSMDQRELLSVLPVVKKAINIIVAGAKGQQIPGFTHPKSLQPLVVMLRESILQGQIEMKALAAECLGMVVKVSDVAALKAHVVNITGPLIRVLGDRFPANVKLPIIETLSKLLDKVDAMLRPFLPQLQSTFLKALQEPTSRPVRLAAGGALARLLKLHPKPEATMTELLKLLATSTDQQLIESSLATARALIATCGQKMSPTTIDEIYRVTELIYSENVENPTELDASLTACSGALLGETIAQKSDWKTAQNCVLSGIESPSTSARGRQAKACALQQLCSSNGDELWASEANSACRSAFTSAFTSPDPIVASAALRGASHVLKVSIDRDLMSAVARSLNHASTDVRKTAGIALGHVGHSADLPNDILKLIVPQLINGCKESNSQVRAASELALVHALKMTQNEDRFEAYRNTLEGVVQRNLDETRVSLARVVRAGDVDLEPLDTILNVY

SEQ ID NO: 18924 - protein, 346 aa, Caenorhabditis elegans
MTDVEIKAENGSGDASLEPENLRKIFVGGLTSNTTDDLMREFYSQFGEITDIIVMRDPTTKRSRGFGFVTFSGKTEVDAAMKQRPHIIDGKTVDPKRAVPRDDKNRSESNVSTKRLYVSGVREDHTEDMLTEYFTKYGTVTKSEIILDKATQKPRGFGFVTFDDHDSVDQCVLQKSHMVNGHRCDVRKGLSKDEMSKAQMNRDRETRGGRSRDGQRGGYNGGGGGGGGWGGPAQRGGPGAYGGPGGGGQGGYGGDYGGGWGQQGGGGQGGWGGPQQQQGGGGWGQQGGGGQGGWGGPQQQQQGGWGGPQQGGGGGGWGGQGQQQGGWGGQSGAQQWAHAQGGNRNY

SEQ ID NO: 18925 - protein, 494 aa, Caenorhabditis elegans
MILLILTSILIIYLFNHFYWKRRKLPPGPIPLPIIGNLYLMTEDVKPGYKMYEKLKDKYGPVFTFWLANLPMVTVTDWKLIKQHFIKDGANFVGRPEFPISMEMRQGPYGIIESHGDRWIQQRRFALHILRDFGLGKNLMEEKVLGEVTAMIDSIRKSMEDVDMQNIFDASVGSVINNMLFGYRYDETNIEEFLELKNRMNKHFKLAAEPMGGLIGMNPWLGHLPFFKGYKNVIMHNWMGLMEMFRKQATDRLASIDYDSDEYSDYVEAFLKERKKHENEQDFGGFEMEQLDSVCFDLWVAGMETTSNTLNWALLYVLLNPEVRQKVYEELEREIGSDRIITTTDRPKLNYINATVNESQRLANLLPMNLSRSTNADVEIAGYRIPKDTVITPQISSVMYDPEIFPEPYEFKPERFLESDGSLKKVEELVPFSIGKRQCLGEGLAKMELFLYFANLFNKFDIKFHESNPNPSIKKEVGVTMKAKNYRVSMKERY

SEQ ID NO: 18926 - protein, 534 aa, Caenorhabditis elegans
MVRPEDFNSLELDNSLTDGETVHEMMAHKAGLTYNDFNILPGFINFGVHDVSLETNITKDLKIKAPLVSSPMDTVTESGMAIVMALYGGIGIIHGNFPKPEDQAAEVLKVKRFKQGYVMQPHCLSRDSTAFDMIQIKKKYGYTGAPVTEDGRVGSKLIGMVTSRDFDFITMDVAGQKGTPISDTNDVTPTTPITRIMVSVDQLHLGHINDAPELSQKKLKEHRLGKLPIVNDNGELCALLCRSDLLKARDYPMASYDSKGQLLCGAAVNTRGESQYTVDRVVEAGVDVLIIDSSNGSSTYQISMLRYIKEKHPHVQVIAGNVVTRAQAKLLIDQGADGLRIGMGSGSICITQDVMAVGRAQGTAVYDVARYANQRGIPIVADGGIRDVGYITKAISLGASAVMMGGLLAATTEAPGEYFWGPGGVRVKKYRGMGSLDAMEAHASSQDRYFTAESDQIKVAQGVSATMKDRGSCHKFIPYLIRGVQHGMQDIGVRSLRDFREKVDNGIVKFERRSTNAQLEGGVHSLHSFEKRLY

SEQ ID NO: 18927 - protein, 348 aa, Caenorhabditis elegans
MGCNFSSQSKLQVPEIRASRSITPASQKSEDPYSHIRLLLLGSAESGKTTVLEQVRLLYKQHFTESEYFHRRAFIYHNIFKSIKALCRAMRMSDIQFADPINMGRAQSIIADEHGHYGLFSKDLAEKIKHIWNDKSMQKLYARRSQFNLNDSASYFLNNIDKINMVDYKPSERDLIMAYVPTCGVQNVIFTACNQSFQLFDIGGQKIDRRKWALQYEGIDAIFFCIAISEYDQVMSEDMVTNRLDDALNLLQSISEDPAFATTPIYLFLNEIDVFCEKLSVIPLSKYKPDFKGGDQDDAIDFMENLACEALGKRDRSLYRVYRCIAIDTQMMAELLSTVFKDIAKRKK

SEQ ID NO: 18928 - protein, 355 aa, Caenorhabditis elegans
MACCLSEEAREQKRINQEIEKQLQRDKRNARRELKLLLLGTGESGKSTFIKQMRIIHGQGYSEEDKRAHIRLVYQNVFMAIQSMIRAMDTLDIKFGNESEELQEKAAVVREVDFESVTSFEEPYVSYIKELWEDSGIQECYDRRREYQLTDSAKYYLSDLRRLAVPDYLPTEQDILRVRVPTTGIIEYPFDLEQIIFRMVDVGGQRSERRKWIHCFENVTSIMFLVALSEYDQVLVECDNENRMEESKALFRTIITYPWFTNSSVILFLNKKDLLEEKILYSHLADYFPEYDGPPRDPIAAREFILKMFVDLNPDADKIIYSHFTCATDTENIRFVFAAVKDTILQHNLKEYNLV

SEQ ID NO: 18929 - protein, 2780 aa, Caenorhabditis elegans
MVRQIEKTVLNTVLTINSIDSQDQGEFALKIKNRCGEDKYAIGIQVTDRPAAPGKPAVEDQNVDSVRLRWAAPTNDGGSPVRNYTVEMCTEKGKTWTKAEVTKQAFITLFNLVPGESYRFRVRADNTFGQSEPSDESELVVVKNVSRVVEEPKKKEVKVKEQESVDYERVAKDSEPSEYKTIDIHRLPNDLQAKYIIHEELGKGAYGTVYRATEKATGKTWAAKMVQVRPGVKKENVIHEISMMNQLHHEKLLNLHEAFDMGNEMWLIEEFVSGGELFEKILEDDSLMSEEEVRDYMHQILLGVSHMHKNQIVHLDLKPENILLKAKNSNELKIIDFGLARKLDPKKSVKLLFGTPEFCAPEVVNYQPVGLSTDMWTVGVISYVLLSGLSPFLGDSDEDTLANVSASDWDFDDPSWDDVSDLAKDFICRLMIKDKRKRMSVQDALRHPWITKMQPKLDKSGVPARQKRNFLSLKRWSDDLLPIGRLAKRGAIFRRLTMDGVFERNIAFDTDAAPSVKKQLEDIVANVGDLIATLSCDVDGVPSPKVQWYKDDKELTVPSMKYDSFYNEGLAELTVKNIVESDAGKYTCRATNDLGSIMTHAKLSVKADEKKKKKSKTSPAVIEKKKDRKTSKVVVIEEMIDMPPNFHHLLQDDEAKIGEPKILVVTNTTLPEPTVDWYHNGEHISINDSNYLRKHDKGRYELHILSVDSTDEGKWKAVGKNAFGECESEAKLTVVIPDGQYAPSFGKQLSDVKCSESDILKLEVNIQANPAPEINWFRNESEIEHSQHHRLQFDDGSGNYSLTIIDAYAEDSGEYKCVAKNKIGKAHTVCCVRIEELLSKRSKKIDGSKAPRFRMQLPTPREVPQGADLTLVCSVSGTPHPNIKWTKDDKPIDMSNKQVRHENGVCTLHIIGARDDDQGRYVCEAENIHGVAQSFSVVEIKEAVDKDHVRPKFLEPLVNCSTCEGNEMVLECCVTGKPIPTITWYKDGLKLIIENRMLQYTDRKGVSRLNIMNVVMNDDGEYTCEAVNSLGKDFTHCTVKVVDMGLSKTRLTPVRSRSRSRSRSPSVVGGEIQRPPVVTRPLADATVTEGNRELLEVEVDGFPTPTIEWYHDGKLVAESRTLRTYFDGRVAFLKIYEAHEEHNGQYVCKVSNKLGAVETRAIVVVEAPDAAEHVTQMPTFVKKLQDVVLKTAGETATFTCQSYANPAAQVVWLHNGKALQQTKSNYKTRLFDDNTATLVIENVTDELCGTYTAVANNQFGDVHTSAQLTISGSEAKKIAASLPYFIIELKPKINVVEGATLSIQADLNGSPIPEVVWLKDNSELVESDRIQMKCDGVNYQLLVRDVGLEDEGTYTITAENEKGKIRQNTEVSVTKSKEVKEKKEKKKVEKKDEGKKKPGRPGLPRPSGASKTEQVTMAFDAPSEGPADSYEVERRCPDQREWVSCGSTKSLELEIKGLTPNTEYIFRVAGKNKQGLGEWSEMTSTLKTASVGQAPQFTISPQSKIIANRDDEFEIAVEFSGTPTPSVKWYKENLQIVPDEKIDVATTSTSSILNLKSQEENGTFNCLIENELGQASASCQVTIFNKPASLQSTPDHSLERNLVPTLQKALNNESAQAGQQIMLTCRISSRSESTVAWFKDDERIESAGRYELSSDKKSNHKLVCHAVQSQDTGKYRCVVTNKYGYAESECNVAVEDVTKFIAPSFSATLSDSTAILGHNITLECKVEGSPAPEVSWTKDGERISTTRRIRQTQDENGNCKLSISKAESDDMGVYVCSATSVAGVDSTSSMVMIAKTTGTDSHLVIAQTADEKHEKPRFTRAPPSLIEVNESGQFTLIAKAVGEPKPTVTWLKDGREILRTNRIYHHFVTGDGESHLIAECVVSKTSGIFSCKAENPNGTVIAETQVIVQRMKPANQLANVAPKFTIPLTDMGIVNGHPTTLSCNVTGSPEPTLEWIYIDDSGHKINLTSSTTDWTECRFGKVAELKSERVLREQRGTYQCIATNSSGQATTQCYLLVGELSDEPAGPPRFVKCLQDTWTPLKESIEFSVELAGFPTPDLTWYHNEKKINEGKDVKITFPSDTTSVLSIKNVSLASLGMYFVEASNIHGVLRTAGRLNVSDERRKAEPPQFKHVLEPVLAVQPKVAFSEEHPRASSSAATARVKKGAAPMFLQGLEDMDLKAGASAAVAGKLGRKLRPHRSTTNDADKLAKALAQSLRLDEPRASIDSRPESAANAALDEVRAAINSRNKRVCRPKFMVKPKPRKVLEEYKSLRLKTAISGNPMPQVHWDKEGIILETGNKYSIYNDGDFYYLEVHHVSTFDKGFYNCTAANNEGIITCTSEIDVLPNKEDSAAQVAKRKSRKEAKAPNFIEVLPGRSQANLNESLCVECSVSAYPCASIIWTRNSVRLLPQADRYTMSYDGECASLKFISVTPGDEGTYACEAVNELGSAVTNMNLQVSGVDPNAAEGIPPLFRFEKIKSVRKVVDGSRVELAAELVQASEPLQIRWLRNKVTIVDSPSFSYSRSENMVFLTIADVFPEDGGEYTVEAKNQSGIARCTMQLDVRNNERSVADEAPRVFDFEPTTRSDPGVSVELRAKVIGHPDPVISWTKAGQKLNNEEKYMMRNEGDKFILRIANVTRADAGKYELTAINPSGQANAELELTVVQSTKTVGAKPKFNESPISVQTCEKNRAELRASFSGTPAPACRWFYNGNELIDGLDGYTITSSDTNSSLLINSVDKKHFGEYLCTIRNQNGEELANAMILSEGSSAALPQRRTIRR

SEQ ID NO: 18930 - protein, 2808 aa, Caenorhabditis elegans
MVRQIEKTVLNTVLTINSIDSQDQGEFALKIKNRCGEDKYAIGIQVTDRPAAPGKPAVEDQNVDSVRLRWAAPTNDGGSPVRNYTVEMCTEKGKTWTKAEVTKQAFITLFNLVPGESYRFRVRADNTFGQSEPSDESELVVVKNVSRVVEEPKKKEVKVKEQESVDYERVAKDSEPSEYKTIDIHRLPNDLQAKYIIHEELGKGAYGTVYRATEKATGKTWAAKMVQVRPGVKKENVIHEISMMNQLHHEKLLNLHEAFDMGNEMWLIEEFVSGGELFEKILEDDSLMSEEEVRDYMHQILLGVSHMHKNQIVHLDLKPENILLKAKNSNELKIIDFGLARKLDPKKSVKLLFGTPEFCAPEVVNYQPVGLSTDMWTVGVISYVLLSGLSPFLGDSDEDTLANVSASDWDFDDPSWDDVSDLAKDFICRLMIKDKRKRMSVQDALRHPWITKMQPKLDKSGVPARQKRNFLSLKRWSDDLLPIGRLAKRGAIFRRLTMDGVFERNIAFDTDAAPSVKKQLEDIVANVGDLIATLSCDVDGVPSPKVQWYKDDKELTVPSMKYDSFYNEGLAELTVKNIVESDAGKYTCRATNDLGSIMTHAKLSVKADEKKKKKSKTSPAVIEKKKDRKTSKVVVIEEMIDMPPNFHHLLQDDEAKIGEPKILVVTNTTLPEPTVDWYHNGEHISINDSNYLRKHDKGRYELHILSVDSTDEGKWKAVGKNAFGECESEAKLTVVIPDGQYAPSFGKQLSDVKCSESDILKLEVNIQANPAPEINWFRNESEIEHSQHHRLQFDDGSGNYSLTIIDAYAEDSGEYKCVAKNKIGKAHTVCCVRIEELLSKRSKKIDGSKAPRFRMQLPTPREVPQGADLTLVCSVSGTPHPNIKWTKDDKPIDMSNKQVRHENGVCTLHIIGARDDDQGRYVCEAENIHGVAQSFSVVEIKEAVDKDHVRPKFLEPLVNCSTCEGNEMVLECCVTGKPIPTITWYKDGLKLIIENRMLQYTDRKGVSRLNIMNVVMNDDGEYTCEAVNSLGKDFTHCTVKVVDMGLSKTRLTPVRSRSRSRSRSPSVVGGEIQRPPVVTRPLADATVTEGNRELLEVEVDGFPTPTIEWYHDGKLVAESRTLRTYFDGRVAFLKIYEAHEEHNGQYVCKVSNKLGAVETRAIVVVEAPDAAEHVTQMPTFVKKLQDVVLKTAGETATFTCQSYANPAAQVVWLHNGKALQQTKSNYKTRLFDDNTATLVIENVTDELCGTYTAVANNQFGDVHTSAQLTISGSEAKKIAASLPYFIIELKPKINVVEGATLSIQADLNGSPIPEVVWLKDNSELVESDRIQMKCDGVNYQLLVRDVGLEDEGTYTITAENEKGKIRQNTEVSVTKSKEVKEKKEKKKVEKKDEGKKKPGRPGLPRPSGASKTEQVTMAFDAPSEGPADSYEVERRCPDQREWVSCGSTKSLELEIKGLTPNTEYIFRVAGKNKQGLGEWSEMTSTLKTASVGQAPQFTISPQSKIIANRDDEFEIAVEFSGTPTPSVKWYKENLQIVPDEKIDVATTSTSSILNLKSQEENGTFNCLIENELGQASASCQVTIFNKPASLQSTPDHSLERNLVPTLQKALNNESAQAGQQIMLTCRISSRSESTVAWFKDDERIESAGRYELSSDKKSNHKLVCHAVQSQDTGKYRCVVTNKYGYAESECNVAVEDVTKFIAPSFSATLSDSTAILGHNITLECKVEGSPAPEVSWTKDGERISTTRRIRQTQDENGNCKLSISKAESDDMGVYVCSATSVAGVDSTSSMVMIAKTTGTDSHLVIAQTADEKHEKPRFTRAPPSLIEVNESGQFTLIAKAVGEPKPTVTWLKDGREILRTNRIYHHFVTGDGESHLIAECVVSKTSGIFSCKAENPNGTVIAETQVIVQRMKPANQLANVAPKFTIPLTDMGIVNGHPTTLSCNVTGSPEPTLEWIYIDDSGHKINLTSSTTDWTECRFGKVAELKSERVLREQRGTYQCIATNSSGQATTQCYLLVGELSDEPAGPPRFVKCLQDTWTPLKESIEFSVELAGFPTPDLTWYHNEKKINEGKDVKITFPSDTTSVLSIKNVSLASLGMYFVEASNIHGVLRTAGRLNVSDERRKAEPPQFKHVLEPVLAVQPKVAFSEEHPRASSSAATARVKKGAAPMFLQGLEDMDLKAGASAAVAGKLGRKLRPHRSTTNDADKLAKALAQSLRLDEPRASIDSRPESAANAALDEVRAAINSRNKRVCRPKFMVKPKPRKVLEEYKSLRLKTAISGNPMPQVHWDKEGIILETGNKYSIYNDGDFYYLEVHHVSTFDKGFYNCTAANNEGIITCTSEIDVLPNKEDSAAQVAKRKSRKEAKAPNFIEVLPGRSQANLNESLCVECSVSAYPCASIIWTRNSVRLLPQADRYTMSYDGECASLKFISVTPGDEGTYACEAVNELGSAVTNMNLQVSGVDPNAAEGIPPLFRFEKIKSVRKVVDGSRVELAAELVQASEPLQIRWLRNKVTIVDSPSFSYSRSENMVFLTIADVFPEDGGEYTVEAKNQSGIARCTMQLDVRNNERSVADEAPRVFDFEPTTRSDPGVSVELRAKVIGHPDPVISWTKAGQKLNNEEKYMMRNEGDKFILRIANVTRADAGKYELTAINPSGQANAELELTVVQSTKTVGAKPKFNESPISVQTCEKNRAELRASFSGTPAPACRWFYNGNELIDGLDGYTITSSDTNSSLLINSVDKKHFGEYLCTIRNQNGEELANAMILSEVLSMFYSSLFLVVFVDIVAQCHVARLLHFLNEERFVGRNIFA

SEQ ID NO: 18931 - protein, 1096 aa, Caenorhabditis elegans
MSRVSGYFMGISKKNGQKKHPARPSTESSTSSSHHRRPAQEMNGTSTATATGGGGTSGATTTASSGAPAASSGGSSARYSSSGRSHPTSGSSSSHARSTGQSGMSSRSAARRNDQDVHVGKYKLLKTIGKGNFAKVKLAKHVITGHEVAIKIIDKTALNPSSLQKLFREVKIMKQLDHPNIVKLYQVMETEQTLYLVLEYASGGEVFDYLVAHGRMKEKEARAKFRQIVSAVQYLHSKNIIHRDLKAENLLLDQDMNIKIADFGFSNTFSLGNKLDTFCGSPPYAAPELFSGKKYDGPEVDVWSLGVILYTLVSGSLPFDGQNLKELRERVLRGKYRIPFYMSTDCENLLKKFLVINPQRRSSLDNIMKDRWMNVGYEDDELKPFIEPPKDQIDEQRIEKLIQIFQLGFNKAAILESVEKEKFEDIHATYLLLGERKSDPSRYSRSSATATGASITAGSALASAANAQKHQQSSAAPSSGSSSSRRSSQNDAAATAAGGTVVMSGTRHGGVQMRAQPTSRQATISLLQPPSYKPSSNTTQIAQIPPLFNRNSTATSSAAQPSTGITGTRKIADPKGRIPLNSTAVQGHRTATGAVAANNGGIPSHRDHAQQQQYMNQLTSSTMMSKLINKTPAAGGTAATSSSSSSSATSTAPLQKSGSQISHAPTEPVIREDDDENNSENQNGNVPLIGGVGPQTSPAVQVPTEDATSSSDKEQQQQKASSETPKESKPSMIHQSPSMPPSQMMTAMESLKLSESGQTGGPTVATGGPPQRATSQQMSRSATTNSANMGASSGGAAAAASATNQLSGAPSSTGASSQQYHPKAPSSSSSSSTNPPHQHQLTHNASFSVTPSSYQIPTSTAVNVTSTGMPTSSSSSAFPRNTRNRQTFHGKTEKDKGGDDSSDEIGETPGNVSIGATGPSANNAEATIWSKLSKLTRRDHNRESMTQPVSGRAGTIGASQGQQTAAALAAIREQSGPIAPGAGQVAPSLPIHEGDVKPRSLRFTWSMKTTSSLAPDDMMREIRKVLDANGCDYEQRERYMILCVHGDPNTDSLVQWEMEVCKLPRLSLNGVRFKRISGTSIGFKNIASKIAQELNL

SEQ ID NO: 18932 - protein, 384 aa, Caenorhabditis elegans
MSSTAGQVINCKAAVAWSAKAPLSIETIQVAPPKAHEVRVKILYTAVCHTDAYTLDGHDPEGLFPVVLGHEGSGIVESVGEGVTGFAPGDHVVPLYVPQCKECEYCKNPKTNLCQKIRISQGNGFMPDGSSRFTCNGKQLFHFMGCSTFSEYTVVADISLCKVNPEAPLEKVSLLGCGISTGYGAVLNTCKVEEGSTVAVWGLGAVGLAVIMGAKAAGAKKIVGIDLIESKFESAKFFGATECINPKSVELPEGKSFQAWLVEQFDGGFDYTFECIGNVHTMRQALEAAHKGWGVSCIIGVAGAGQEIATRPFQLVTGRTWKGTAFGGWKSVESVPRLVDDYMNKKLLIDEFITHRWNIDDINTAFDVLHKGESLRSVLAFEKI

SEQ ID NO: 18933 - protein, 670 aa, Caenorhabditis elegans
MLSKLFVFLLICYATADEVDKKEAKHGFQLFHWNWDHIHKVYVITTWLLVASLAKILFNLMKPLSKWLPDSSLLIIVGLGLGYFLNQTTLSGVHLDSHAFFLYLLPPIIFDAGYFMPNRALFKNFDSVLVFSVLGTLWNTFAIGGSLLIMSKYQLFTMPFTTFEILVFSALISAVDPVAVIAIFEEIHVNEFLFINVFGEALFNDGVTVVLYQMFKSFALIGSENLSPWDYATGGLSFFVVALGGAAIGIIFAIATSLATKYTQGIKILAPVFIFLLPYMAYLTAEMVSLSSIIAIAVCGMLMKQYIKGNITEAATNSVKYFTKMLAQCSETVIFMFLGLSTLTSEHHVDFIFIGATLVFCLIYRAIGIIVQCFILNKFRAKKFEVVDQFILSYGGLRGAIAYGLVVSIPASIQAKPMFITTTICVIYFTVFLQGITIRPLVNCLNVKKKEHREATMVESVYNKYLDYMMSGVEDIAGQRGHYSFIENFERFNAKVIKPVLMRHEKRQSFDATSIIRAYEKITLEDAIKLTKVKSTLQNKRLEKVKSEVRVAPEQTTVTPKDVQLARFMQSGENIDQLYTLFSDLLDKKLNELKVQADKVDKANDDDIQDDYMAEMGSHSNLGFMHHSADQLDSDSVFQRRGRRLSTGDLKGHCGTSRKPKHSMFELRHV

SEQ ID NO: 18934 - protein, 498 aa, Caenorhabditis elegans
MSPPQENRSPKAEYLNNFFNTNPTNGKSRGSQEAPRKPLGQTNLNVQGSMPAKKEGFNRVLDGLKKRQLQHDFKLERAAETYEPTQNIGSGAFGIVCEAVETSSNQKVAIKKVAHASATPTLARRTLREIRVLRYINHPNIVPLRDIFRTKGPLGIDVFLVMDLMQNNLHHIIYGNEDPLEEHYINAFLGQLLRGLEYLHAACIAHRDLKPSNLLVNQDGTLRIADFGMAKCADNSSKKHDDEEHCYYMTQHVATLPYRAPELLFVLPEHSTAVDMWAVGCIFGEMVIRNEILPGRSVQGQIKMLLTMLGQPPQEVINEVRCDRTRKLIQDFGRKADAEWDDIMFCKARGDDQIVRGNCDTIDFVKQLFQYDAQKRINIQDALLHPYIQRVIPAEAPQKKCPFRVKKDMMQVEDLNHQELISMMKQDVRSAENPITYSELHSGGDYNTWIAGVFQSERSREIIKNEYSTSSYTSPELDREYIGHVNQYQRGILSNCAA

SEQ ID NO: 18935 - protein, 486 aa, Caenorhabditis elegans
MSPPQENRSPKAEYLNNFFNTNPTNGKSRGSQEAPRKPLGQTNLNVQGSMPAKKEGFNRVLDGLKKRQLQHDFKLERAAETYEPTQNIGSGAFGIVCEAVETSSNQKVAIKKVAHASATPTLARRTLREIRVLRYINHPNIVPLRDIFRTKGPLGIDVFLVMDLMQNNLHHIIYGNEDPLEEHYINAFLGQLLRGLEYLHAACIAHRDLKPSNLLVNQDGTLRIADFGMAKCADNSSKKHDDEEHCYYMTQHVATLPYRAPELLFVLPEHSTAVDMWAVGCIFGEMVIRNEILPGRSVQGQIKMLLTMLGQPPQEVINEVRCDRTRKLIQDFGRKADAEWDDIMFCKARGDDQIVRGNCDTIDFVKQLFQYDAQKRINIQDALLHPYIQRVIPAEAPQKKCPFRVKKDMMQVEDLNHQELISMMKQDVRSAENPITYSELHSGDSTGSTSDMSTNTSGEYSPIAQHEQLLEDVATQISICEPTCDL

SEQ ID NO: 18936 - protein, 248 aa, Caenorhabditis elegans
MSALLGGRIAVVTGGASGIGKAISQTLAKHGARVVVADLDSGNAAATAKALPASQSHSSFACDVSNADSVKGLSEHVKSLGTPSILVNCAGITKDSTLLKMKQEQWDSVIKVNLTGVFHVSQAFVKASVDNNNHPLSIINVSSIVGKMGNFGQTNYAATKAGVIGFTKSAAKELAKKNVRVNAVLPGFIKTPMTEAMPPTVLAEICKGIPMGRMGEAEEIANSVLYLASDLSSYVTGATLEVTGGFSM

SEQ ID NO: 18937 - protein, 276 aa, Caenorhabditis elegans
MATINSHLREPERVNLLSDHDDSDDDEVHVKRNPQMWPMSMASSAHAEAGIVDADGILPGCVGKANRMIRIAFLRKVLGIVGFQLLFTIGICAAIYNIPNSNQLLQKHAWIVFPNLLGSIALIIALHVYAREVPLNYVLLAAFTAVQAVTMGCVVTLFEAKVVLEAAVITGLVVASLFAYTLQNKRDFSVGYASMGSLLCVLLWAGIFQMFFMSPAVNFVINVFGAGLFCVLLVIDLDMIMYRFSPEDYICACVSLYMDILNLFIRILQIVAEANK

SEQ ID NO: 18938 - protein, 749 aa, Caenorhabditis elegans
MRSQKTLLVILTLLLSYNVFCTGDTNGTLAQDPADQLLNTVPENFTNNIEYPQNNNNNTSETDESMDAEGEWVQSAPPEEIEEAKHLLDPVHVDFEHTHKPLAFVFLIILVTLAKPTLHWPVLRKLPESVVLMLYGVLMATAVKALMRIDPGQLDTFMFFMILLPAIVNDAGLSMQKKEFTIALPKILLFAVVGTVVHALLLAATMYGIEPIFSFKPGFLHLFVFATLISAVDPVSVLSTFAELDVKKSLFILIFGESLCNDAVTIVLYRTSINVIKTSDASDEMLTITSVVGSCVVQFMIVCGFGLLCGAVVGFAGVFIMKNMVGHQMNQPIFQLFCPYLAYLLAETGHYSGILASILCAAIMSYYMAANMCVEMEFAAFTFSKTGSSLSESCIFFYLGVSLVSYNHEFDFYFIAVTVFCCTLYRFLVTCTLSAFYNLFASEKNRIPFTDQLVVTHAGIRGAVCFGLVQIIDERIIPAKPYFVTTTLAMIFVTSILQGCTIKFVMKCLKIPGDDGTKQKDPKALRWLTHLNDKYIKKFLVSENTYLPTDETFRNLGLPKAVSTALRIGERSHTDLQRHGEVSHTPAPSVGRPTIAPFDFGNMEEENNRLPSTGRRTPVARSQTRYSRHFIYAIPNETDNYLTCPVSASKRPPFDPSQVYQHQNTISNPGDDRARCYNRRHNSMSGADEMELKQLNQTVQKKLSRTITSGTKQFVVNPDEAIREESPATIPKKRATFEDDEISKIDESE

SEQ ID NO: 18939 - protein, 684 aa, Caenorhabditis elegans
MDAEGEWVQSAPPEEIEEAKHLLDPVHVDFEHTHKPLAFVFLIILVTLAKPTLHWPVLRKLPESVVLMLYGVLMATAVKALMRIDPGQLDTFMFFMILLPAIVNDAGLSMQKKEFTIALPKILLFAVVGTVVHALLLAATMYGIEPIFSFKPGFLHLFVFATLISAVDPVSVLSTFAELDVKKSLFILIFGESLCNDAVTIVLYRTSINVIKTSDASDEMLTITSVVGSCVVQFMIVCGFGLLCGAVVGFAGVFIMKNMVGHQMNQPIFQLFCPYLAYLLAETGHYSGILASILCAAIMSYYMAANMCVEMEFAAFTFSKTGSSLSESCIFFYLGVSLVSYNHEFDFYFIAVTVFCCTLYRFLVTCTLSAFYNLFASEKNRIPFTDQLVVTHAGIRGAVCFGLVQIIDERIIPAKPYFVTTTLAMIFVTSILQGCTIKFVMKCLKIPGDDGTKQKDPKALRWLTHLNDKYIKKFLVSENTYLPTDETFRNLGLPKAVSTALRIGERSHTDLQRHGEVSHTPAPSVGRPTIAPFDFGNMEEENNRLPSTGRRTPVARSQTRYSRHFIYAIPNETDNYLTCPVSASKRPPFDPSQVYQHQNTISNPGDDRARCYNRRHNSMSGADEMELKQLNQTVQKKLSRTITSGTKQFVVNPDEAIREESPATIPKKRATFEDDEISKIDESE

SEQ ID NO: 18940 - protein, 611 aa, Caenorhabditis elegans
MKLLWTISTILLISSTVAGSNNGNTRLDMAAQRRASNIHRMDTIILLTYVSVMVLIVVTAWAFKHYRFRFIHESGVTLFYGLLIGFVIRYFGLGLLQSQTFDVITKNKTIVKEPPDYLMLEVKPEGGSRVSFHYELIEGFFADKRKKIEQQIEQKSVFSPEVFFNMLIPPIIFNAGYSLKKRHFFRNIGSILAIVFIGTTISCFGTGCLMFVFTSIFQMGYSFKELLFFGALISATDPVTIISVFNDMNVEADLFALIFGESALNDAVAIVLSEVIENFSTSSEAITLQDFGSAIAGFAGVFFGSLMLGFMIGCMNAFLTKMTLISEHALLESSLFVLISYISFLVAEVCGLTGIVSVLFCGIAQAHYTYNNLSDESQSNTKHFFHMVSFIMESFIFCYIGVSVFVTNNQRWSFSFLLFSLISITASRALFVYPLSWLLNIRRRPKIPKRYQHMILFAGLRGAMAFALAGRNTSTENRQMIFATTTAVVIVTVLVNGGLTSWMIDYLQIKHGKDAIEEGQRLENSMSSSPADQHSDLDESVPVTMSPGLNPWDKAFLPRKWYHFDASFMKPLLTHATPSLEQTLPPFCLPLTSLLTSSRQRAGETSSFDCE

SEQ ID NO: 18941 - protein, 630 aa, Caenorhabditis elegans
MKLLWTISTILLISSTVAGSNNGNTRLDMAAQRRASNIHRMDTIILLTYVSVMVLIVVTAWAFKHYRFRFIHESGVTLFYGLLIGFVIRYFGLGLLQSQTFDVITKNKTIVKEPPDYLMLEVKPEGGSRVSFHYELIEGFFADKRKKIEQQIEQKSVFSPEVFFNMLIPPIIFNAGYSLKKRHFFRNIGSILAIVFIGTTISCFGTGCLMFVFTSIFQMGYSFKELLFFGALISATDPVTIISVFNDMNVEADLFALIFGESALNDAVAIVLSEVIENFSTSSEAITLQDFGSAIAGFAGVFFGSLMLGFMIGCMNAFLTKMTLISEHALLESSLFVLISYISFLVAEVCGLTGIVSVLFCGIAQAHYTYNNLSDESQSNTKHFFHMVSFIMESFIFCYIGVSVFVTNNQRWSFSFLLFSLISITASRALFVYPLSWLLNIRRRPKIPKRYQHMILFAGLRGAMAFALAGRNTSTENRQMIFATTTAVVIVTVLVNGGLTSWMIDYLQIKHGKDAIEEGQRLENSMSSSPADQHSDLDESVPVTMSPGLNPWDKAFLPRKWYHFDASFMKPLLTHATPSLEQTLPPFCLPLTSLLTSSRQRAYVSAEPFNTIVQSGIPLIDGSGCDEESV

SEQ ID NO: 18942 - protein, 783 aa, Caenorhabditis elegans
MWIKLLFFFTTLLVSTSGLGDDGITALLDPNSTEFSTVLPSNNSEKFSYMLASVKNMNMTASEFEEFIKVLKHRQSKDHSGEHVGNEHDESHGISVVSWHWDYVKNELVLTLFFIVIGLFKLVYHHTFVTRKILPESCCLIFIGIAIGFFFVGDATHASIKFLEFKSKVFFFYLLPPIILESAYSLKDRAFIENIGTILLYAVVGTILNIVLLAAALLILIWVGIMGKYNLSVMDILTFASLVAAVDPVAVLAVFQEVGVNKMLYFMVFGESLFNDAVTIVCYNLAIEFQTLPDFTWYHGFLGLLSFLCVSIGGLIIGLICGAISSFVTKFTTDVRVVEPVVLFGMAYLAYLGSEMFHFSGIIALIACGLFQTHYACCNISYKSFTSVMYITKVCSTLCESLIFIILGVMLVNEREWFWTDWHPVFSAVSVVLCVVVRFGVTFFLTYFVNQFTGGVRHISFQEQFIMSYGGLRGAVSFSLVFMISANPDVKNTMLGATYAVILFTNIIQGSTIKLFVKWLNIRLAKKEDHFRLFIEFNNGMVQHLSQGIEDLCGDKSLSLINRMSELSKKYVRPLLEKNYTANKAKKEGKLVELNRAVAMREALNNSPSQSSFQRQHTIDEMAESGALPHDLLDEEHQGHHHHGQVHPDNEDADQRANELIKDVSSIRQLMHNPFEDCYLDRNLTHEEEKEQARLKMKKTRAFKFSSVRKTIGFFGKKKSVRRHATQQGILHSAIATIGVQSVDRPSTSTRVSVEDEEQGLTMKEMEEEHPLMTITESEETSF

SEQ ID NO: 18943 - protein, 644 aa, Caenorhabditis elegans
MSLLRRPWVLVVGLLLIMSYVGAECEEEEKEYPSRYPIAYFEWENVKIPMTICLWLIGASIAKIIFNLIPHLNELFPDSALLIMIGLIIGIIFKLIGVNKNAFFLESEVFMLYLLPPLVFDAGYFMPARQFFDNFGSILCFAMIGTSFNIVAIALSLWAISLTGLFSVETPLMHMLLFGSVAADVDPVAVIVIFEELKVNEVLFIAVFGESLLNDGVAVVLYRMFLTFSEIGTENLITSDYINGGVSFLVVAFGGIGIGLLFAFLTSLVTRFARDEEVKVLNSVFILILPYTCYLCGELFGLSSIMAIVFCGAAMRQYCRENVDPDTVKATESFIKVLSLASETVIFVFLGLSTVSSNHHWDTSFIVLTVVFCLIYRTLGVVVMCYFLNKYRLNKYTKVDQFIMAYGGLRGAIAYGLVVAIPDFIPGKNMFVTSCIIVIYFTVFLQGITLKPIAEFLQVEKKNVHSKNMIEHIYSELIDTTMAGMEDIAGFKGHHWIRDSWNALNNNYLRPILVNKNNMKEMDKTKLVRKYKHLVDEDAKKIARGDLNSNMVFTKALIEHTRSRTNTMIDGVSSTSKIDFTKHMKENFGVTVYDDHSTVPMTPTHLFQETTEVEYSVRSEINDNDGFENDGYESDESGSFHERV

SEQ ID NO: 18944 - protein, 1633 aa, Caenorhabditis elegans
MNDYEIRDLTGSSQKSNNQKISNNSGESAHFNGTSENVKTESDDDSTCSSSLNKLSNRHSEPMNHLSVGGFVAKDLLSSLTIPLPQTVIRTCQSIDIDTPDRSRNDKTLTSFFYSSCKNLLLTTIIPDPLDLVAAAVGQSTAQALLVAQIGWMVCVCCRCCLCKCIANGRGVRGQKKQIQEPTIADDDGRDLPYEVPGSIHIPKPVYNKKLSKSRSSSVPHVSVPSLVSSSADYKRLSMWETSLNVESDVEPLHTPPLVVGRKLDYIDKEGNNPSCCRERGTRKPGFRPLRGSGSPPPPDPSTSTKVAVTSASEVKKIKDHKKQLKKEKEKKKKMDKKQSSSGGGFFTRWFGGSGSNNSQQNLAEDVIDARSERKTAKQREQELLQRSERRSGGRTHSHEEYRRHQQPSLMVNTNFDEDDYATIDRVRRSNNREMSMPASPRNVHFVDETSGPLSRTMNESAFGDRAHLQYRPRAQKGAAGPTTRGAPTSSVNQLDEATLDLLRLSTEPSPVPSRRALPKSASLSSVQQKQPIKTADGGQLKIGSVYTWDQNSVDTTTDDERAKDFLRGDRSSRLSPQSERKNERQIQIRQQSSGPTNRRETEIEYEEKRQGPPVVRTTVEGKLKMEKIVGADLITVDSCISSAWTVRDTVTNYKIKSTIGKKSLILEEIKDGQSKYKITLIENGETKMEREASLDVPDFVNKKDYLAEVSKKLLSDLREDSESVSALTHIEVEIVEDVTNILKTYVIGERADDVLAEEQLRLHYEQTADKTPSPIPLEKVEKIYVDELQKDKIELEDPEKADIHLIKDGRHFEGEGALKRIRRFETEESIEKPTVIRMEPRCAHAFADCDVAKKDDTSNYTVKIAVPLVHTITFLLKKSKMMRQQKAAGYEMEQEGQRFEDETTLRRIKRYETEEEEEKQHVAVIQHVEEVKVATMKTQREVEAEGGQYEMSQEGIHLRGETTFKKRGKHLDSESSEERFMEREAEGGQYAMQMEGERLLGEKKFRSKGRHYESESEESMASWNGGSPTLVDLVKKESSSIFEATFETANNHSPIVAEVRRPKLKKENTTIGCTISNQKATSANAELTTKHVNTEKGSGKFRELGEEQAMMLCGFENQKSSKEEVTGSRQQKNEIKVAFAAGSAETENTTISTTIFHDADSFAVEGSSKSANSTATYGRFKEMSEENASNMVYLQKSESSSSNLSGAETKMKHIQRQSSEARFSEFKQVAESCAVMIKNTGVERGSTSSTVAEAATEVIEETIIRVDEQLEKKTTVIETEQASEVKMREKGEERRKEEKRVSFAAEVQEKTMEAIDKSLGLDTSMEVEPAFQKPSIIKKPMKKERERRSRDLRQNAAPAFKPVRRNSLLQALAIGSPHNIPHFKTLDDIVKAIKHAGLEYSNLIFGIDYTKSNFYQGERTFDKRPLHTIDPAEMNPYQQVIQIVGKTLSSFDADGQIPAYGFGDEEFTDHGIFNIAERYDLEKDCNGFEEVLRVYNEVTPTIEMSGPTNFVPLIDRAIEICKEKHSYHILVIVADGQVTNEKINQKAIAAASHYPLSIIMVGVGDGPWNMMGRFDDNIPKRLFDNFHFVDFHKVMFNAPNADASFALNALMEIPDQYKAIKELGLLKHSRRG

SEQ ID NO: 18945 - protein, 516 aa, Caenorhabditis elegans
MNAVVASQNKNDRSFSNMESESSSNVEKSEKENHHQSLPDENWTPFLFFCISSIALASFQDGFQIGCINAPGPLIIDWIKKCHFELFGEVLSQYQADFIWSVAVSMFSVGGMFGSFCSGFLADKFGRKSTLLYNNILALLAAVCLSTSKLFNFYPMIVFGRFLVGLNCGITSGLVPMFLTELAPANLRGKCGSFHQLNISVAIVLSQALGLPQIFGTQVGWPYIFACVAIPTFLQLATIPFCVESPKYLISKLNDREEARRILEKLRGHTKVDEELEHMVQETMVTVEPLHQPGYVSLFKGDNQWPMIVSILMMFSQQFSGISAVTFYSTLIFKRNGLSGNEPMYATVGFGCIKLIATFGCLFLIDHPKFGRKRLHIAGLSGMCISSILIVITLTLSNAGYHWASYMNVLFILSFVVTFAFGPGPIPWFFTSELFDSATRGRAAAVSATSNWVANWMVGLTFLPINNIIHQYAFLMFTFFTFTFAIFTWKFVPETKGKSPSAIRKELAFMRKRICS

SEQ ID NO: 18946 - protein, 539 aa, Caenorhabditis elegans
MEMDVYDELLAAALFIVFSSIVLWVFRKLWAVRKRKNINDTSSKSGHYWSSINYSEQHNYCSGCKEHIVSGYECDNCLLKVDNINCLRAVSTKIQCKVNPIHCRKETFDHHWICGNIGADLFCEVCEELCGGVGLQDFRCSWCWRVVHTKCKPKFTKHCDFGGLKRTIIPPYCVTTRRPGNRNQRMAVIDKIEIPVDIEKWRPIMVIVNPKSGSGAGKQLLRNFRAHLHPAQVVDVLKSNIAASLRWIDEHPNVDVRILIAGGDGTICSALDQIDTLSRRIPVAVLPLGTGNDLSRLLKWGKKCDGDIDVIKLMEDIQEAEVTLVDRWTIDAESQKKLGVRLQSNKTLSMTNYVSVGVDACVTLGMQNTRESIPRAMSSRLLNKFLFFTFGTKDVFERVCKGLNERIDLYLDDVHVNLPDIEGLIFLNIPYWGAGVKPWATYNDSHRQECDDEMIEVFAVTSSFHIAQMQIGLASPLCIGQAKHAKLVFKGNHSFPMQSDGEAWVNSAGTVLISHKCKTAMLRKAEKQTTGFFYFLPPF

SEQ ID NO: 18947 - protein, 458 aa, Caenorhabditis elegans
MPMRKIVMLGANARTQRSVSSIQLPAEYSPSASSAPYFNYSPDDFILDLRSHQSDEIYENGNSNHEKDEKKALKELLHERWENAKQYNAFNYPLNCMYRCLDGKYDLSMQLNIERGELRRKPMHFKNIKEPFNHLRFNFAKLHDHEILFYLKCDTDPISNDLLDRHLVAVNASPLERDHSLIVPSVNKCSPQVLTLQAVRIAVDLMLLVDDDMFHILFNSLLGQASVNHLHLHAMYWPYDSDLINRKCEPLHDVPNVYVIRPPVWICPAIVFQLDSLDNYEQFKMNIYKCVEHLTESNQAHNLFLARAQPIRTTGAEKEEDRRGERPQLVTCYVFPRMNMIGAKPPSNFNPAANELAGNLTSYTIRFFESANEQSVIRIIEEEASLDDDTFRSLCFDLADVLIGRSVGTSRPQDLDTLAGLTSPEIDELRDSFQSFMPRSPSIRHRSSTRAQSDEGSK

SEQ ID NO: 18948 - protein, 363 aa, Caenorhabditis elegans
MKLHEENNKALFEAMRNRENPTKWESYKQVITAVSAYWVFSIGLVFLNKYLLSSVQLDAPLFITWYQCLVTVFLCLFLSKTSKAYGLFKFPSMPIDAKISREVLPLSVVFVAMISFNNLCLKYVGVSFYYVGRSLTTVFNVVCTYLILGQKTSGQAIGCCALIIFGFLLGVDQEGVTGTLSYTGVIFGVLASLSVALNAIYTRKVLSSVGDCLWRLTMYNNLNALVLFLPLMLFNGEFGAVFYFDKLFDTTFWILMTLGGVFGFMMGYVTGWQIQATSPLTHNISGTAKAAAQTVMAVVWYSELKTLLWWTSNFVVLFGSGMYTYVQKRVMDKKNSGASPASEAKSDKVKLLGRDGNAAEESV

SEQ ID NO: 18949 - protein, 2322 aa, Caenorhabditis elegans
MITSRNNDIGNLIEQFRQRDTPQKERKAILARIEEILQTTKNVESLCVKWTYLLDNLCWPSLTKHDRNDMKTLAGKVIRLVGVLLFDTESYPEFLIYLGTLYQSVTKKSEETRADIVFSVYFIVGVISQKTENRLIATDTENVEKSLDWIIKVLPNSSISVYNHCLKGFVLVANTFPNVYAAMFESTLRAILTNLPDFNSHEKNFELLIDTVMRFSDQLNEKPHLAEEMVRIIRPDIKKNGLGNMRELKKRMKLTMALVKMAKSQKMLEETNQMISEMSIELEENGGKWSSASLITIVCDVFNELLILGKDDVKLQKGVEESLCNVLKDLNLSNQSTMEKQAFFNSLAKIVKQLPAESQVKTRVHQIVFNTETGLFTPKNRDNRMFGHNMIYKDLINLVSVLLTPTSLNHLQATYTDLRKIMIDSMSRLKQSEDTPYSDNIRWNESILLLFFSSLQSISCAKSSLIVMMGIRPSIFEFFSSELPLTEYWLASNHPEVYHLFITIFVGHLKAHDFYIVQSDYIVRGDSIGQSIGQTKRDYARKQVVALQKIINNFGDKLWKKTRLMISSWLHSLIATACEHQIGSDSFSQREWVRLRNTVIHQSVLTWNNECVNQALTILSTATKWSELTSDIHRDIADKTKKAKWKEATTIWESGDCNTYIRQSMSTVYQMSQERQQKTITSTSFGAEEFIIITNFLLKQATPTTFKKGQNSWMDEVLETFTQGCRTLEKPDSYVPETFIEKWDWIINQTANFCIVNKMKTPLGKPMQTFAAFENEIKRLAKEVIVRKNSDKKLNKSSTEDPNQSPPLKYSVQWLRVHLLLKLIVVLEKLMNSAIHGGSSVFNLTEIPVSSRQFFTVNAASCEVWLNRVYYPALLVAYFNGYYGLVIRFGSNALSHFARQKDGDNDKKIVNGVCTASLMSLSMAVLGEPMEIVGLRRKVREEFGTDMGQSLMEALGEMANARYETALVALEAVLVTDAATNETLKMIIQLAMVDILNRIRLPQATDYYKVVLFGEESNDSTITEDFRSVELLTKFEKLNNTVNEKRQVVDWSARERFQFVESAFSQTMRRTELLDIQKDFSAMGALALSADSSCKLYSDISSTSLIIANLVNKMTGVSQWKNKLTDTEIFDRNEEGNDGDKLAICRKLMHWGRHTKSNRGQSCAAHSEIIRLSRKTSNCELAFFHINSAIRGEKLAAWQRLEVERQRLKLVKTQNLDVRIREMNEVFGSLAEVFTTSCQLKSDFQMVDGMIKEKMISEGYNEDIAKREEHMSRASIQLADFFQSLPELENVLAPNLFPTIIWSELQRRSDSLSAGYHGIVGSLFHLASEMCPSLAKAHLKMARWAYEIAKIKNFPAENLSFYKFGKDETENEELLKSLEATSLVNLEKLVRAAISDDLRANNILAPNSHFMHIWKMVRDHRTKFLSIAVTSYFQFIQNMSGDCDNLPYSKKEETTLATLRILELLVKHGDVLIDVINDGLNKTNVHIWKEILPQLFARLSHPSEHIRKTLVDLISKICTAAPHAVVFQVVSGAASSSTDGEELEEQQNDDRNRVRACCEKLETNMSQSYPNLVKDVRQFVAELERINLLNEEKWSVVMGTMEHEMEKRLSLIRTENAKTESALHLTASVKNDIIVKRTQLLTRQIFDVLDELYQQTVIEPPKSKNEEEFVTAFAEVLTNAFQESRISRTTSPEKSWIPFKNLIANFVHRNSKKGMQTFETEDISPYLASLSNSCVPMPGQESVEFDRVVSISRVARQVTILPTKTRPKKLGFVGSDGKQVAFLFKGREDLHLDERVMQFLRLCNVMLQPGKGKHRQSVAAYQAHHYAVIPLGPRSGLIKWVEGATPMFHIYRKWQMKEKALKQATKKNGETVPEIERPSNMYHNMIRLAFADHKIDSSITSDRSKWPAEILEEVFESLTAKTPTDLISRELWMRANDATTWWSVTKRYSRSLAVMSMVGSVLGLGDRHLDNLLVDLKWGHVVHIDYNICFDKGKNLRIPETVPFRLTRNMRHALGPSEMYGTFRESCVHVLSTLRSGHQVLTMLLDAFVFDPLVDWTSHEHTATSGVSLALQLAVYGSNWKTKAKERLTDAMELLNLRMSEVQTLWLANRDDLLHWMKQVTECLLIENSMLGANAIYAQQRVKAGTELREAVTRHHALAKELRPLIRVIGKEREEFADYLKFYKQALFDPLLKGHSALRNELDIDTCVYNFNIVMQNIDNVFGALVNLSFTPIETITSRTSQQEFKPPPGLENVWVVKQDQQENSQAREVVRRVERRLNGWLDGSAGPDRKLSPREEADILIAEATSTPNLSQMYEGWTAWV

SEQ ID NO: 18950 - protein, 480 aa, Caenorhabditis elegans
MPRARHFFPESAVLIVLGLFAGFTIYELWTVDLFLHPDLFFLYLLPPIVLEAGYFMPNKAFISNITTISLFAVAGTVMNIFLTSCFIFAFQNFYDFNITIVDTLLFSTVISAVDPVAVLSVFEEIHVNKLLYITVFGESLLNDAVTVVLYHSFHSMVRIGQAHLIYQDYTMSMMNFFLVSGGGILVGVVFAVVAALGVKWSSNVSVLQPIICITVPYMAYLCSEIVHVSGILGIVVCGLCMKSYVTGSMEERADITVKYTLKTLSSCCEAIIFVFLGFSIFSKDHKWDFGFAIVTVITCFAARFLVVFTLTWVANKWRMQKISLRDQTIMAFGGLRGAICFGLVLTIDGEVVPAKPIMISTTLIVIVFTVFIQGTMIKPLVSFLNVKIDNAYDKSLFQSCIEHSFEDTMCGVEAIIGAHGQYYWKNKVDKWNAQFLEPALTRQDMNRGRRLLKKLTDMTTDEQREALLQEESAMLEEHQV

SEQ ID NO: 18951 - protein, 1898 aa, Caenorhabditis elegans
MNWDTLKGVLKTRRLTKRTIPAYIHPTSRSDSTSSTQSATAGFILNEEPITLFRLELERLQYILHFPEEVAFQLSSTEYQLFYSIQPMDYVRYVSCDLTSVPVSENPSPVRNLVKRLSEVSSWITHVIVSQPTHDDRKVALTAILRIVETCWNIGNFNAAVEVLMGLKSEKLRPFWLSLRQEEKSQFDSLCETLLPANQALPSQAYINAVQRALRMPQSRVIPFFGIFLRDLYAIVNDLPNIVVIGQEGETQKLEFMSDPNGEDHFSSRIGVGGLLNADKINLVAIVLDNLELFHRHSRTMIKLLEEQAVPPIQIPQNEREQKEKEAKTYEPVQVVRGSSHGVALIPLDTLTFDLDVIQRLQHGTTVIHYEPDSGRSNLCLLRLDPSCGQINWHKISYSVNKDPKEKDVLAKVSVSNLQPLDSGRGAPSPMPSGRTPGTGGVGVEEGELKLSVVKGVELVDSYDIDIEAIYRRHSMEEMSVPVSCWKVSHGQLLSDNEFIYFLAPQQIAQFWTNGLQSVVKSLQGQQRYPDRRMLWIKNVYLSLYEITGESNCGPRPFEALQAFGLSQTNTNATRPNDSSLSSEPGGAKSRLKNLKNAMQKKLRGASREGSRSQSPQPHSPLVRPPSIKSQISSQSGPPGPNSPGYLLKPRGEPANSDAGDIDSIYTPRSRTPTSSSYGGRSVGGRSCKSWRSRGGETPNSGSISSSGQMSIQVSGLSGPSGKEFQEKPLTLVEFAELFRLFNTRMRKDLRDVFNDVLSTATTPQHCPKRERDRHSPRMQSRLASVSNSYNADFLSNDFLTRNTAVTSHHISEKQNKIYNALALASVNSMGGLMDTSRSSMLTPQMLRAFVNTHQMEQIDEQTAIKLIQDHEPDGICRQKNQMSFEGFTRFLCDPVNFAFVPETIEPDEEDLRYPLSHYYINSSHNTYLTGHQLKGPSSSEMYRQVLLTGCRCVELDCWDGDDGLPLIYHGHTLVSKIGFRQVVEIIKKSAFITSDLPVILSIENHCSLQQQAKMAQMFKTVLGDLLVSNFLFEADFSDSPRLPCPLQMKNKILIKNKKMIVDPPTPLPMIERGAVQRGETQLNLHRKQSKNSYESSTVDEVEDDDLDEFLDDEENEEDDQEEVQVRSEKEDSPKTSKRAEKSARNIKQQDSLCSDHSVEQAKPSTSKTTSKTNDRKTEDEVLYAQLAQNAIRNQQPRKNNTGVQIAPELSDIVIYMQATKFKGFPPVDGIQSPRIMEEGPASASLSFSSRARTPSNLLNTPAPPRRQRSSTQLSQELAAEFLGSVRANATATCYQVTSLNENAAKKLMKRHPAKCVSYTRDHLIRTYPSAKHYDSSNFNPINCWAHGMQMVALNFQTPDVIMAVNQAMFEQSGNCGYQLKPRCLWDESHLLYNKFLPLSKDIAGHSALLLNLTIISGQHVYPNTHYASLYVEIEVIGIHNDCVREKSKVVQRNSVNPIWNHTTQLRIACVDLAFLRIAVCDSGQNGRVVAHRVVPVKCIRPGFRHLPLRTPTNLPIDNAMIFLRTRFEQEEHIYLHDDDSNTYCNLEHTLAYRTDLTPNLSPTPILKKQIFVLRITGAFADETAITVHSESGSTVKTVMQQALLNAGKNADQVEEYVLIEESLPAPSGEDPIEQRVLPLNEPIMDAVACWNGSMRRFVLRKKGSDPSSRAWITSIIKSGTSGSSTSVSPSPLTKDGHVKSASSNQLHGRSLDTDAFGEHLEVTEGKWLNPRARSMGDTFLVCVHNVSEDQPYAILRAGIHSTAADIIRQVFVKARRSNVDDSEFVLVEETCDDPKLNQGQSMLQALSLARKRSNDLTPKYPNNRTTSRVLGQNENVWKAQSRWKSMGRFVLENRKDTVHATLEKEFHEMAKIIREGIPKKDETYYMIYYSGLPGEDI

SEQ ID NO: 18952 - protein, 462 aa, Caenorhabditis elegans
MSNDQLKSKLREFFDRQPDQSEKAHQDSKIFEVLYSQFLENQHCIDWNSWKFLEEKHQVTLKDLEPFDKSRFNILNKLAVIKLNGGLGTTMGCSKAKSLVEVREGYTFMDLAVLEHQKMCEAHNVDTPLYLMNSFYTDEDTKKYLAEKGYSNVKTFVQSKCPRLDAETKLPIEDENEDWGDDAWCPPGHGNIFQSLQNSGVLDQLLADGREIIFVSNIDNTGANTDLQIVQLMLDKNVDYIMECTPKTQVDVKGGTLIDIGGRMMHLEMPQVPAENLPDFCSTKVFKIFNTNNIYVNLKAVKKLLPDIKSEIIVNKKTIRSREVLQLEFSIGGCIKNFDNALCVHVERKRFRPVKNLGDLLSLRSTLCDLDHSTFKVHHNHELGAPPVISLDPSIYNSVEVVDLKFPHPLVMDNCSEFAVVGDVTFGKNVKLSGKVTVNGKTESPGVVPDGTVLKDQEYIAE

SEQ ID NO: 18953 - protein, 1209 aa, Caenorhabditis elegans
MSDYSAKPSGSLARIGDYDLSSDDSDQNDEDETLIASKTIQTGAVQVNDIAVAEASPAETDAKSSASPVSGPEPPTSAVVENRDLDEFKKESGSNDDKQEEINEDKDSNEETVFQQTESGSADVVDKTDVKQKDSDSSADDDHSHSKSGSVHSPQKPQGSTTPCSVQSPASPVGDEQAVKMEEVEEPIVASEEVPDKKPESVKESTDSESSGSEHGFEKMDTAEKVEDECNDDEVAASNGTEEPEPGDKAADTVNPWETPRQEPVDGVVQPRTEPPAGKPTRHTNCLDFVLFTVVKDALKHKHSWPFQLPVDAIKLEIPEYHNIVNTPMDLRTIEKRLRNLYYWCAEDAIKDINQVFINCYSFNPPEYDVYKMAKTLEKQVLSQLTQLPRSEKPADLADHHRRGMFSASTPSGKTKGPKQRGRKSTRGRKKTSLPRGASTFKDESVDDNNDDESSKVDSINFDDDDDTATEKDAESRAESVQPEVVNEEPKPSTSQPPSKKRKAENGEPAVAVKIATPATPVAAHPQEETPRRKNPNTLIEWKHLVPRWQGKIPEWQKFCSKLLNEIHSVKNKGFAQVFYLPVDPIKLKIYDYLEVITNPMDLQTIKKKLDFKQYAEPEEFVHDINLMVDNCCKYNPKGSPAHSNALELRSFFEQRWKLFPRPGVDPIIADSYINQNLVVNTDLIEDERINSYLSAVKAEEKKCAEKLEQLRSMSEGLYTIAMQRREAKLAGNTAPALAQNQLSQLEGLGISIKSTPMMIPELISPALSVRSSSRAPVPKIIDDIGPSPIKARKISKPRASMASNVSVPYTPTGNPRGRKPKKSGRPKKNIYSPATVSERISQQPPFEVTPYVSIYGRKVVGTNDKIELSERMASIPQMYITPILRIIQIGHHNTGKTITSLRSLCEEEIDFNDVSDDLVIELLDYLEMIQKDKAKAEQVRQELEVKAKFYGFEAYDNKLGTIPKTRNMPPPLQHRMRSDSPSPSASRTGNQSSDSDSASDDSSDDEPSRSNSNVAGPRRALELSGNSSSASTPAGPSKAQPAVVRPSSKSVASKPAYTKRTLSESSSSSDSNGSSSDSSDSDSEPKPQAKKPEPPQKKVAKKPAPQQKKKAPLSILDELLPDTPEKKPVMASVPTTSGSARQLPPDSYQKPSQISEAELKAQKEQEHNAALQRREEARRLRALEDQQQVLNQHEVMHEFESQYGDFSY

SEQ ID NO: 18954 - protein, 1431 aa, Caenorhabditis elegans
MAKEFQFNWKPTIIPELLHGSVFDRYDDESTCLELNAQVRIDENGFFLRWLIEGKDAVVLDMGQIWEARTGGLPKDGRIMFELEQRGASETIAERTIWITHGQDLVNVQSFFLVAESVELAKTCRAGINDILKSSRIRHVCPTTQLMKYHTWLTMNVNERRKIPIKLIIKTFSSGKPEKMVQKCLNDLGLGGDKYTPARVINRSMGKKFRNFYKCSRGRKRKEREELDVDILTFEKFQRLYNKICPRTEVQELFVKLSGQKEYLTKERLINFLNEEQRDPRLNEILFPFFDSQRIVALLKKHENDIKYQEDGKMSGDGFLRFLMSDENPPVFLDRIEMFMDMDQPLCHYYINSSHNTYLTGRQYGGKSSSEIYRQVLLSGCRCIELDCWDGTGENKGEPIITHGKAMCTDVFFKDVLVQIRDTAFARSDFPVVLSFENHCSKSNQLKMAKYCMDIFGDMLLSKPFEDAPLDPGVSLPSPNRLRKKILIKNKRLKTDIERHQLDQFLREGKLDEEDELNETPEVVGEDSVSPRSGGSGGTGAPEEVDDDTSDDDDDPSVQTSLNVMRTIPTVNTTSNNGSNRSARSSLDTPSPSGGSLMVPDRATSTATSIKNAVLARSPNFSSLRQKLSFKRRQSPLAGDQRAHPEVEQPVSSSSPATPSISGPPPCATSSGSTSSITITTTGCSTSSSGPSKHILGGEMPAKENDEAHPELKQNFIAKNLKGFGFSKKQPVLTKEEEERIFAEYHYTGATTNIHPLLSSLVNYTHPVKFSGFDVAEANNLHFHMSSFSESTGLGYLKQSAPEFVNYNKRQSSRIYPKGARVDSSNFLPQIFWNAGCQMVSLNFQTPDVYMQLNMGKFEYNGGSGYLLKPDFLRRPDRTFDPFSESPVDGVIAAHCSVRVISGQFLSDRKIGTYVEVEMYGLPTDTIRKEHKTKVIPGNGLNPVYNEDPFVFRKVVLPELAVLRFAVYDENGKQLGQRILPLDGLQAGYRHISLRSDTNQSFILSPVLFVQIVIKTYVPDELSGLVDALADPRAFLSEQKKRQEALAHMGVDDSDIPDVPNTRNMALRHVKQPPRQNGSSADLLANNGQTGSARGDQTSSMASSTIRSPNEQPQPVAVDKFKVDPIEVDDLRRDKAFAKLLKRFQKELDDLRKKHQKQRDSIQKQQPARRRNSSIAWIQTNVDKLITNNRRSTKKEKGSRRSLTASVSSGCGSASGTVTVSVCSPSGASCSGYSTGGPSTPVACNSDGTGSPATIGSPVPQDLVNNDRVRSLVNTQTGEWSAMVRRHDEEEFELKKVQLKEQFDLLRKLMSEAQKNQMLALKLRLEAEGKDLKQTQTKKSMEDAKVIQLDKGIKTKAERDRRVKELNEKNLKMFVEERKRLAMKAQKHEEQLTKRHLDQLEQLDKDFHKALDAEVGNYKEEQLAAQPTSVV

SEQ ID NO: 18955 - protein, 624 aa, Caenorhabditis elegans
MFSHQDRDRDRKEDGGGDGTEMKSKSRSQPSGLNRVKNLSRKLSAKSRKERKDRDSTDNSSKMSSPGGETSTKQQQELKAQIKIGHYILKETLGVGTFGKVKVGIHETTQYKVAVKILNRQKIKSLDVVGKIRREIQNLSLFRHPHIIRLYQVISTPSDIFMIMEHVSGGELFDYIVKHGRLKTAEARRFFQQIISGVDYCHRHMVVHRDLKPENLLLDEQNNVKIADFGLSNIMTDGDFLRTSCGSPNYAAPEVISGKLYAGPEVDVWSCGVILYALLCGTLPFDDEHVPSLFRKIKSGVFPTPDFLERPIVNLLHHMLCVDPMKRATIKDVIAHEWFQKDLPNYLFPPINESEASIVDIEAVREVTERYHVAEEEVTSALLGDDPHHHLSIAYNLIVDNKRIADETAKLSIEEFYQVTPNKGPGPVHRHPERIAASVSSKITPTLDNTEASGANRNKRAKWHLGIRSQSRPEDIMFEVFRAMKQLDMEWKVLNPYHVIVRRKPDAPAADPPKMSLQLYQVDQRSYLLDFKSLADEESGSASASSSRHASMSMPQKPAGIRGTRTSSMPQAMSMEASIEKMEVHDFSDMSCDVTPPPSPGGAKLSQTMQFFEICAALIGTLAR

SEQ ID NO: 18956 - protein, 626 aa, Caenorhabditis elegans
MFSHQDRDRDRKEDGGGDGTEMKSKSRSQPSGLNRVKNLSRKLSAKSRKERKDRDSTDNSSKMSSPGGETSTKQQQELKAQIKIGHYILKETLGVGTFGKVKVGIHETTQYKVAVKILNRQKIKSLDVVGKIRREIQNLSLFRHPHIIRLYQVISTPSDIFMIMEHVSGGELFDYIVKHGRLKTAEARRFFQQIISGVDYCHRHMVVHRDLKPENLLLDEQNNVKIADFGLSNIMTDGDFLRTSCGSPNYAAPEVISGKLYAGPEVDVWSCGVILYALLCGTLPFDDEHVPSLFRKIKSGVFPTPDFLERPIVNLLHHMLCVDPMKRATIKDVIAHEWFQKDLPNYLFPPINESEASIVDIEAVREVTEFQRYHVAEEEVTSALLGDDPHHHLSIAYNLIVDNKRIADETAKLSIEEFYQVTPNKGPGPVHRHPERIAASVSSKITPTLDNTEASGANRNKRAKWHLGIRSQSRPEDIMFEVFRAMKQLDMEWKVLNPYHVIVRRKPDAPAADPPKMSLQLYQVDQRSYLLDFKSLADEESGSASASSSRHASMSMPQKPAGIRGTRTSSMPQAMSMEASIEKMEVHDFSDMSCDVTPPPSPGGAKLSQTMQFFEICAALIGTLAR

SEQ ID NO: 18957 - protein, 462 aa, Caenorhabditis elegans
MRDMIYGEMALVSHTHPAAVGSTTCYEKNQQKQQQVQQIPTQPQVAHVSSNAILAAAQPFYPPPVQDSQPDRPIGYGAFGVVWSVTDPRSGKRVALKKMPNVFQNLASCKRVFREIKMLSSFRHDNVLSLLDILQPANPSFFQELYVLTELMQSDLHKIIVSPQALTPDHVKVFVYQILRGLKYLHTANILHRDIKPGNLLVNSNCILKICDFGLARTWDQRDRLNMTHEVVTQYYRAPELLMGARRYTGAVDIWSVGCIFAELLQRKILFQAAGPIEQLQMIIDLLGTPSQEAMKYACEGAKNHVLRAGLRAPDTQRLYKIASPDDKNHEAVDLLQKLLHFDPDKRISVEEALQHRYLEEGRLRFHSCMCSCCYTKPNMPSRLFAQDLDPRHESPFDPKWEKDMSRLSMFELREKMYQFVMDRPALYGVALCINPQSAAYKNFASSSVAQASELPPSPQAW

SEQ ID NO: 18958 - protein, 450 aa, Caenorhabditis elegans
MTEPEPVVMRLSLPASGAGRRGRGGVEEDEEEEEDEDEEEENEDEDEDEDDDNDDDEDDDEEEEDEDEEEDEAEDEAEDDEENEEVKEEKEDEEVVEERVKVEEPRPRAVAERDDASEGDASLGSLRAPSDDQGEQSPWSSDVAEEGRRSPTWSDRSWYTDLGSWNAMMAGSSVSSRSSSSISSLSTFRSPVSSTSGYVSGVSGGAFNPDDDEGVMGDDDEEEEEEEEEEEEEEEDVADVVDAEAIDDAVPEAEKEEAAAGPSASNPLKRSGTDLGTDAPSSKRPTSSSLPTSDRRFALVNVAMQHSKDPLHQELKKHLEELGIDDLESAEYHSMPFKNQLPHFLVIFVVGSDASASLINEMIKEDEWMAKFKECGTQQFLWRELDAEELVRTFLLAMALSQYVPMGAALGNVAVVLAALNDQELMKRVKDKLSGKGHKMIWRIRNHLGV

SEQ ID NO: 18959 - protein, 773 aa, Caenorhabditis elegans
MSNSEPSTSTPSGKTKKRGKKCETSMGKSKKSKNLPRFVKIQPIFSSEKIKETVCEQGIEECKRMLKGHFNAIKDDYDIRVKDELDTDIKDWLKDASSSVNEYRRRLQENLGEGRTIAKFSFKNCEKYEENDYKVSDSTVTWIKPDRTEEGDLMKKFRAPCSRIEVGDISPPMIYWVPIEQSVATPDQLRLTHMPYFGDGIDDGNIYEHLIDMFPDGIHGFSDNWSYVNDWILYKLCRAALKDYQGSPDVFYYTLYRLWPNKSSQREFSSAFPVLCENFAEKGFDPSSLEPWKKTKIAEGAQNLRNPTCYACLAYTCAIHGFKAEIPIEFPNGEFYNAMLPLPNNPENDGKMCSGNCWKSVTMKEVSEVLVPDSEEILQKEVKIYFMKSRIAKMPIEDGALIVNIYVFNTYIPFCEFVKKYVDEDDEESKIRSCRDAYHLMMSMAENVSARRLKMGQPSNRLSIKDRVNNFRRNQLSQEKAKVQLRHDSLRIQALRDGLDAEKLIREDDMRDSQRNSEKVRMTAVTPITACRHAGPCNATAENCACRENGVCSYMCKCDINCSQRFPGCNCAAGQCYTKACQCYRANWECNPMTCNMCKCDAIDSNIIKCRNFGMTRMIQKRTYCGPSKIAGNGLFLLEPAEKDEFITEYTGERISDDEAERRGAIYDRYQCSYIFNIETGGAIDSYKIGNLARFANHDSKNPTCYARTMVVAGEHRIGFYAKRRLEISEELTFDYSYSGEHQIAFRMVQTKERSEKPSRPKSQKLSKPMTSE

SEQ ID NO: 18960 - protein, 385 aa, Caenorhabditis elegans
MMLRSQAKNVDLTSQADSRHQQKRKQAEQLDALKNPSEPAAKKQHSKGLTELRAHISGFKIDSAKRDPLGKSRTSRRDVENLPPQKSRYVDPCPHYDYDLEEAGNPDSISDYAQGIFDYYRHREVHFRVRKYLHKHPEVDVKTRAILIDWMVEIQETFELNHETLYNAVKLTDMYLCKTKNVDKNTIQKLACVAIFIAAKYDERSPPLVDDLIYLSGDRFSRDELLAMERELFATVGYDLGSPLSYRYLRRFGRVCRVDMKTLTMGRFILETSLMVYEYAMVSQSRLAAAAFVLAMRMLDKNNEYEWNPVLEKYSGFTGEEVMPLVEHMNHILHFSKDKWAQLTSVRQKYSHEVFFHVASIPMLPDTLKVVDSHTYAPVPMLSYP

SEQ ID NO: 18961 - protein, 458 aa, Arthrobacter nicotinovorans
MAIATIDPTTGITLKTFDAHTPEEVENRIARAEAAFRSLQNTSFEERARWMHKAADILESEADEVARLIATEMGKTLTTAKYEALKSATGMRHFADHAQRYLSPETPVPASEVNASNLHVQFDPLGVVLAVMPWNYPLWQAVRFAAPALMAGNTGLLKHASNVPQCALYLGDLFARGGFPEGAFQTLLVEGKDVIPLVDDARIRAVTLTGSVAAGSAIAEAAGRNIKRSVLELGGMDVFIVMPSADIEKAAAQAVIARLQNSGQSCIAAKRFYVHEDVYDRFEHLFVTGMAEAVAGDPLDESTSFGPLATERGRQDVHELVRDAREKGAAVQCGGEIPEGEGWYYPATVLTGVTEDMRIYREECFGPVACLYKVSSLQEAIALSNDSDFGLSSSVWTNDETEATEAARSIEAGGVFINGLTASFPAVPFGGLKDSGYGRELSAYGIREFVNIKTVWTS

SEQ ID NO: 18962 - protein, 450 aa, Arthrobacter nicotinovorans
MLATLASATSEDAVAALEAACAAQTSWARTAPRVRAEILRRAFDLVTARSEDFALLMTLEMGKPLAEARGEVAYGAEFLRWFSEETVRDYGRYLTTPEGKNKILVQHKPVGPCLLITPWNFPLAMATRKVAPAVAAGCTMVLKPAKLTPLTSQLFAQTMMEAGLPAGVLNVVSSSSASGISGPLLKDSRLRKVSFTGSTPVGKRLMSDASRHVLRTSMELGGNAPFVVFEDADLDKAVEGAMAAKMRNMGEACTAANRFLVQESVAQEFTRKFAAAMGALSTGRGTDPASQVGPLINNGARDDIHALVTAAVDAGAVAVTGGAPVDGPGYFYQPTVLADVPNNAAILGQEIFGPVAPVTTFTTEQDAIKLANASEYGLAAYLYSRDFNRLLRVAEQIEFGMVGFNAGIISNAAAPFGGVKQSGLGREGGSEGIAEYTTTQYIGIADPYEN

SEQ ID NO: 18963 - protein, 608 aa, Homo sapiens
MEMRWFLSKIQDDFRGGKINLEKTQRLLEKLDIRCSYIHVKQIFKDNDRLKQGRITIEEFRAIYRIITHREEIIEIFNTYSENRKILLASNLAQFLTQEQYAAEMSKAIAFEIIQKYEPIEEVRKAHQMSLEGFTRYMDSRECLLFKNECRKVYQDMTHPLNDYFISSSHNTYLVSDQLLGPSDLWGYVSALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 18964 - protein, 680 aa, Helicobacter pylori
MKKKANEEKAPKRAKQEAKAEATQEIKQENKTKESNKAKESKIKENKTKESKIKEAKAKEPIPVKKLSFNEALEELFANSLSDCVSYESIIQISAKVPALAQVKKIKELCQKYQKKLVSSSEYAKKLNAIDKIKNTEEKQKVLDEELEDGYDFLKEKDFLEWSRSDSPVRMYLREMGDIKLLSKDEEIELSKQIRLGEDIILDAICSVPYLIDFIYAYKDALINRERRVKELFRSFDDDDENSVSDSKKDDDSEEDEENEERKKVVSEKDKKRVEKVQESFKALDKAKKEWLKALEAPIDEKEDELVRSLTLAYKRQILKDRLYDLEPTSKLINELVKTMETTLKSGDGFEKELKRLEYKLPLFNDVLIANHKKILANITNMTKEDIIAQVPEATMVSVYMDLKKLFLTKEASEEGFDLAPNKLKEILEQIKRGKLISDRAKNKMAKSNLRLVVSIAKRFTSRGLPFLDLIQEGNIGLMKAVDKFEHEKGFKFSTYATWWIKQAISRAIADQARTIRIPIHMIDTINRINKVMRKHIQETGKEPDLEVVAEEVGLSLDKVKNVIKVTKEPISLETPVGNDDDGKFGDFVEDKNIVSSIDHIMREDLKAQIESVLDQLNEREKAVIRMRFGLLDDESERTLEEIGKELNVTRERVRQIESSAIKKLRSPQYGRILRNYLRI

SEQ ID NO: 18965 - protein, 423 aa, Rattus norvegicus
MALRVTRNTKINTENKAKVSMAGAKRVPVAVAASKPLLRSRTALGDIGNKVSEQSRIPLKKETKKLGSGTVTVKALPKPVDKVPVCEPEVELDEPEPEPVMEVKHSPEPILVDTPSPSPMETSGCAPAEEYLCQAFSDVILAVSDVDADDGGDPNLCSEYVKDIYAYLRQLEEEQSVRPKYLLGREVTGNMRAILIDWLIQVQMKFRLLQETMYMTVSIIDRFMQDSCVPKKMLQLVGVTAMFIASKYEEMYPPEIGDFAFVTNNTYTKHQIRQMEMKILRVLNFSLGRPLPLHFLRRASKIGEVDVEQHTLAKYLMELSMLDYDMVHFAPSQIAAGAFCLALKILDNGEWTPTLQHYLSHTEESLLPVMQHLAKNIVMVNRGLTKHMTIKNKYATSKHAKISTLAQLNCTLVQNLSKAVTKA

SEQ ID NO: 18966 - protein, 376 aa, Danio rerio
MDTTGKVIKCKAAVAWEAGKPLTIEEVEVAPPKAHEVRVKIHATGVCHTDAYTLSGSDPEGLFPVILGHEGAGTVESVGEGVTKFKPGDTVIPLYVPQCGECKFCKNPKTNLCQKIRVTQGQGLMPDNTSRFTCKGKQLFHFMGTSTFSEYTVVAEISLAKVDEHAPLDKVCLLGCGISTGYGAAINTAKVEAGSTCAVFGLGAVGLAVVMGCKSAGATRIIGIDVNPDKFEIAKKFGATEFVNPKDHSKPIQEVLVELTDGGVDYSFECIGNVGIMRAAIEACHKGWGTSVIIGVAGAGQEISTRPFQLVTGRTWKGTAFGGWKSVESVPKLVNDYMNKKLMVDEFVTHTLPFAQINEAFDLMHAGKSIRAVLQF

SEQ ID NO: 18967 - protein, 387 aa, Arabidopsis thaliana
METQGKVITCKAAVAWGAGEPLVMEDVKVDPPQRLEVRIRILFTSICHTDLSAWKGENEAQRAYPRILGHEAAGIVESVGEGVEEMMAGDHVLPIFTGECGDCRVCKRDGANLCERFRVDPMKKVMVTDGKTRFFTSKDNKPIYHFLNTSTFSEYTVIDSACVLKVDPLFPLEKISLLSCGVSTDKCLWNEGVGAAWNVADIQPASTVAIFGLGAVGLAVAEGARARGASKIIGIDINPDKFQLGREAGISEFINPKESDKAVHERVMEITEGGVEYSFECAGSIEALREAFLSTNSGVGVTVMLGVHASPQLLPIHPMELFQGRSITASVFGGFKPKTQLPFFITQCLQGLLNLDLFISHQLPFHDINEAMQLLHQGKALRCLLHL

SEQ ID NO: 18968 - protein, 268 aa, Arabidopsis thaliana
MAKRGESLRDKPKWSLEGMTALVTGGSKGLGKAVVEELAMLGARVHTCARDETQLQESLREWQAKGLQVTTSVCDVSSRDQREKLMETVSSLFQGKLSILVPNVGIGVLKPTTECTAEEFSFIIATNLESTFHFSQLAHPLLKASGSGNIVLMSSVAGVVNLGNTSIYGATKGAMNQLARNLACEWASDNIRANSVCPWFITTPSTKDFLGDKDVKEKVESVTPLRRVGEANEVSSLVAFLCLPAASYITGQTICVDGGFTINGFSLP

SEQ ID NO: 18969 - protein, 336 aa, Orconectes limosus
MHRAAGAMTKIPTILLNSGSHIPVMGLGTGSLGRNGKMSEEAVTAVLETALECGYRHFDSAAYYGNEAIIGQVLRRWISEGKVKREELFITTKLPTRGNREKDVARFLQKSLDNLRLPYVDLYLVHYPCGILDTDRERLSADEVTVDPTTDIHAIWRAMEAQLAAGKTKNIGLSNFNADQVQRIIKGCQVRPAVLQVEVHVYMQQGALRAFCAQHDIVVCAFCPLGGPFRLIRKASRPGEVKLLLEDPQVLDVATAHHKTPAQVLLRYLHQINVIPIPKSANPTRLFQNTQIFDFELTSAEMSRLAGLDRGHEGRIFTEFRRGDHTHPEFPFHPPH

SEQ ID NO: 18970 - protein, 350 aa, Arabidopsis thaliana
MAEEIRFFELNTGAKIPSVGLGTWQADPGLVGNAVDAAVKIGYRHIDCAQIYGNEKEIGLVLKKLFDGGVVKREEMFITSKLWCTYHDPQEVPEALNRTLQDLQLDYVDLYLIHWPVSLKKGSTGFKPENILPTDIPSTWKAMESLFDSGKARAIGVSNFSSKKLADLLVVARVPPAVNQVECHPSWQQNVLRDFCKSKGVHLSGYSPLGSPGTTWLTSDVLKNPILGGVAEKLGKTPAQVALRWGLQMGQSVLPKSTHEDRIKQNFDVFNWSIPEDMLSKFSEIGQASDFPHIVVHIGQRAFFVLLTHLGYRILKTCVSMLQGRLVRGMSFVHETSPYKSLEELWDGEI

SEQ ID NO: 18971 - protein, 544 aa, Caenorhabditis elegans
MFYEETSCCELTISNLIHLMLRSALRATVQARNASGVPPGLSNMKPQYTGIFINNEFVPAKSGKTFETINPANGKVLAQVAEGDKTDVNIAVKAAQNAFRIGSEWRRMDASQRGVLLNRLADLMERDRVILASLESLDNGKPYAVAYNADLPLSIKTLRKLTAKKCNFLNQILFLLRRMADKNHGKTIPIEGDYFTYTRHEPVGVCGQIIPWNFPLLMQAWKLGPALAMGNTVVMKVAEQTPLSALHVAALTKEAGFPDGVVNIIPGYGHTAGQAISSHMDVDKVAFTGSTEVGRLVMKAAAESNVKKVTLELGGKSPNIIFADADLNDSVHQANHGLFFNQGQCCCAGSRTFVEGKIYDDFVARSKELAEKAVIGDPFDLKTTQGPQVDGKQVETILKYIAAGKKDGAQLVTGGAKHGDQGHFVKPTIFANVKDQMTIAQEEIFGPVMTIIRFDTMEELVEKANNTIYGLAAGVMTKDIDKALHIANATRAGSVWVNCYDVFDAAAPFGGFKQSGIGRELGEYGLEAYTEVKTVTIKVPQKNS

SEQ ID NO: 18972 - protein, 576 aa, Arabidopsis thaliana
MSIYIYERFEIFKITHFFVRGTLTYQSNYVEWKKVTRLCHTKQLLTVNGQYPGPTVAVHEGDIVEIKVTNRIAHNTTIHWHGLRQYRTGWADGPAYITQCPIRSKQSYTYRFKVEDQRGTLLWHAHHSWQRASVYGAFIIYPRQPYPFSGSHIQSEIPIILGEWWNDDVDNVEKAMMKTGAGAKVSDAYTLNGLPGPLYPCSTKDTFTATVDAGKTYILRIINAALNNELFVAVANHTLTVVEVDAVYTKPVHTKAIMIAPGQTTTLLLRADQLSGGEFLIAATPYVTSVFPFNNSTTVGFIRYTGKTKPENSVNTRRRRRLTAMSTVVALPNMLDTKFATKFSDSIKSLGSAKYPCKVPTKIDKRVITTISLNLQDCPLNQTCDGYAGKRFFASMNNISFVRPPISILESYYKKQSKGVFSLDFPEKPPNRFDFTGVDPVSENMNTEFGTKLFEVEFGSRLEIVFQGTSFLNIENHPLHVHGHNFFVVGRGFGNFDPEKDPKRYNLVDPPERNTFAVPTGGWAAIRINADNPGVWFIHCHLEQHTSWGLAMGFIVKDGPLPSQTLLPPPHDLPQC

SEQ ID NO: 18973 - protein, 315 aa, Arabidopsis thaliana
MNGDELPFESGFEVYAKGTHKSEFDSNLLDPRSDPIWDAIREEAKLEKEPILSSFLYAGILAHDCLEQALGFVLANRLQNPTLLATQLLDIFYGVMMHDKGIQSSIRHDLQAFKDRDPACLSYSSAILHLKGYHALQAYRVAHKLWNEGRKLLALALQSRISEVFGIDIHPAARIGEGILLDHGTGVVIGETAVIGNGVSILHGVTLGGTGKETGDRHPKIGEGALLGACVTILGNISIGAGAMVAAGSLVLKDVPSHSVVAGNPAKLIRVMEEQDPSLAMKHGEFADSYILLALCICLARDLVVTVLERICRCY

SEQ ID NO: 18974 - protein, 1064 aa, Arabidopsis thaliana
MAGNEWINGYLEAILDSQAQGIEETQQKPQASVNLREGDGQYFNPTKYFVEEVVTGVDETDLHRTWLKVVATRNSRERNSRLENMCWRIWHLTRKKKQLEWEDSQRIANRRLEREQGRRDATEDLSEDLSEGEKGDGLGEIVQPETPRRQLQRNLSNLEIWSDDKKENRLYVVLISLHGLVRGENMELGSDSDTGGQVKYVVELARALARMPGVYRVDLFTRQICSSEVDWSYAEPTEMLTTAEDCDGDETGESSGAYIIRIPFGPRDKYLNKEILWPFVQEFVDGALAHILNMSKVLGEQIGKGKPVWPYVIHGHYADAGDSAALLSGALNVPMVLTGHSLGRNKLEQLLKQGRQSKEDINSTYKIKRRIEAEELSLDAAELVITSTRQEIDEQWGLYDGFDVKLEKVLRARARRGVNCHGRFMPRMAVIPPGMDFTNVEVQEDTPEGDGDLASLVGGTEGSSPKAVPTIWSEVMRFFTNPHKPMILALSRPDPKKNITTLLKAFGECRPLRELANLVTTLIMGNRDDIDELSSGNASVLTTVLKLIDKYDLYGSVAYPKHHKQSDVPDIYRLAANTKGVFINPALVEPFGLTLIEAAAHGLPMVATKNGGPVDIHRALHNGLLVDPHDQEAIANALLKLVSEKNLWHECRINGWKNIHLFSWPEHCRTYLTRIAACRMRHPQWQTDADEVAAQDDEFSLNDSLKDVQDMSLRLSMDGDKPSLNGSLEPNSADPVKQIMSRMRTPEIKSKPELQGKKQSDNLGSKYPVLRRRERLVVLAVDCYDNEGAPDEKAMVPMIQNIIKAVRSDPQMAKNSGFAISTSMPLDELTRFLKSAKIQVSEFDTLICSSGSEVYYPGGEEGKLLPDPDYSSHIDYRWGMEGLKNTVWKLMNTTAVGGEARNKGSPSLIQEDQASSNSHCVAYMIKDRSKVMRVDDLRQKLRLRGLRCHPMYCRNSTRMQIVPLLASRSQALRYLFVRWRLNVANMYVVVGDRGDTDYEELISGTHKTVIVKGLVTLGSDALLRSTDLRDDIVPSESPFIGFLKVDSPVKEITDIFKQLSKATA

SEQ ID NO: 18975 - protein, 356 aa, Magnaporthe grisea
MSRANPPSNSSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQENNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPDDEPTAPPIPEEFFDFDKHKDNLSKEQLKQFIYQEIMR

SEQ ID NO: 18976 - protein, 361 aa, Emericella nidulans
MVQQMPPQGGSRKISFNVSDQYEIQDVIGEGAYGVVCSAIHKPSGQKVAIKKITPFDHSMFCLRTLREMKLLRYFNHENIISILDIQRPRNYESFNEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKALFPKSNDLALDLLEKLLAFNPTKRITVEEALRHPYLEPYHDPDDEPTAPPIPEGFFDFDKNKDALSKEQLKSKYLAPIDSISYATIN

SEQ ID NO: 18977 - protein, 310 aa, Caenorhabditis elegans
LDKSWVSPRKLLYPLFNLSKPCVTINEFKLEKFEIFRLRHNNIVQLFDTYDEKQFVYLVMELVTGGELFDRIVAKGSYTEQDASNLIRQVLEAVGFMHDNGVVHRDLKPENLLYYNQDEDSKIMISDFGLSKTEDSGVMATACGTPGYVAPEVLQQKPYGKAVDVWSIGVIAYILLCGYPPFYDESDANLFAQIIKGEYEFDAPYWDQISDSAKDFITHLMCCDPEARFTCQDALSHPWISGNTAYTHDIHGTVAVHLKKSLAKRNWKKAYNAAAAIRQLQMLRLSSNSNRLQKQASQQQPEPPTPAFHA

SEQ ID NO: 18978 - protein, 569 aa, Arabidopsis thaliana
MDSARSWFHKFQPRDKPRKKDMFSGSTYGGGVTETTVPDGGNDTETATKLPPLGGDGEALSNSTKQKVAAAKQYIENHYKEQMKNLNERKERRTTLEKKLADADVCEEDQTNLMKFLEKKETEYMRLQRHKMGADDFELLTMIGKGAFGEVRVVREINTGHVFAMKKLKKSEMLRRGQVEHVRAERNLLAEVDSNCIVKLYCSFQDNEYLYLIMEYLPGGDMMTLLMRKDTLSEDEAKFYIAESVLAIESIHNRNYIHRDIKPDNLLLDRYGHLRLSDFGLCKPLDCSVIDGEDFTVGNAGSGGGSESVSTTPKRSQQEQLEHWQKNRRMLAYSTVGTPDYIAPEVLLKKGYGMECDWWSLGAIMYEMLVGYPPFYADDPMSTCRKIVNWKTHLKFPEESRLSRGARDLIGKLLCSVNQRLGSTGASQIKAHPWFEGVQWEKIYQMEAAFIPEVNDDLDTQNFEKFDEEDNQTQAPSRTGPWRKMLSSKDINFVGYTYKNFEIVNDYQVPGIAELKKKESKSKRPSVKSLFGTESDSSSSGSEQQTINRSYSNPTPRGMEPNLRRLDSE

SEQ ID NO: 18979 - protein, 522 aa, Arabidopsis thaliana
MATEPTRSWFQIRQQKPDKSSPTKKGQEGNVKNLGRPPMNDAPSNATKQKVAAAKQYIENHYKIQKKSLQERKERRSILEQNLADADVTVEDKMDILKNFEKKEMEYMRLQRQKMGVDDFELLSIIGRGAFGEVRICKEKSTGSVYAMKKLKKSEMLRRGQVEHVKAERNVLAEVDSPFIVKLCYSFQDDEHLYLIMEYLPGGDMMTLLMRKDTLREDETRFYVAQTILAIESIHKHNYVHRDIKPDNLLITRNGHIKLSDFGLSKSLESKNFPDFKAELVDRSTKPAAEHDRLSKPPSAPRRTQQEQLLHWQQNRRTLAFSTVGTPDYIAPEVLLKKGYGMECDWWSLGAIMFEMLVGFPPFYSEEPLATCRKIVNWKTCLKFPDEAKLSIEVKDLIRRLLCNVEQRLGTKGVHEIKAHPWFRGVEWERLYESNAPYIPQVKHELDTQNFEKFDEVPSTCQTSSKSSPWRKMISSKDANFLGYTFKNLEIVDEHHIPGMAELKRKSKTANKPSLKTLFGKK

SEQ ID NO: 18980 - protein, 475 aa, Arabidopsis thaliana
MLEKKLAAAEVSEEEQNNLLKDLEMKETEYMRRQRHKMGADDFEPLTMIGKGAFGEVRICREKGTGNVYAMKKLKKSEMLRRGQVEHVKAERNLLAEVDSNCIVKLYCSFQDEEYLYLIMEYLPGGDMMTLLMRKDTLTEDEARFYIGETVLAIESIHKHNYIHRDIKPDNLLLDKDGHMKLSDFGLCKPLDCSNLQEKDFTVARNVSGALQSDGRPVATRRTQQEQLLNWQRNRRMLAYSTVGTPDYIAPEVLLKKGYGMECDWWSLGAIMYEMLVGFPPFYSDDPMTTCRKIVNWRNYLKFPDEVRLSPEAKDLICRLLCNVEQRLGTKGADEIKGHPWFRGTEWGKLYQMKAAFIPQVNDELDTQNFEKFEETDKQVPKSAKSGPWRKMLSSKDINFVGYTYKNVEIVNDDQIPGIAELKKKSNKPKRPSIKSLFEDETSGGTTTHQGSFLNLLPTQIEDPEKEGSKSSSSG

SEQ ID NO: 18981 - protein, 500 aa, Arabidopsis thaliana
TAAVIGLNTGKRLLSSSFYHSDVTEKFLSVNDHCSSQYHIASTKSGITAKKASNYSPSFPSSNRHTQSAKALKESVDVASTEKPWLPNGTDKELEEECYDDDDLISHSVEAILLLQKSMLEKSWNLSFEKAVSSEYPGKGTIRKKKIPVITCSGISARQRRIGAKKKTNMTHVKAVSDVSSGKQVRGYVKGVISEDVLSHVEVVRLSKKIKSGLRLDDHKSRLKDRLGCEPSDEQLAVSLKISRAELQAWLMECHLAREKLAMSNVRLVMSIAQRYDNLGAEMSDLVQGGLIGLLRGIEKFDSSKGFRISTYVYWWIRQGVSRALVDNSRTLRLPTHLHERLGLIRNAKLRLQEKGITPSIDRIAESLNMSQKKVRNATEAVSKVFSLDRDAFPSLNGLPGETHHSYIADTRLENNPWHGYDDLALKEEVSKLISATLGEREKEIIRLYYGLDKECLTWEDISKRIGLSRERVRQVGLVALEKLKHAARKRKMEAMILKN

SEQ ID NO: 18982 - protein, 218 aa, Arabidopsis thaliana
MRKVCELDIELSEEERDLLTTGYKNVMEAKRVSLRVISSIEKMEDSKGNDQNVKLIKGQQEMVKYEFFNVCNDILSLIDSHLIPSTTTNVESIVLFNRVKGDYFRYMAEFGSDAERKENADNSLDAYKVAMEMAENSLAPTNMVRLGLALNFSIFNYEIHKSIESACKLVKKAYDEAITELDGLDKNICEESMYIIEMLKYNLSTWTSGDGNGNKTDG

SEQ ID NO: 18983 - protein, 286 aa, Arabidopsis thaliana
MSSSGSDKERETFVYMAKLSEQAERYDEMVETMKKVARVNSELTVEERNLLSVGYKNVIGARRASWRIMSSIEQKEESKGNESNVKQIKGYRQKVEDELANICQDILTIIDQHLIPHATSGEATVFYYKMKGDYYRYLAEFKTEQERKEAAEQSLKGYEAATQAASTELPSTHPIRLGLALNFSVFYYEIMNSPERACHLAKQAFDEAIAELDTLSEESYKDSTLIMQLLRDNLTLWTSDLPEDGGEDNIKTEESKQEQAKPADATEVVIHFKMRTDQRAWKLNEI

SEQ ID NO: 18984 - protein, 241 aa, Arabidopsis thaliana
MENEQSTHVHFASLSSSSERYNETFEEIKKAMKKSVQLKAELSAKERNLVSVGYKNVISARRASLEILSSIVQKEESKGNEENVKKLKNYRNKVEDELAKICNDILSVINKQLIPSSTTVDSSVLFYNMLADFSSNAESKEATDQSLDAYKRLVWYQQFQLYMTLNWTSVFLNSPESAYQLAKQAFDDAINEFDISDESNKDMTLIIQLLRDNLNMWTLDLTEREEVIFLFPYLPPLMIDR

SEQ ID NO: 18985 - protein, 355 aa, Aspergillus oryzae
MSGHENNGAPPVGKEKINTDIVTLTRFLTEEQTKVPEATGDFTLLCHALQFSFKSIAYYIRCAFLINLTGLAGSSNTTGDDQKKLDVIGNDIFISAMRGSGKCRILVSEEEEEAIIFDEHPYARYAVVCDPIDGSSNLDAGVSVGTIFGIFKLPDSVLGPENKVSPKDLLLPGTEMVASGFTMYGASAQLVITMRNGGVNGFTLENSLGEFILTHPNMTLPAKRAIYSVNEGNSSYWEEWTNAYFHSLKFPPEGQKPYSARYIGSMVADAYRTLLYGGVFAYPADKKAPKGKLRILYECAPMAMLFENAGGLAVNSRMERLLGVVPEHIHDKSGVFLGSKDEVQKIIDTYNKYKK

SEQ ID NO: 18986 - protein, 412 aa, Arabidopsis thaliana
MGYYNNVFDECNDQTDIGNNKAFNIGLSLAYNWESHKYDWWRNLDGKVPDIAKSGFTSAWLPPPSQSLAPEGYLPQDLYSLNSAYGSEHLLKSLLRKMKQYKVRAMADIVINHRVGTTRGHGGMYNRYDGISLPWDEHAVTSCTGGLGNRSTGDNFNGVPNVDHTQHFVRKDIIGWLRWLRNTVGFQDFRFDFARGYSANYVKEYIGAAKPLFSVGECWDSCNYNGHGLDYNQDSHRQRIISWIDATGQISAAFDFTTKGILQEAVKGQYWRLCDAQGKPPGVMGWWPSRAVTFLDNHDTGSTQAHWPFPSHHVMEGYAYILTHPGIPCVFYDHFYDWGSSIHDQIVKLIDIRRRQDIHSRSTVRVLKAESNLYAAIVGEKICMKLGDGSWCPSGRDWTLATSGHRYAVWHK

SEQ ID NO: 18987 - protein, 251 aa, Paenibacillus polymyxa
MEAGGKKTSHSYLEDTEVKRLIALSQSGDNDARETLINSNIRLVWSVVQRFMNRGYEPDDLFQIGCIGLLKSVDKFDLSYEVKFSTYAVPMIIGEIQRFLRDDGTLKVSRSLKETANKVRKMKDELSKPLNRLPTVKEVADELGVTPEDVVFAQEANKPPTSIHETVFENDGDPITLMDQIADESQERWFDKLALNEAIDGLSERERLIVYLRYYRDQTQSEVASRLGISQVQVSRLEKKILQQIRDQIAQ

SEQ ID NO: 18988 - protein, 263 aa, Bacillus sphaericus
MKPLEQSSEKLLSQEEMRDLIARAQQGDHEARKRMVEGNTRLVWSIVQRFTTRGVELEDLFQIGCIGLMKSVDKFDLSYDVKFSTYAVPMIIGEIQRFLRDDGMVKVSRSIRELNFKIRHATDEFIKRNEHRPTIQELAQVLGVTTEEIVTASDALRDPASLHEQLYESEGDSITLMDQMKDEKSEQPFDYIPLKEVLTRLEPREQSIIYLRYFSDCTQTEIANRLGISQVQVSRLEKKILAQLKSWMATSATVEQEVIKKDI

SEQ ID NO: 18989 - protein, 250 aa, Geobacillus stearothermophilus
MDVDVKQGQSPIKDQEMKELIRRSQEGDQEARDEIIEKNMRLVWSVVQRFLNRGYEADDLFQIGCIGLLKSVDKFDLSYDVKFSTYAVPMIIGEIQRFLRDDGTVKVSRSLKEMGNKIRKAKDELSKTRGRSPTITEIADHLGISPEDVVLAQEAVRLPTSIHETVYENDGDPITLLDQIADADEASWFDKIALKKAIEELDERERLIVYLRYYRDRTQSEVASRLGISQVQVSRLEKKILQHIKDKMDG

SEQ ID NO: 18990 - protein, 388 aa, Staphylococcus carnosus
MNKSKGGLQLTVQTLSLVAGFMVWSIIAPLMPMISQDIKITSSQISIVLAIPVILGSVLRIPFGYLTNIIGAKWVFFSSFIILLFPIFLLSQAQSVNMLMLAGFFLGVGGAVFSVGVTSIPKYFPKDKVGLANGIYGMGNLGTAVSSFLAPPIAGAIGWQSTVRLYLIVMAVFAIVMFFLGDAKEPKVKIPLVAQTKDLLKDLRTYYLSFWYFITFGSFVAFGIFLPKYLVDHYELTTVDAGIRAGIFIAIATFLRPLGGIIGDKIDAVKALKVDFLFMIIGAIILGIANDMILFTVGCLTVSVCAGIGNGLVFKLVPQYFQKEAGVANGIVSMMGGLGGFFPPLVITYVTSITGTSHLAFIFLALFGVLALVTMWHLSKKNRSLAYK

SEQ ID NO: 18991 - protein, 295 aa, Gibberella moniliformis
MSLYDKSVTATRSAHRTSDTLHSLVAGSSDTVAKTRLQLNQVSGRNKQNVPWPRFGLQWYSGCIPFLIGNSVKTSIRFVSFDGYQKLLADDDGNISRFGILLAGFGAGATESLLAVTPSERIKTIIIEDRRLEKPRIRNSFHAMSIIARDHGLSGFFQGFWPTTARQSAGSAIRLGSYTFLKQVVQSRTPQGGKIGTVKTFIIGSLAGLITVYLTQPLDTIKTRMQRLEARTRYGNAFICARGILEQEGFTAFWSGAVARSLRLVMSGGIVFMVYEKVVEGLDVISPAKRYEIAA

SEQ ID NO: 18992 - protein, 411 aa, Schizosaccharomyces pombe
MALYSISKPVGSKINKHSYQDENTLVGKQALSKGTEKTKLSTNFEINLPRRTVLSDVSNVGKNNADEKDTKKAKRSFDESNLSTNEEADKPVESKFVKKLKVYSKNADPSVETLQKDRVSNVDDHLSSNPLMAEEYAPEIFEYIRKLDLKCLPNPKYMDQQKELTWKMREILNEWLVEIHSNFLLMPETLYLAVNIIDRFLSRRSCSLSKFQLTGITALLIASKYEEVMVPSIQNFVYMTDGAFTVEDVCVAERYMLNVLNFDLSYPSPLNFLRKISQAEGYDAQTRTLGKYLTEIYLFDHDLLRYPMSKIAAAAMYLSRRLLRRGPWTPKLVESSGGYEEHELKEIAYIMLHYHNKPLEHKAFFQKYSLKRFLKASIFVHQLVRNDTSVNRTDDDDLQSEPSSSLTNDGH

SEQ ID NO: 18993 - protein, 404 aa, Asterina pectinifera
MSLRVRGTTNILGTAKLGMLNSENADARMNGKMVTRATTKTIKSTLGTRGALENISNVAKNNVQAAAKKEIKQKRGMTKSKATSSLQSVIGLHVEPVEKVQSPEPMDMSEVSNALEAFSQNILEMGVDDIDKDDHENPQLCSEYVNDIYHYMRHLEREFKVRTDYMAMQEITERMRTILIDWLVQVHLRFHLLQETLFLTIQILDRYLEVQAVSKTKLQLVGVTSMLIAAKYEEMYPPEIGDFVYITDNAYSKAQIRAMECNILRKLDFNLGKPLCIHFLRRCSKAGGVDGHKHTLSKYIMELTLPEYSFVKYDPSEIAAAALCLSTKILDEDMEWNKTLVHYSAYSEGHLAPIVQKMAVLLNNAPKSKFQAVRKKYASSKFMSISSSQELKSTVITDLADENC

SEQ ID NO: 18994 - protein, 183 aa, Arabidopsis thaliana
MTRVYVGNLDPRVTERELEDEFKAFGVLRNVWVARRPPGYAFLEFDDERDALDAISALDRKNGWRVELSHKDKGGRGGGGGRRGGIEDSKCYECGELGHFARECRRGRGSVRRRSPSPRRRRSPDYGYARSPRGRRSPPRRRSVTPPRRGRSYSRSPPYRGSRRDSPRRRDSPYGRRSPYANG

SEQ ID NO: 18995 - protein, 200 aa, Arabidopsis thaliana
MSRVYVGNLDPRVTERELEDEFRAFGVVRSVWVARRPPGYAFLDFEDPRDARDAIRALDGKNGWRVAQSHNRGERGGGGRGGDRGGGGAGRGGRGGSDLKCYECGETGHFARECRNRGGTGRRRSKSRSRTPPRYRRSPSYGRRSYSPRARSPPPPRRRSPSPPPARGRSYSRSPPPYRAREEVPYANGNGLKERRRSRS

SEQ ID NO: 18996 - protein, 184 aa, Arabidopsis thaliana
MTRVYVGNLDPRVTERELEDEFKAFGVLRNVWVARRPPGYAFLEFDDERDALDAISALDRKNGWRVELSHKDKGGRGGGGGRRGGIEDSKCYECGELGHFARECRRGRGSVRRRSPSPRRRRSPDYGYARRSISPSGRRSPPRRRSVTPPRRYSRSPPYRGSRRDSPRRRDSPYGRRSPYANGV

SEQ ID NO: 18997 - protein, 210 aa, Paeonia lutea
IVESVGEGVTDLKPGDHVLPVFTGECKECRHCKSEESNMCDLLRINTDRGVMLNDGKSRFSINGQPIFHFVGTSTFSEYTVVHIGCVAKINPEAPLDKVCVLSCGISTGLGATLNVAKPKKGSSVAIFGLGAVGLAAAEGARIAGASRIIGVDLNPKRFEEAKKFGVTEFVNPKDYNKPVQEVIAEMTGGGVDRSVECTGSIMAMISAFE

SEQ ID NO: 18998 - protein, 385 aa, Caenorhabditis elegans
MRLMGCVGAGADAEGREARKVNKQIEEQLAKDKQVMRATHRLLLLGAGESGKSTIVKQMRILHINGFNEAEKREKITDIRRNVRDAMQVSEKDSRVILRAMDEIVPKVSLDDPSTAISRDYILRITNDPEDNYPSEFYDHILTCWKDKGVMACYERSSEYQLIDCAQYFLDKVDVVRQNNYDPSEQDILRCRVMTTGIFETKFEVDKVRFHMFDVGGQRDERRKWIQCFNDVTAIIFVCASSSYNLVLWEDNTQNRLRESLALFKNIWNNRWLKTISVILFLNKQDLLSEKIKAKRYLLESFFPEFEGYNLPNDAVFDNQEDKDVVRAKYFIRGEFLRISTANSDGRHHCYPHFTCAVDTENIRRVFNDCRDIIQRIHLRQYELL

SEQ ID NO: 18999 - protein, 356 aa, Rosellinia necatrix
MMGACMSSNKEDEEQKKRSQAIDRALDEDSKRLRRECKILLLGSGESGKSTIVKQMKIIHLKGYSEEELYNYRATVFKNLIECAKAVIIAMDQFEIEPSSEGTTDYCDYLRNYTVESGPSARIEAKVGIAVQALWNDPCIDRLMQHATEFYLMDSAGYFFDEVHRICAPDYLPNEMDVLRARTKTTGIYETKFQMGALNIHMFDVGGQRSERKKWIHCFENVTSIIFCVALSEYDQVLLEESSQNRMMESLLLFDSVVNSRWFMRTSIILFLNKVDIFKAKLPRSPLGNYFPDYSGGNDVNKAAKYLLWRFNQVNRAHLNLYPHLTQATDTSNIRLVFAAVKETILNNALKDSGIL

SEQ ID NO: 19000 - protein, 353 aa, Rosellinia necatrix
MGCGMSTEEKEGKARNEEIENQLKRDKMMQRNEIKMLLLGAGESGKSTILKQMKLIHEGGYSRDERESFKEIIFSNTVQSMRVILEAMESLELPLEEPRMEYHVQTIFMQPAQIEGDVLPPEVGGAIEALWKDHGVQECFKRSREYQLNDSARYYFDNIVRIATPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 19001 - protein, 354 aa, Rosellinia necatrix
MCFGSRKTDEAGDARSRELDKIIKQDEKRMLKEVKLLLLGAGESGKSTVLKQMKLIYAQGFSKTEKLEWKPVVLINVIQSLRLIFDAMEDYNIEFERKENEKNKELVLLDVEIGPNDPLPQDYLQPIKSLWADSGVQKAILKGNEYALHDNIAYFCDDVDRLWDKNYIPTDQDLLRTRLRTTGITETVFDLGQLTYRMFDVGGQRSERKKWIHCFENVHCLLFLVAISGYDQCLVEDKDGNQMNEALMLWESIANSHWFAKSALILFLNKMDLFKEKLVSSPITSYGFTDYRGPADDHKLASKYFMDKFKALNRNPEKEIYGHFTNATDTNLLKITMTSVQDMIIQRNLKQLIL

SEQ ID NO: 19002 - protein, 343 aa, Caenorhabditis elegans
MPLPPCIVLATSSPVSTINLLLLGSGESGKSTFVKQMHIIHGAGEFTADEVRAYRQQIYQNAISAMRVLLDARNKLGIAWEDPKRQVEVEKVMRFSVGDLLKGIDFTTFVEVAPIISDFWNDAAIRKTYEQRNLFQISDSCQYFFEHIPRIAMPDFYPTNRDILFCRKATRGISEHIFEINKIPFRFIDVGGQRSQRQKWFQCFTDITSILFMVASNEYDQVILEDRRTNRVVESRSVFETIVNNRAFSNVSIILFMNKNDLLQEKVPKSDIRQYFTDFTGDHTLVRDVQFFLVDKFEASRRDRARPFFYHFTTAVDTENIRRVFRDVRESILEQNLKTLMMQ

SEQ ID NO: 19003 - protein, 236 aa, Arabidopsis thaliana
KNSVFKTEEKKLELKLGPPGEEDDDESMIRHMKKEPKDKSILSLAGKYFSPSSTKTTSHKRTAPGPVVGWPPVRSFRKNLASGSSSKLGNDSTTSNGVTLKNQKCDAAKTTEPKRQGGMFVKINMYGVPIGRKVDLSAHNSYEQLSFTVDKLFRGLLAAQRDFPSSIEDEKPITGLLDGNGEYTLTYEDNEGDKMLVGDVPWQMFVSSVKRLRVIKTSEISSALTYGNGKQEKMRR

SEQ ID NO: 19004 - protein, 234 aa, Arabidopsis thaliana
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLGKFSFLFVSISGSFLFFQ

SEQ ID NO: 19005 - protein, 138 aa, Arabidopsis thaliana
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYREGDNKGSGKSGDGSNRDAGGGVSGEEMPV

SEQ ID NO: 19006 - protein, 424 aa, Gallus gallus
MASKEVLEDTVEERVISEEYKIWKKNTPFLYDLVMTHALEWPSLTVQWLPDVSRPEGKDYALHWLVLGTHTSDEQNHLVVARVQIPNDDQFDTSQYDSEKGEFGGFGSVTGKIETEIKINHEGEVNRARYMPQNPYIIATKTPSADVLVFDYTKHPSKPDPSGECNPDLRLRGHQKEGYGLSWNSNLKGHLLSASDDHTVCLWDISAGPKEGKIVDAKAIFTGHSAVVEDVAWHLLHESLFGSVADDQKLMIWDTRSNTTSKPSHSVDAHTAEVNCLSFNPYSEFILATGSADKTVALWDLRNLKLKLHSFESHKDEIFQVHWSPHNETILASSGTDRRLNVWDLSKIGEEGSAEDAEDGPPELLFIHGGHTAKISDFSWNPNEPWVICSVSEDNIMQIWQMAENIYNDEEPDIAAAELEGQGT

SEQ ID NO: 19007 - protein, 203 aa, Picea abies
MECFEEKGKGVQKTRMVRGKTQMKRIENDTSRQVTFSKRRNGLLKKAYELSVLCDAEVALIVFSPRGKLYEFANPSMQKMLERYDKCSEGSNTTNTTKERDIQYLKREIANREERIKILESRQRKMVGEELASCALSDLNLLESQVERGLRHIRARKTQILVAEIEELKRKERISSEENAFHRKSLSILCMRMVPFWQLLQVH

SEQ ID NO: 19008 - protein, 739 aa, Arabidopsis thaliana
ILICFTYIPKVFNFLELQKVPPMASSAFAFPSYIITKGGLSTDSCKSTSLSSSRSLVTDLPSPCLKPNNNSHSNRRAKVCASLAEKGEYYSNRPPTPLLDTINYPIHMKNLSVKELKQLSDELRSDVIFNVSKTGGHLGSSLGVVELTVALHYIFNTPQDKILWDVGHQSYPHKILTGRRGKMPTMRQTNGLSGFTKRGESEHDCFGTGHSSTTISAGLGMAIGRDLKGKNNNVVAVIGDGAMTAGQAYEAMNNAGYLDSDMIVILNDNKQVSLPTATLDGPSPPVGALSSALSRLQSNPALRELREVAKGMTKQIGGPMHQVAAKVDVYARGMISGTGSSLFEELGLYYIGPVDGHNIDDLVAILKEVKSTRTTGPVLIHVVTEKGRGYPYAERADDKYHGVVKFDPATGRQFKTTNETQSYTTYFAEALVAEAEVDKDVVAIHAAMGGGTGLNLFQRRFPTRCFDVGIAEQHAVTFAAGLACEGLKPFCAIYSSFMQRAYDQVVHDVDLQKLPVRFAMDRAGLVGADGPTHCGAFDVTFMACLPNMIVMAPSDEADLFNMVATAVAIDDRPSCFRYPRGNGIGVALPPGNKGVPIEIGKGRILKEGERVALLGYGSAVQSCLGAAVMLEERGLNVTVADARFCKPLDRALIRSLAKSHEVLITVEEGSIGGFGSHVVQFLALDGLLDGKLKWRPMVLPDRYIDHGAPADQLAEAGLMPSHIAATALNLIGAPREALF

SEQ ID NO: 19009 - protein, 729 aa, Mus musculus
MNPFQKNESKETLFSPVSTEEMLPGPPSPPKKSTPKLFGSSYPLSIAFIVVNEFCERFSYYGMKAVLTLYFLYFLHWNEDTSTSVYHAFSSLCYFTPILGAAIADSWLGKFKTIIYLSLVYVLGHVFKSLGAIPILGGKMLHTILSLVGLSLIALGTGGIKPCVAAFGGDQFEEEHAEARTRYFSVFYLSINAGSLISTFITPMLRGDVKCFGEDCYALAFGIPGLLMVLALVVFAMGSKMYRKPPPEGNIVAQVTKCIWFAICNRFRNRSEDIPKRQHWLDWAAEKYPKHLIMDVKALTRILFLYIPLPMFWALLDQQGSRWTLQANKMDGDLGFFVLQPDQMQVLNPFLVLVFIPLFDLVIYRLISKCGVNFSSLRKMAVGMILACLAFAVAALVEIKINGMIHPQPASQEIFLQVLNLADGEIEVTVQGNRNNPLLVSEISSFQNTTHYSKLRLETKSQDLHFHLKYNNLSVHNEYSVEEKNCYQLVVHENGESLSSMLVKDTGIKPANGMTAIRFINTLHKDMNISLDANAPLSVGKDYGVSEYRTVQRGKYPAVHCETEDNVFSLNLGQLDFGTTYLFVITNITNRGLQAWKAEDIPANKLSIAWQLPQYVLVTAAEVMFSVTGLEFSYSQAPSSMKSVLQAAWLLTVAVGNIIVLIVAQFSGLVQWAEFVLFSCLLLVVCLIFSVMGYYYVPLKSEGIHEATEKQIPHIQGNMINLETKNTRL

SEQ ID NO: 19010 - protein, 160 aa, Arabidopsis thaliana
MTARFNQQILKQRHFSESTRLVKKRKRRSRRKVCLLCLCWSVFEEMVKSTSKDAQDLFHSLHSAYTATPTNLKIIDLYVCFAVFTALIQVAYMALVGSFPFNSFLSGVLSCIGTAVLAVCLRIQVNKENKEFKDLAPERAFADFVLCNLVLHLVIINFLG

SEQ ID NO: 19011 - protein, 361 aa, Cricetulus griseus
MAAAEEPKPKKLKVEAPQALSENVLFGMGNPLLDISAVVDKDFLDKYSLKPNDQILAEEKHKELFDELVRKFKVEYHAGGSTQNSIKVAQWMIQKPHKAATFFGCIGIDKFGEILKSKAAEAHVDAHYYEQNEQPTGTCAACITGDNRSLVANLAAANCYKKEKHLDLENNWVLVEKARVYYIAGFFLTVSPESVLKVARYAAENNRIFTLNLSAPFISQFFKESLMEVMPYVDILFGNETEAATFAREQGFETKDIKEIAKKAQALAKVNSKRPRTVVFTQGRDDTVVATENEVMAFAVLDQNQKEIIDTNGAGDAFVGGFLSQLVYNKPLTECIRAGHYAASVIIRRTGCTFPEKPDFH

SEQ ID NO: 19012 - protein, 406 aa, Arabidopsis thaliana
APRQSWDGPKPISIVGSTGSIGTQTLDIVAENPDKFRVVALAAGSNVTLLADQVRRFKPALVAVRNESLINELKEALADLDYKLEIIPGEQGVIEVARHPEAVTVVTGIVGCAGLKPTVAAIEAGKDIALANKETLIAGGPFVLPLANKHNVKILPADSEHSAIFQCIQGLPEGALRKIILTASGGAFRDWPVEKLKEVKVADALKHPNWNMGKKITVDSATLFNKGLEVIEAHYLFGAEYDDIEIVIHPQSIIHSMIETQDSSVLAQLGWPDMRLPILYTMSWPDRVPCSEVTWPRLDLCKLGSLTFKKPDNVKYPSMDLAYAAGRAGGTMTGVLSAANEKAVEMFIDEKISYLDIFKVVELTCDKHRNELVTSPSLEEIVHYDLWAREYAANVQLSSGARPVHA

SEQ ID NO: 19013 - protein, 478 aa, Arabidopsis thaliana
MATETVLATAVSNGKSKGCCKSGPGYATPLAAMAGPREKLIYVTALYSGTGRDKPDYLATVDVDPSSPTFSSVIHRLKMPYIGDELHHTGWNSCSSCHGDASADRRYLVLPGLISGRIYAIDTKTDPKAPSLYKVVEPKEIAEKTGLAFPHTSHCLASGDMLVSCLGDKEGNAKGNGFLLLDSDFNVKSRWDKPGHGPLFGYDFWYQPRFKTMISTSWGAPKAFSKGFNLQHVADGLYGSHLHIYQWPEGEMKQITYWVFVVMWLQIRFLHDPSKDTGYVGSALSSNMIRFFKNSDDTWSHEAIENWILPEMPGLITDFLISLDDRFFYFVNWLHGDIRQYNIEDPKNPVLTGQIWVGGLLQKGSPYKAVGEDGNTYQFDVPQIKGKSLRAGPQMIQLSLDGKRLYATNSLFSAWDRQFYPEIMEKGSHIIQIDVDTDKGGLTLNPDFFVDFGDEPDGPALAHEMRYPGGDCTSDIWI

SEQ ID NO: 19014 - protein, 356 aa, Arabidopsis thaliana
MKTVLVIINCIFLAIGNCGGPLMMRLYFQNGGERIWFPSFLQTVGCPLIFFPLLLSFLRRRRCLEEQETTPFFLMKPPLFIAAIVVGLLVGFDNYLYSYGLAYIPVSTASLIISAQLGFTALFAFFMVKQKFTPFTINAIVLLTGGAVVLALNSDSDKLANETHKEYVVGFIMTLGAALLYGFILPLVELSYKKSGQRITYTLALEFQMVLCFAATCVCLVGMLAAGDFKVKHALFIFKNRVIAGEARDFKLGESLYYVVIVFTAIIWQAFFVGAIGLIFCASSLVSGIMVSALLPVTVILAVICFQEKFQAGKGVALALSLWGSVSYFYGQVKSEEKTKAQDTQLSQLPVTDYVA

SEQ ID NO: 19015 - protein, 225 aa, Arabidopsis thaliana
GQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 19016 - protein, 266 aa, Arabidopsis thaliana; identical to SEQ ID NO: 623

SEQ ID NO: 19017 - protein, 464 aa, Arabidopsis thaliana
MLDLNLNADSPESTQYGGDSYLDRQTSDNSAGNRVEESGTSTSSVINADGDEDSCSTRAFTLSFDILKVGSSSGGDESPAASASVTKEFFPVSGDCGHLRDVEGSSSSRNWIDLSFDRIGDGETKLVTPVPTPAPVPAQVKKSRRGPRSRSSQYRGVTFYRRTGRWESHIWDCGKQVYLGGFDTAHAAARAYDRAAIKFRGVDADINFTLGDYEEDMKQVQNLSKEEFVHILRRQSTGFSRGSSKYRGVTLHKCGRWEARMGQFLGKKYIYLGLFDSEVEAARAYDKAAINTNGREAVTNFEMSSYQNEINSESNNSEIDLNLGISLSTGNAPKQNGRLFHFPSNTYETQRGVSLRIDNEYMGKPVNTPLPYGSSDHRLYWNGACPSYNNPAEGRATEKRSEAEGMMSNWGWQRPGQTSAVRPQPPGPQPPPLFSVAAASSGFSHFRPQPPNDNATRGYFYPHP

SEQ ID NO: 19018 - protein, 376 aa, Arabidopsis thaliana
MSNFTYTSAFNLSDNSPFNPAIGSSSSSSSALVVASDDDNNTDDACSICLEPFTLQDPSTVTSCKHEYHLQCIIEWSQRSKECPICWQLFVLRDPASQELLAAVEKERLLKTRNISSSSPISIHHSHDDFHSEEEESQFSSFDEQFLRHLTEAAHRRCLLRRRDGQISSSLVSSSDPTTIHPTDLVNLYRLSAISHVEHQNSNPCPSPGSMTPSPVSGHSSIPADSNNGSRISPGPSPSRSSQSPKSPEASSLPEAIKSKLAAASAKYKESISKSKQGLKEKLLARNNSVKELSKGVQREMNAGIAGVARMIERMDFSSKRFGGSAHVSTSTATASGFNFSFKGKRVEANSKSNNNGDKTEPQKLQVSDFSRFLVF

SEQ ID NO: 19019 - protein, 573 aa, Arabidopsis thaliana
MTVEQNLEALDQFPVGMRVLAVDDDQTCLKILESLLRHCQYHVTTTNQAQKALELLRENKNKFDLVISDVDMPDMDGFKLLELVGLEMDLPVIMLSAHSDPKYVMKGVTHGACDYLLKPVRIEELKNIWQHVVRSRFDKNRGSNNNGDKRDGSGNEGVGNSDPNNGKGNRKRKDQYNEDEDEDRDDNDDSCAQKKQRVVWTVELHKKFVAAVNQLGYEKAMPKKILDLMNVEKLTRENVASHLQKFRLYLKRISGVANQQAIMANSELHFMQMNGLDGFHHRPIPVGSGQYHGGAPAMRSFPPNGILGRLNSSSGIGVRSLSSPPAGMFLQNQTDIGKFHHVSSLPLNHSDGGNILQGLPMPLEFDQLQTNNNKSRNMNSNKSIAGTSMAFPSFSTQQNSLISAPNNNVVVLEGHPQATPPGFPGHQINKRLEHWSNAVSSSTHPPPPAHNSNSINHQFDVSPLPHSRPDPLEWNNVSSSYSIPFCDSANTLSSPALDTTNPRAFCRNTDFDSNTNVQPGVFYGPSTDAMALLSSSNPKEGFVVGQQKLQSGGFMVADAGSLDDIVNSTMKQV

SEQ ID NO: 19020 - protein, 754 aa, Lycopersicon esculentum
MGSLLRMNRLLSSIVESCNCIIDPQLPADDLLMKYQYISDFFIALAYFSIPVELIYFVKKSAVFPYRWVLVQFGAFIVLCGATHLINLWTFNMHTRNVAIVMTTAKALTALVSCITALMLVHIIPDLLSVKTRELFLKKKAAQLDREMGIIRTQEETGRHVRMLTHEIRSTLDRHTILKTTLVELGRTLALEECALWMPTRTGLELQLSYTLRHQNPVGLTVPIQLPVINQVFGTNHVVKISPNSPVARLRPAGKYMPGEVVAVRVPLLHLSNFQINDWPELSTKRYALMVLMLPSDSARQWHVHELELVEVVADQVAVALSHAAILEESMRARDLLMEQNVALDLARREAEMAVRARNDFLAVMNHEMRTPMHAIIALSSLLQETDLTPEQRLMVETILKSSNLLATLINDVLDLSRLEDGSLQLDIGTFNLHALFREVHSLIKPIASVKKLFVTLSLSSDLPEYVIGDEKRLMQILLNVVGNAVKFSKEGNVSISAFVAKSDSLRDPRAPEFFAVPSENHFYLRVQIKDTGIGITPQDIPNLFSKFTQSQALATTNSGGTGLGLAICKRFVNLMEGHIWIESEGLGKGSTAIFIIKLGIPGRANESKLPFVTKLPANHTQMSFQGLKVLVMDENGVSRMVTKGLLTHLGCDVTTVGSRDECLRVVTHEHKVVIMDVSMQGIDCYEVAVVIHERFGKRHGRPLIVALTGNTDRVTKENCMRVGMDGVILKPVSVYKMRSVLSELLEHGVVLES

SEQ ID NO: 19021 - protein, 479 aa, Arabidopsis thaliana
MESKWLFGRKQEAEVGPFSAWNITGTYRGLPHALLHFFYVFYTSGLSTMLWLNVLDYLSNVKRVFSGTWKFLNSLNSSSKFQDFQKENGNSVVELVAVPTKITGVHYVQLGIFSSQVFQESPRDRLLKRKLSPVNEMEKHCNIEIAAQVSRVASSENNGDKNYYHMEGLMESPGVGDDGDCFSPLLLNATSVNVEVYYNKAVNYTLMVLLLIRQMEHVLNLKLTTSHAESLFNAFATAAFFKFVVFSIFEMRYLLAIWKATRPSNSGEGWETMRRELSFLYSRFYGILLGGILIMYQFHNYMQPILLLMYSFWIPQIVANVVRDSRKPLHPYYILGMTATRLAIPLYVFGCPHNFMRVEPNKHYFGSRCFVPRQMLPEKYNYHRRFNRDVSRTTDCVICMTAIDLRQHTSDCMVLQFFPASLNYIFSPIDRIMSVVVLKTEMDGYKNGVSNLSAVSSSSIEDVFGLLGCTDFTQIIAGL

SEQ ID NO: 19022 - protein, 304 aa, Arabidopsis thaliana
MKFGETFTEYLHGEEEWFLEKCRFVEYKKLKKVLKKCKTCNSTKSDDGQIIPSATSSSLSDSCECKACPLIFVQQSNGERNDLLGCDQMFFEELMKEATDIAGFFRSRVRHLLHLHVATGMQRYMIRLRRCFTDEKQALVQEGQILIQYITMNAIAIRKILKKYDKVHSSENGKNFKLKMRAERIELLHSPWLIELGAFYLNSGLDNVGNFKNSFGRVACENLNEDQPVLKLMLPNSIELEYDLTCAICLAGVYAEAVHMIELHLLLKTRSKEYWKERMMNERSEMVKQSKMFWNEQTKHMIGY

SEQ ID NO: 19023 - protein, 310 aa, Arabidopsis thaliana
MKRLSSSDSVGGLISLCPTTSTDEQSPRRYGGREFQSMLEGYEEEEEAIVEERGHVGLSEKKRRLSINQVKALEKNFELENKLEPERKVKLAQELGLQPRQVAVWFQNRRARWKTKQLEKDYGVLKTQYDSLRHNFDSLRRDNESLLQEISKLKTKLNGGGGEEEEEENNAAVTTESDISVKEEEVSLPEKITEAPSSPPQFLEHSDGLNYRSFTDLRDLLPLKAAASSFAAAAGSSDSSDSSALLNEESSSNVTVAAPVTVPGGNFFQFVKMEQTEDHEDFLSGEEACEFFSDEQPPSLHWYSTVDHWN

SEQ ID NO: 19024 - protein, 406 aa, Arabidopsis thaliana
MDLVSSRDTLGDPSTSTKALLLGFSRSRSDHCIIMSGESSSGSTEHCIKVVPTHGGRYVQYNVYGQLFEVSRKYVPPIRPIGRGACGIVCAAVNSVTGEKVAIKKIGNAFDNIIDAKRTLREIKLLRHMDHENVITIKDIVRPPQRDIFNDVYIVYELMDTDLQRILRSNQTLTSDQCRFLVYQLLRGLKYVHSANILHRDLRPSNVLLNSKNELKIGDFGLARTTSDTDFMTEYVVTRWYRAPELLLNCSEYTAAIDIWSVGCILGEIMTGQPLFPGKDYVHQLRLITELVGSPDNSSLGFLRSDNARRYVRQLPRYPKQQFAARFPKMPTTAIDLLERMLVFDPNRRISVDEALGHAYLSPHHDVAKEPVCSTPFSFDFEHPSCTEEHIKELIYKESVKFNPDH

SEQ ID NO: 19025 - protein, 378 aa, Caenorhabditis elegans
MSTVPLNKNSPSMPPPPSSNTVADFTHLRRRRPRSAHYDPNTITLPAKEEVTPQDVNDLYKRIDKLGEGSYATVYKCESKLDGSIVALKEIKLQFQEGLPFTAIREASLLRNLRHANIVSLHDIFYQHHQLTFVFEYMKMDLSKYLEQNVYGLDSIDIKLLLFQLLRGLDFCHRKKILHRDLKPQNLLLDEDGVLKLADFGLARAKSVPSRTYSHEVVTLWYRPPDVLMGSTDYSTSLDMWGVGCIFAEICTGAALFPGSKDSHYPGTKDQLDMIFSIRGTPDEKKWPEVKTLPGYTPELFPRYRELSFIAVNPMFTKILKTGQELLGMLLQLRPESRVSAASAMLHPYFASFPREVHLLAPSQSIFRLKELKDLRSL

SEQ ID NO: 19026 - protein, 602 aa, Caenorhabditis elegans
MSYVGAECEEEEKEYPSRYPIAYFEWENVKIPMTICLWLIGASIAKIIFNLIPHLNELFPDSALLIMIGLIIGIIFKLIGVNKNAFFLESEVFMLYLLPPLVFDAGYFMPARQFFDNFGSILCFAMIGTSFNIVAIALSLWAISLTGLFSVETPLMHMLLFGSVAADVDPVAVNEVLFIAVFGESLLNDGVAVVLYRMFLTFSEIGTENLITSDYINGGVSFLVVAFGGIGIGLLFAFLTSLVTRFARDEEVKVLNSVFILILPYTCYLCGELFGLSSIMAIVFCGAAMRQYCRENVDPDTVKATESFIKVLSLASETVIFVFLGLSTVSSNHHWDTSFIVLTVVFCLIYRTLGVVVMCYFLNKYRLNKYTKVDQFIMAYGGLRGAIAYGLVVAIPDFIPGKNMFVTSCIIVIYFTVFLQGITLKPIAEFLQVEKKNVHSKNMIEHIYSEGHHWIRDSWNALNNNYLRPILVNKNNMKEMDKTKLVRKYKHLVDEDAKKIARGDLNSNMVFTKALIEHTRSRTNTMIDGVSSTSKIDFTKHMKENFGVTVYDDHSTVPMTPTHLFQETTEVEYSVRSEINDNDGFENDGYESDESGSFHERV

SEQ ID NO: 19027 - protein, 474 aa, Caenorhabditis elegans
MTDDVDTHIHEKFDLQKRLGKGAYGIVWKAYDKRSRETVALKKIFDAFRNPTDSQRTFREVMFLQEFGKHPNVIKLYNIFRADNDRVIRRDIYLAFEFMEADLHNVIKKGSILKDVHKQYIMCQLFRAIRFLHSGNVLHRDLKPSNVLLDADCRVKLADFGLARSLSSLEDYPEGQKMPDLTEYVATRWYRSPEILLAAKRYTKGVDMWSLGCILAEMLIGRALFPGSSTINQIERIMNTIAKPSRADIASIGSHYAASVLEKMPQRPRKPLDLIITQSQTAAIDMVQRLLIFAPQKRLTVEQCLVHPYVVQFHNPSEEPVLNYEVYPPLPDHIQLSIDDYRDRLYEMIDEKKASFKRIQHEKIRPYGEDKSRAPIAQAECSDTDYDTARSLQRTTSMDKNNSSSHDSSSGTLRERAASAESRTSKDSNGEMRNGNGNTPSSIKQRRRSVERARLFANIKPSKILHPHKLISNY

SEQ ID NO: 19028 - protein, 576 aa, Caenorhabditis elegans
MNAVVASQNKNDRSFSNMESESSSNVEKSEKENHHQSLPDENWTPFLFFCISSIALASFQDGFQIGCINAPGPLIIDWIKKCHFELFGEVLSQYQADFIWSVAVSMFSVGGMFGSFCSGFLADKFGRKSTLLYNNILALLAAVCLSTSKLFNFYPMIVFGRFLVGLNCGITSGLVPMFLTELAPANLRGKCGSFHQLNISVAIVLSQALGLPQIFGTQVGWPYIFACVAIPTFLQLATIPFCVESPKYLISKLNDREEARRILEKLRGHTKVDEELEHMVQETMVTVEPLHQPGYVSLFKGDNQWPMIVSILMMFSQQFSGISAVTFYSTLIFKRNGLSGNEPMYATVGFGCIKLIATFGCLFLIDHPKFGRKRLHIAGLSGMCISSILIVITLTLSNAGYHWASYMNVLFILSFVVTFAFGPGPIPWFFTSELFDSATRGRAAAVSATSNWVANWMVGLTFLPINNIIHQYAFLMFTFFTFTFAIFTWKFVPETKGKSPSAIRKDLQNASFDYSSPSRPSRTFFSPIWIWVQLWLRSTNVSWIWWIWWRTSRASYWKEVGRREELFADFLYLIVI

SEQ ID NO: 19029 - protein, 496 aa, Caenorhabditis elegans
MTVDSIPLNTGAQLPLFGLGTWQVKDEAELTMSQKNNWKIKTDLKNVIFGQKRKTQKKSDTAHLYQNEHIIGKVLHEYISSGKLKREDIFVTSKLPFTAHAPEDVPKCVESQLKALQLEYIDLYLIHCPFPFKHQEGSFAPLMENGELAVTEIAHIDTWRALEKLYKEGKLKQNVEKLVANILLTIHALGVSNFSCNQLQALYDAAEVKPANQQVECHIYWPQQELRALCKKLGVTVTAYAPLGSPGRKAARPDGVWPEGDPLLEPIVKQLAAKYHKTAAQILIRHLTQHGISTIPKSVSPDRIVENISTFDFKLSDEDMHTLNSIETRTRLFIADLIFSRQWAGKSSVVQTKSALQLAISSIAGFEKFRQSAIPAIAEIAEIVDCRTFSAIFKPNYISEIEKIANWFLVFTLSSIHSSHTTTLTPPKFQKLGSDFTRLLAQLFQFFSIIIFKPTAILGIFQKFMILEILRFTKNLTENFEKSDFFVVFQILYLIM

SEQ ID NO: 19030 - protein, 250 aa, Mycobacterium smegmatis
MTSEYADVLDMFRELAGTTEGSPSYVRQREKIVERCLPLADHIARRFDGRGEPREDLVQVARVGLVNAVNRFDVEAGSDFVSFAVPTIMGEVRRHFRDNSWSVKVPRRLKELHLRLGAATAELSQRLGRAPTASELAHELDMDREEVVEGLIAGSSYNTLSIDSGGGGDEEAPAIVDTLGDLDMGLDQIDNRESLRPLLASLPERERTVLVLRFFESMTQTQIAERVGISQMHVSRLLAKSLARLRDQLQ

SEQ ID NO: 19031 - protein, 1246 aa, Caenorhabditis elegans
MAPTLTSSGKRRTVKVSPDGDHVTHNRKNSSSHARSTGQSGMSSRSAARRNDQDVHVGKYKLLKTIGKGNFAKVKLAKHVITGHEVAIKIIDKTALNPSSLQKLFREVKIMKQLDHPNIVKLYQVMETEQTLYLVLEYASGGEVFDYLVAHGRMKEKEARAKFRQIVSAVQYLHSKNIIHRDLKAENLLLDQDMNIKIADFGFSNTFSLGNKLDTFCGSPPYAAPELFSGKKYDGPEVDVWSLGVILYTLVSGSLPFDGQNLKELRERVLRGKYRIPFYMSTDCENLLKKFLVINPQRRSSLDNIMKDRWMNVGYEDDELKPFIEPPKDQIDEQRIEKLIQIFQLGFNKAAILESVEKEKFEDIHATYLLLGERKSDMDASEITMAQSLLSHSSINVSSSLGQHPAGVITREHVTSSSASGSSASPSRYSRSSATATGASITAGSALASAANAQKHQQSSAAPSSGSSSSRRSSQNDAAATAAGGTVVMSGTRHGGVQMRAQPTSRQATISLLQPPSYKPSSNTTQIAQIPPLFNRNSTATSSAAQPSTGITGTRKIADPKGRIPLNSTAVQGHRTATGAVAANNGGIPSHRDHAQQQQYMNQLTSSTMMSKLINKTPAAGGTAATSSSSSSSATSTAPLQKSGSQISHAPTEPVIREDDDENNSENQNGNVPLIGGVGPQTSPAVQVPTEDATSSSDKEQQQQKASSETPKESNPIVWQNLHLNSLLKSLLDSSAATSYETPRRPGIAGRRSEPSAATPRRRHQTMVVDARHLQTPPDTDRPYHFEDTTLDRQMRALYVSTASSRMTRGVLPTPPTSNSTSSSFIVEPLTHVAAASPDITTTTPTKSTVTTSPYFRRTPSFRMVLIVLLLCDNGLRLWPSMIHQSPSMPPSQMMTAMESLKLSESGQTGGPTVATGGPPQRATSQQMSRSATTNSANMGASSGGAAAAASATNQLSGAPSSTGASSQQYHPKAPSSSSSSSTNPPHQHQLTHNASFSVTPSSYQIPTSTAVNVTSTGMPTSSSSSAFPRNTRNRQTFHGKTEKDKGGDDSSDEIGETPGNVSIGATGPSANNAEATIWSKLSKLTRRDHNRESMTQPVSGRAGTIGASQGQQTAAALAAIREQSGPIAPGAGQVAPSLPIHEGDVKPRSLRFTWSMKTTSSLAPDDMMREIRKVLDANGCDYEQRERYMILCVHGDPNTDSLVQWEMEVCKLPRLSLNGVRFKRISGTSIGFKNIASKIAQELNL

SEQ ID NO: 19032 - protein, 385 aa, Arabidopsis thaliana
MAKSDMLPFLAMVLVQIGYAGMNITSKMAMEAENDEIIFININVKMNVKKNVVKKKKTKKWCRAIFICQDTKTRPKITLRILVQVFFCSITGATGNQVLYFVGLQNSSPTIACALTNLLPAVTFLLAAIFRQETVGIKKASGQAKVIGTLVCVIGAMVLSFYHGHTIGIGESKIHWAYAENITKHGSSSGHSNFFLGPFLIMAAAVSWAAWFIIQTKMSETFAAPYTSTLLMCLMGSIQCGAIALISDHTISDWSLSSPLRFISALYAGVVASALAFCLMSWAMQRKGPLYVSVFSPLLLVVVAIFSWALLEEKLYTGTFMGSALVVIGLYGVLWGKDREVSEKEEEREKVKQQNHKVKSESNEDIESRLPVASSGNGSTRSTSP

SEQ ID NO: 19033 - protein, 783 aa, Arabidopsis thaliana
MATLGDIGVAAAINILTAIIFLLAFAILRIQPFNDRVYFPKWYLKGIRSSPLHSGALVSKFVNVNLGSYLRFLNWMPAALKMPEPELIDHAGLDSAVYLRIYLIGLKIFVPIALLAWSILVPVNWTSHGLQLAKLRNVTSSDIDKLSISNIENGSDSLYFGRFWTHLVMAYAFTFWTCYVLMKEYEKVAAMRLAFLQNEQRRPDQFTNLGLSQLLSQVLVRNVPADPDESISDSVEHFFLVNHPDHYLTHQVVYNANDLAALVEQKKSTQNWLDYYQLKYTRNQEHKPRIKTGFLGLWGKKVDAIDHYIAEIEKLNEQERKKVKKDDTSVMPAAFVSFKTRWGAAVSAQTQQSSDPTEWLTEWAPEAREVFWSNLAIPYVSLTVRRLIMHIAFFFLTFFFMIPIAFVQSLASIEGIEKNAPFLKSIIENDLFKSVIQGFLPGIVLKLFLIFLPSILMVMSKFEGFVSLSSLERRAAFRYYIFNLINVFLGSVITGSAFEQLDSFLKQSAKEIPKTVGVAIPIKATFFITYIMVDGWAGIAGEILRLKPLIFFHIKNSLLVKTEKDREEAMNPGQINYHATEPRIQLYFLLGLVYAPVTPVLLPFIIIFFALAYLVFRHQIINVYNQEYESAARFWPDVHGRIISALIIAQILLMGLLSTKGAAQSTPFLLFLPIITFFFHRYCKGRYEPAFLRHPLKEAMVKDTLERAREPNFNLKPYLQKAYIHPVFKDNDYEDSRFDEISGYCIEDSDEECVTVPTKRQSRINTPAVSHASRGSSRSPPSK

SEQ ID NO: 19034 - protein, 596 aa, Arabidopsis thaliana
MEAKIVKVLDSSRCEDGFGKKRKRAASYAAYVTGVSCAKLQNVPPPNGQCQIPDKRRRLEGENKLSAYENRSGKALVRYYTYFKKTGIAKRVMMYENGEWNDLPEHVICAIQNELEEKSAAIEFKLCGHSFILDFLHMQRLDMETGAKTPLAWIDNAGKCFFPEIYESDERTNYCHHKCVEDPKQNAPHDIKLRLEIDVNGGETPRLNLEECSDESGDNMMDDVPLAQRSSNEHYDEATEDSCSRKLEAAVSKWDETDAIVVSGAKLTGSEVLDKDAVKKMFAVGTASLGHVPVLDVGRFSSEIAEARLALFQKQVEITKKHRGDANVRYAWLPAKREVLSAVMMQGLGVGGAFIRKSIYGVGIHLTAADCPYFSTNYELVYSARYCDVDENGVRYMVLCRVIMGNMELLRGDKAQFFSGGEEYDNGVDDIESPKNYIVWNINMNTHIFPEFVVRFKLSNLPNAEGNLIAKRDNSGVTLEGPKDLPPQLESNGARGSGSANSVGSSTTRPKSPWMPFPTLFAAISHKVAENDMLLINADYQQLRDKKMTRAEFVRKLRVIVGDDLLRSTITTLQNQPKSKEIPGSIRDHEEGAGGL

SEQ ID NO: 19035 - protein, 110 aa, Arabidopsis thaliana
MPVPLAPYPTPPAPALAPSYNTPPANGSTSGQSQLVCSGCRNLLMYPVGATSVCCAVCNAVTAVPPPGTEMAQLVCGGCHTLLMYIRGATSVQCSCCHTVNLALEGLHAY

SEQ ID NO: 19036 - protein, 131 aa, Arabidopsis thaliana
MGLSHFPTASEGVLPLLVMNTVVSITLLKNMVRSVFQIVASETESSMEIDDEPEDDFVTRRISITQFKSLCENIEEEEEEKGVECCVCLCGFKEEEEVSELVSCKHFFHRACLDNWFGNNHTTCPLCRSIL

SEQ ID NO: 19037 - protein, 204 aa, Arabidopsis thaliana
MMSSQTSSHNKLIKLPQRFFFLHKQFFLHKQILLFVVVMAPTVKTAAVKTNEGNGVRYRGVRKRPWGRYAAEIRDPFKKSRVWLGTFDTPEEAARAYDKRAIEFRGAKAKTNFPCYNINAHCLSLTQSLSQSSTVESSFPNLNLGSDSVSSRFPFPKIQVKAGMMVFDERSESDSSSVVMDVVRYEGRRVVLDLDLNFPPPPEN

SEQ ID NO: 19038 - protein, 565 aa, Arabidopsis thaliana
MNYSWITIMSLLVICKLASAKVVLIGKNTILSFDDVEATFTPIVRNSGECGILYVAEPLEACSDITNMAEKRSKYRSSYVLIVLGGCSFEEKVRKAQKAGYKAAIVYNDGYDELLVPRNSSGVDIHGLLVTRASGEVLKGYADQDEMKLWLIPGFGISSWSIMGITFISLLAMSAILATCFVVRRHQIRQSVRDLPHGGQGLSCMPRDLLQSMPTEVYSGVLEESSTSVTCAICIDDYCVGEKLRILPCKHKYHAVCIDSWLGRCRSFCPVCKQNPRTGNDVPPASETTPLISPSPNSITSLQSFYDLPIVVRLASSKVTLIGKNTFLSFDDVEANFTPVVRRSGEYGLLYAAEPLDACSYLTNMAEKGSKFRPSYVLIVRGGCSFEEKIRNAQEAGYKAAIVYNDRYEELLVRRNSSGVYIHGVLVTRTSGEVLKEYTSRAEMELLLIPGFGISSWSIMAITFVSLLVISAVLASYFSVRRHRIRQHVRDLHHGGQGHSRMPKDLLQSMPTEVYTGVLEEGSTSVTCAICIDDYRVGEILRILPCKHSKSHFVLFDLELVNYLS

SEQ ID NO: 19039 - protein, 329 aa, Arabidopsis thaliana
MAYQPPKQPMEREVFYCAVQYSKLITVISESISSDLEMDSRRMSRPRQIKFEEGWSNIQKGITKLIRILEGEPEPTFYFSECFKLYTIIYDMCVQRSDYSQQLYEKYRKVIEDYTIQTVLPSLREKHDEDMLRELVKRWNNHKIMVKWLSKFFVYIDRHLVRRSKIPIPSLDEVGLTCFLDLVGDEYSYSSLFFNAANVFVTIHANYLLQVYCEMQSTAKEVVIALVEECLKMERERVTHYLHSITEPKLVEKIQNELLVMVTKNRLENEHSGFSALLRDDKHITEEGNALIKQADDKTTNQLLIELHNKFIVYVIECFQNHTLFHKFL

SEQ ID NO: 19040 - protein, 223 aa, Arabidopsis thaliana
MVAPTEIKFEVEWSNIQQGFTKLIRMIEGESEPAFNQEIMMMMHTATYRICAYKNPQQLYDKYRELIENYAIQTVLPSLREKHDECMLRELAKRWNAHKLLVRLFSRRLVYLDDSFLSKKGLPSLREVGLNCFRDQVYREMQSMAAEAILALIHKEREGEQIDRELVRNVIDVFVENGMGTLKKYEEDFERLMLQDTASYYSSKASRWIQEESCLDYTLKAYL

SEQ ID NO: 19041 - protein, 568 aa, Arabidopsis thaliana
MFKILTTKIQSFFCLNISGGTEDGSIDIYGNPPSKKKTGNWKACPFILGNECCERLAYYGIAKNLITYYTSELHESNVSAASDVMIWQGTCYITPLIGAVIADSYWGRYWTIASFSAIYFIGMALLTLSASLPVLKPAACAGVAAALCSPATTVQYAVFFTGLYLIALGTGGIKPCVSSFGADQFDDTDPRERVRKASFFNWFYFSINIGSFISSTLLVWVQENVGWGLGFLIPTVFMGVSIASFFIGTPLYRFQKPGGSPITRVCQVLVAAYRKLKLNLPEDISFLYETREKNSMIAGSRKIQHTDAAVISEYESKSGAFSNPWKLCTVTQVEEVKTLIRMFPIWASGIVYSVLYSQISTLFVQQGRSMNRIIRSFEIPPASFGVFDTLIVLISIPIYDRFLVPFVRRFTGIPKGLTDLQRMGIGLFLSVLSIAAAAIVETVRLQLAQDFVAMSIFWQIPQYILMGIAEVFFFIGRVEFFYDESPDAMRSVCSALALLNTAVGSYLSSLILTLVAYFTALGGKDGWVPDDLNKGHLDYFFWLLVSLGLVNIPVYALICVKHTKKKAL

SEQ ID NO: 19042 - protein, 2698 aa, Arabidopsis thaliana
MNHLIVFLIVISIYFGLNESWTVVPWGCKDNTLEFRNELAPNSILKVNCTSKDNTISVHDVLFNDASSAVSSPETAKNSDEPPPISSEAVNVLFPSVDPNSKLFRNSLNITISREAPPLTTSRIDRSKPDFAGKEIRSKVGTLFISHRDENMYKSGQTGIKKDERWCLLSESSHRDEEEEEASPFYPFTIVLTYQPGPGQSPWKEMASPLESLLSISGSVSTSSTLIRLRIFRHDIPEILQNSDMTSDIAPVIVDMIFQTLAIYDDRASRKAVDDLIVKGLGNVTFMKTFAAMLVQVMEKQLKFCFDTSQAIYSLYMDEVKGSRIPYKDSPELLGLLLEFSCSSPALFEQSKAIFVDIYVKDVLNSREKQKPNLSNCFKPLLQRLSHEEFQTVILPAAVKMLKRNPEIVLESVGFLLANVNIDLSKYALELLPVILPQARHTDEDRRLGALSMVMCLSEKSSNPDTIEAMFASVKAIIGGSEGRLQSPHQRIGMLNAVQELASAPEGKYIGSLSRTICSFLIACYKDEGNEDVKLSILSAVASWASRSSVAIQPNLVSFIAAGLKEKEALRRGHLRCVRIICRNPDTISQISDLLSPLIQLVKTGFTKAVQRLDGIYALLIVSKIAACDIKAGSNQQLMFHIPLIQYNLKASKLSSDDCVVCVDLLEVLLVEHSSRVLEAFSLKSLSQLLLFLLCHPSWNVRKTAYNSVTKIFLATSQLATTLLDEFSDFLSITGDQIVSSRTSDADNPADHQAPFVPSVEVLVKALIVISSAAVAGPPSSWIVRAIFCSHHPSIVGTGKRDAVWKSLLGPMGLTSAKTPEQQAAVYSLSTMMSLAPEDTFTVFKMHLQDLPDRLSHDMLSETDIKIFHTPEGMLLSEQGVYVAQTIGAKYTKQEPSSNHSLKKGLASRETANSGRRDTAKLTKKADKGKTAKEEARELMLKEEASTRENVHRIQKSLSLVLHALGEMGLANPVFCHSQLPFLATFLDPLLRSPIVSAAAFENLVKLARCTVQPLCNWALEISTALRLIAIDEVDTSFDFRPSVDKAGKTYEGLFERIVNGLSISCKSGPLPVDTFTFIFPVLYHVLGVVPAYQASVGPALNELCLGLQADDVANALYGVYSKDVHVRLACLNAVKCIPAVSKCSLPQNVKIATNIWIALHDPEKSVAESADDLWARYGHDLGTDYSGIFKALSHINLNVRLAAAEALADALHESPSSIQLSLSTLFSLYIRDATSGEDVFDAGWIGRQGIALALQSAADVLTTKDLPAVMTFLISRALADPNTDVRGKMINAGIMIIDKHGKENVSLLFPIFENYLNKEASDEEEYDLVREGVVIFTGALAKHLARDDPKVHNVVEKLLEVLNTPSESVQRAVSTCLSPLVLSKQLMKSDKYGERRGAAFGLAGVVMGFGISSLKKYGLIVTLQEALIDRNSAKRREGALLAFECLCEKLGKLFEPYVIKMLPLLLVSFSDQVGAVREAAECAARAMMSQLSAYGVKLVLPSLLKGLEDKAWRTKQSSVQLLGAMAFCAPQQLSQCLPRVVPKLTEVLTDTHPKVQSAGQLALQQVGSVIKNPEISSLVPTLLLALTDPNEYTRHALDTLLQTTFVNSVDAPSLALLVPIVHRGLRERSSETKKKASQIVGNMCSLVTEPKDMIPYIGLLLPEVKKVLVDPIPEVRSVAARAVGSLIRGMGEDNFPDLVPWLFETLKSDTSNVERYGAAQGLSEVIAALGTDYFENILPDLIRHCSHQKASVRDGYLTLFKFLPRSLGAQFQKYLQLVLPAILDGEPIFFGRLLTSELPFDSLTKLVVLYDVLGLADENESVRDAALGAGHVLVEHHATTSLPLLLPAVEDGIFNDNWRIRQSSVELLGDLLFKVAGTSGKALLEGGSDDEGASTEAQGRAIIDILGMDKRNEVLAALYMVRTDVSLSVRQAALHVWKTIVANTPKTLKEIMPILMSTLISSLASPSSERRQVAGRSLGELVRKLGERVLPLIIPILSKGLKDPDVDKRQGVCIGLNEVMASAGRSQLLSFMDQLIPTIRTALCDSALEVRESAGLAFSTLYKSAGLQAMDEIIPTLLEALEDDEMSTTALDGLKQIISVRTAAVLPHILPKLVHLPLSALNAHALGALAEVAGAGFNTHLGTILPALLSAMGGENKEVQELAQEAAERVVLVIDEEGVETLLSELLKGVSDSQASIRRSSAYLIGYFFKSSKLYLIDEAPNMISTLIVMLSDSDSTTVAVSWEALARVIGSVPKEVLPSYIKLVRDAVSTARDKERRKRKGGYVVIPGLCLPKSLKPLLPVFLQGLISGSAELREQAAIGLGELIEVTSEQALKEFVIPITGPLIRIIGDRFPWQVKSAILATLIILIQRGGMALKPFLPQLQTTFVKCLQDSTRTIRSSAAVALGKLSALSTRIDPLVGDLMTSFQAADSGVREAILSAMRGVIKHAGKSIGPAVRVRIFDLLKDLMHHEDDQVRISATSMLGVLSQYLEAAQLSVLLQEVNDLSASQNWGARHGSVLCISSLLKHNPSTIMTSSLFSSMLNSLKSSLKDEKFPLRESSTKALGRLLLKQLATDPSNTKVVIDVLSSIVSALHDDSSEVRRRALSSLKAFAKDNPSATMANISVIGPPLAECLKDGNTPVRLAAERCALHVFQLTKGAENVQAAQKYITGLDARRLSKFPEQSDDSESDDDNVSG

SEQ ID NO: 19043 - protein, 778 aa, Arabidopsis thaliana
MATLADIGLAAAINILSALIFLLLFAILRIQPFNDRVYFPKWYLKGVRSSPVNSGAFVSKIMNLDFRSYVRFLNWMPDALKMPEPELIDHAGLDSAVYLRIYLIGLKIFGPIALLSWSILVPVNWTSDGLQLAKLRNVTSSNIDKLSISNVERGSDRFWAHLVMAYAFTFWTCYVLMKEYEKIAAMRLSFLQSEKRRADQFTVLVRNVPPDSDESISENVQHFFLVNHPDHYLTHQVVYNANELAKLVEDKKKMQNWLDYYQLKYTRNKEQRPRVKMGFLGLWGKKVDAMDHYTAEIEKLSEQIMEERKRIKKDDKSVMQAAFVSFKTRWGAAVCAQTQQTKNPTEWLTEWAPEAREMYWPNLAMPYVSLTVRRFVMHIAFFFLTFFFIIPIAFVQSLASIEGIEKSAPFLSPIVKNKLMKSLIQGFLPGIVLKLFLIFLPTILMIMSKFEGFISISSLERRAAFRYYIFNLVNVFLGSVITGSAFEQLDSFLKQSANDIPRTVGVAIPIKATFFITYIMVDGWAGVAGEIFRLKPLVIFHLKNFFFVKTEKDREEAMDPGQIDFYATEPRIQLYFLLGLVYAPVTPVLLPFIIFFFGFAYLVFRHQIINVYNQKYESAGAFWPDVHGRIISALIISQILLLGLMSTKGKVQSTPFLLVLAILTFGFHRFCKGRYESAFVINPLQEAMIKDTLERAREPNLNLKGFLQNAYVHPVFKDEEDSDEEGLIEDSDDEDCVVVQTKRQRSRRTTVASSNASRGSSQSTPFNQLDLGKGKPET

SEQ ID NO: 19044 - protein, 491 aa, Arabidopsis thaliana
MTILVVDRYYMLMNLLFALTCLLLNLTHCFSPKKFNISAATTSDSDWSIAGSTWYGNPTGYGSDGGACGYGNAVAQPPFSKMVSAGGPSLFKSGKGCGACYQVKCTSKSACSKNPVTVVITDECPGCVKESVHFDLSGTAFGAMAISGQDSQLRNVGELQILYKKVECNYIGKTVTFQVDKGSNANSFAVLVAYVNGDGEIGRIELKQALDSDKWLSMSQSWGAVWKLDVSSPLRAPLSLRVTSLESGKTVVASNVIPANWQPGGACGFAVANPPLYGMVSAGGPSVFNNGIGCGTCFQILCNGHPACSRRPITVTITDECPGGPCASEPAHFDLSGKAMGALARPGQGDRLRSAGVLRVYYRRYLYTYIIFVLKFFLLVCISSVECLYRRTNIAFRMDPGANPYYISFVVEYENGDGDLAYIEIQPADGEFIPMQEMRSAVWKISSGSPLTGPFNIRLTSAESHKVVLAYNVIPANWKPNETYRSVVNFK

SEQ ID NO: 19045 - protein, 355 aa, Arabidopsis thaliana
MADNTDNRRSLWGVPEKLQLHIAMLTLQFGYAGFHVVSRAALNMGISKLVFPVYRNIIALLLLLPFAYFLEKKERPAITLNFLIQFFFLALIGEPRILLVGTGQHFTNICFLHAKLSLCVAGASVITLYKGPTIYTPASHLHAHLLTTNSAVLAPLGNAAPKNWTLGCIYLIGHCLSWSGWLVFQAPVLKSYPARLSVTSYTCFFGIIQFLIIAAFCERDSQAWVFHSGWELFTILYAGIVASGIAFAVQIWCIDRGGPVFVAVYQPVQTLVVAIMASIALGEEFYLGGIIGAVLIIAGLYFVLYGKSEERKFAALEKAAIQSSAEHGIERAPVSRNSIKSSITTPLLHQSTDNV

SEQ ID NO: 19046 - protein, 388 aa, Arabidopsis thaliana
MSLKNIVKNKYKAIGRRGRSHIAPEGSSVSSSLSTNEGLNQSIWVDLPPELLLDIIQRIESEQSLWPGRRDVVACASVCKSWREMTKEVVKVPELSGLITFPISLRQPGPRDAPIQCFIKRERATGIYRLYLGLSPALSGDKSKLLLSAKRVRRATGAEFVVSLSGNDFSRSSSNYIGKLRSNFLGTKFTVYENQPPPFNRKLPPSMQVSPWVSSSSSSYNIASILYELNVLRTRGPRRMQCIMHSIPISAIQEGGKIQSPTEFTNQGKKKKKPLMDFCSGNLGGESVIKEPLILKNKSPRWHEQLQCWCLNFKGRVTVASVKNFQLVAAAAEAGKNMNIPEEEQDRVILQFGKIGKDIFTMDYRYPISAFQAFAICLSSFDTKPVCE

SEQ ID NO: 19047 - protein, 389 aa, Arabidopsis thaliana
MAKMINKTLVLTYIYLLIYIILSSGVILYNKWVLSPKYFNFPLPITLTMIHMGFSGFVAFLLIRVFKVQRLHFHLSECYICPLVWSMLHARLMLSTPYNRYVTCVVPISAFFASSLWFGNTAYLHISVAFIQMLKALMPVATFLMAVVCGTDKARCDVFMNMVLVSVGVVVSSYGEINFNVIGTVYQVMGIFAEALRLVLTQVLLQKKGLTLNPVTSLYYIAPCSFVFLSLPWYVLEKPNIDVSQIQFNFWIFFSNALCALALNFSIFLVIGRTGAVTIRVAGVLKDWILIALSTVIFPESTITGLNITGYAIALCGVVMYNYIKIKDVKAIQPTTDSLPDRITKDWKEKNSSDGGSPRGLELNDEEAPLITSRLSHIGRTQLGNHTAV

SEQ ID NO: 19048 - protein, 318 aa, Arabidopsis thaliana
MGAPKQKWTQEEESALKSGVIKHGPGKWRTILKDPEFSGVLYLRSNVDLKDKWRNMSVMANGWGSREKSRLAVKRTFSLPKQEENSLALTNSLQSDEENVDATSGLQVSSNPPPRRPNVRLDSLIMEAIATLKEPGGCNKTTIGAYIEDQYHAPPDFKRLLSTKLKYLTSCGKLVKVKRKYRIPNSTPLSSHRRKGLGVFGGKQRTSSLPSPKTDIDEVNFQTRSQIDTEIARMKSMNVHEAAAVAAQAVAEAEAAMAEAEEAAKEAEAAEAEAEAAQAFAEEASKTLKGRNICKMVKKRKKHPYSFISQDIISMREL

SEQ ID NO: 19049 - protein, 294 aa, Arabidopsis thaliana
MPISEKSSATNTRLVVKKLFARQLHEGFGAVVRRSIGRFEFRYFDPFLVLDEFSVSAPAGFPDHPHRDCEGHKGVIREGGLQWMTAGKGIVHSEMPSSNSNGITHNKGLQLWINLSSRQKLVEPSYQEIESKDIAETEKDGVRVRVIAGEWNGVKSKICTRTPTMYLDFTLSPGSRISQPIPLHWNAFVYVLQGHGHFGDSKLQHSAAAAHHLLVLGLGGDMLEAWNGSDSGLPLRFILVAGEPIGEPMVQFGPFVMNTQEEIDETIDDFENFRNGFEKARHWKSQAASALGLF

SEQ ID NO: 19050 - protein, 526 aa, Arabidopsis thaliana
MEATQKHMIQEGSSMFYHQPSSVKQMDLSVQTFDSYCTLESSSGTKSHPCLNNKNNSSSTTSFSSNESPISQANNNNLSRFNNHSPEENNNSPLSGSSATNTNETELSLMLKDLETAMMEPDVDNSYNNQGGFGQQHGVVSSAMYRSMEMISRGDLKGVLYECAKAVENYDLEMTDWLISQLQQMVSVSGEPVQRLGAYMLEGLVARLASSGSSIYKALRCKDPTGPELLTYMHILYEACPYFKFGYESANGAIAEAVKNESFVHIIDFQISQGGQWVSLIRALGARPGGPPNVRITGIDDPRSSFARQGGLELVGQRLGKLAEMCGVPFEFHGAALCCTEVEIEKLGVRNGEALAVNFPLVLHHMPDESVTVENHRDRLLRLVKHLSPNVVTLVEQEANTNTAPFLPRFVETMNHYLAVFESIDVKLARDHKERINVEQHCLAREVVNLIACEGVEREERHEPLGKWRSRFHMAGFKPYPLSSYVNATIKGLLESYSEKYTLEERDGALYLGWKNQPLITSCAWR

SEQ ID NO: 19051 - protein, 763 aa, Arabidopsis thaliana
MKGSSESSSRGLNNTSGVSEFCTDGSKSLSHIDYVRSLLGSHKEANLGGLDDDSIVRALECEDVSLRQWLDNPDRSVDAFECFHVFRQIVEIVNAAHSQGIVVHNVRPSCFVMSSFNNVSFIESASCSDSGSDEDATTKSREIGSSRQEEILSERRSKQQEEVKKQPFPMKQILAMEMSWYTSHEEDNGSLCNCASDIYRLGVLLFEILLNWPKEASFCLWLLHPEPSCRPSMSELLQSEFINEPRENLEEREAAMELRDRIEEQELLLEFLFLIQQRKQEAADKLQDTISLLSSDIDQVVKRQLVLQQKGRDVRSFLASRKRIRQGAETTAAEEENDDNSIDEESKLDDTLESTLLESSRLMRNLKKLESVYFATRYRQIKAATAAEKPLARYYSALSCNGRSSEKSSMSQPSKDPINDSRQGGWIDPFLEGLCKYLSFSKLRVKADLKQGDLLNSSNLVCAIGFDRDGEFFATAGVNKKIKIFECESIIKDGRDIHYPVVELASRSKLSGICWNSYIKSQVASSNFEGVVQVWDVARNQLVTEMKEHEKRVWSIDYSSADPTLLASGSDDGSGVSIGTIKTKANICCVQFPSETGRSLAFGSADHKVYYYDLRNPKLPLCTMIGHHKTNFVGLSVSDGYIATGSETNEVCLLSLHKYTKEELLIPFVNKNREFRVLHWTGFCVPQGISNAGFVVQVQNYRPCVGTRSRRCLAVHILSLLAGTVVDLSCCKLHRQYQDFGDGMNQYKVAQKQNGNIPGFGLV

SEQ ID NO: 19052 - protein, 478 aa, Arabidopsis thaliana
MDLSSQRQSPNGSRGFRLQAPLVDSVSCYCRVDSGLKTVVEARKFVPGSKLCIQPDINPNAHRRKNSKRERTRIQPPLLPGLPDDLAVACLIRVPRAEHRKLRLVCKRWYRLASGNFFYSQRKLLGMSEEWVYVFKRDRDGKISWNTFDPISQLWQPLPPVPREYSEAVGFGCAVLSGCHLYLFGGKDPLRGSMRRVIFYNARTNKWHRAPDMLRKRHFFGCCVINNCLYVAGGECEGIQRTLRSAEVYDPNKNRWSFIADMSTAMVPLIGVVYDKKWFLKGLGSHQLVMSEAYDPEVNSWSPVSDGMVAGWRNPCTSLNGRLYGLDCRDGCKLRVFDESTDSWNKFMDSKAHLGNSKSLEAAALVPLHNKLCIIRNNMSMSLVDVSNPDKNNPRLWENIACFKRDKNVLKLNNGANVQKKSATLSFQEGYISDSRTVSVFQSHAKENSRLAFNRSQARRRESKTVRWVTFVHHFFWC

SEQ ID NO: 19053 - protein, 1092 aa, Arabidopsis thaliana
MAEENRKDRGVSSTVAIPSGLNRIKTRLASSGPRPEDSSDTVLKPPFNRNQKTIVPRGHGRTTGSSKQERKGTKLSRWLASYKPKYSCHPPKYACSSTTSSEEIKLRGKNSGKDEEKMIKISETNPPCSKSMGIKSFSHELGPRGGVQTPYPRPHSYNDLKELLGSLHSRFDVAKETVDKKLDVFVRDVKEAMEKMDPSCPEDREMAEQLLDVARACMEMTSAQLRATCESIVQDLTRKRKQCQAGLVKWLFSQLLFILTHCTRVVMFQKETEPIDESSFRKFKECLERIPALETDWGSTPRVDDSGSGYPEYQRNEAGQKFKRRDKESLESETALDYVVPNDHGNNAAREGYAAAKQEFPSHEPQFDSKVVEQRFYLSDEYEDKMSNEPGKELGGSDYVICRICEEEVPLFHLEPHSYICAYADKCEINCVDVDERLLKLEEILEQIIDSRSLNSFTQAGGLENSVLRKSGVASEGCSPKINEWRNKGLEGMFEDLHEMDTAFIDESYTYPIHLKSHVGAKFCHHATSSSTGSITSVSSTNTPRTSHFDSYWLERHCPEQEDLRLMMDLSDIARCGASTDFSKEGSCDYIMACMQDIQAVLKQGKLKALVIDTFGGRIEKLLCEKYLHARELTADKSSVGNIKESEDVLEHASATPQLLLKDRISIDDFEIIKPISRGAFGKVFLARKRTTGDFFAIKVLKKLDMIRKNDIERILQERNILITVRYPFLAEHLMLLMQVRFFYSFTCRDNLYLVMEYLNGGDLYSLLQKVGCLDEEIARIYIAELVLALEYLHSLKIVHRDLKPDNLLIAYNGHIKLTDFGLSKIGLINNTIDLSGHESDVSPRTNSHHFQKNQEEERIRHSAVGTPDYLAPEILLGTEHGLDTTFKSGFHEAPVNCYAADWWSAGIVLFELLTGIPPFTASRPEKIFDNILNGKMPWPDVPGEMSYEAQDLINRLLVHEPEKRLGANGAAEVKSHPFFQGVDWENLALQKAAFVPQPESINDTSYFVSRFSESSCSDTETGNNSGSNPDSGDELDECTNLEKFDSPPYYLSLINFSFKNLSQLASINHDVLLQKDPAKGGGDSPFKSHGT

SEQ ID NO: 19054 - protein, 374 aa, Arabidopsis thaliana
MYGVNVMQVFQECQTRDASGNSFELSMVGCKCIGAYVKNKKNQNQICWIWQKVSVENDKDFQRFLDNVQYKSSGILRYERVFGEGYVSTGGFGNSILTLLSSYGHTYLYCLSVIFMFLFSLTETTKEFVAKMDLKPGQKVLDVGCGIGGGDFYMAENFDVHVVGIDLSVNMISFALERAIGLKCSVEFEVADCTTKTYPDNSFDVIYSRDTILHIQDKPALFRTFFKWLKPGGKVLITDYCRSAETPSPEFAEYIKQRGYDLHDVQAYGQMLKDAGFDDVIAEDRTDQFVQVLRRELEKVEKEKEEFISDFSEVKTFLTTNSFEQNTCLLCSHIDHKILLLQEDYNDIVGGWSAKLERTASGEQKWGLFIADKK

SEQ ID NO: 19055 - protein, 524 aa, Arabidopsis thaliana
MSLWIELYQRASAASEMGQRNRNVDLEMEQQQSQASLQAEPCILLGSFPQQPDNNNMPAMVAHVPNLEPHSLQDPTYDNSAMFYGLPQYHHHPHQRVPTNFYVPYVAFQAPPGQLPSSSSHGVVGVSPDHEYERNAHFMDHTRGTYKRKNAEGIPGQPQYLSTLAAPFNTPETIAPFGGARNRPGAVTVNTVLPSHAPNNFIQGNYAGHHPFPPPGSMWYDQHHGRSDGSPSFWPTPYMHGSNIFAGSIESSSRNPTSFMYPSQLNPRDHYYSHHHHPAPPPVQGMRGQNATLYPHTASSASYRVPPGSFTPQNTMNSGPLGSEMGSSHMGPVQPTGFRIYQHHQRDDSVPVATLRQHRGGVPRLRVMPDDEVALLEFGDFLGGSGNNHIDHHRDMRLDIEEMSYELGFCLSDLSLGFEQELLALSERIGTVNTGLPEEDVKNHLKTRTCSGINFEKESSSPRTKDLETEPCTICQESFKNEEKIATLDCGHEYHAECLEKWLIVKNVCPICKSEALVMEKRKV

SEQ ID NO: 19056 - protein, 424 aa, Arabidopsis thaliana
MRNNITLSFDDIEANFAPSVKGTGEIGVVYVAEPLDACQNLMNKPEQSSNETSPFVLIVRGGCSFEEKVRKAQRAGFKAAIIYDNEDRGTLIAMAGNSGGIRIHAVFVTKETGEVLKEYAGFPDTKVWLIPSFENSAWSIMAVSFISLLAMSAVLATCFFVRRHRIRRRTSRSSRVREFHGMSRRLVKAMPSLIFSSFHEDNTTAFTCAICLEDYTVGDKLRLLPCCHKFHAACVDSWLTSWRTFCPVCKRDARTSTGEPPASESTPLLSSAASSFTSSSLHSSVRSSALLIGPSLGSLPTSISFSPAYASSSYIRQSFQSSSNRRSPPISVSRSSVDLRQQAASPSPSPSQRSYISHMASPQSLGYPTISPFNTRYMSPYRPSPSNASPAMAGSSNYPLNPLRYSESAGTFSPYASANSLPDC

SEQ ID NO: 19057 - protein, 576 aa, Arabidopsis thaliana
MGGGGNLVDGVRRWLFFQRRPSSSSSSNNHDQIQNPPTVSNPNDDEDLKKLTDPSKLRQIKVQQRNHLPMEKKGIPNAEFFTEYGEANRYQIQEVVGKGSYGVVGSAIDTHTGERVAIKKINDVFDHISDATRILREIKLLRLLLHPDVVEIKHIMLPPSRREFRDVYVVFELMESDLHQVIKANDDLTPEHHQFFLYQLLRGLKYVHAANVFHRDLKPKNILANADCKLKICDFGLARVSFNDAPTAIFWTDYVATRWYRAPELCGSFFSKYTPAIDIWSVGCIFAEMLLGKPLFPGKNVVHQLDIMTDFLGTPPPEAISKIRNDKARRYLGNMRKKQPVPFSKKFPKADPSALRLLERLIAFDPKDRPSAEEALADPYFNGLSSKVREPSTQPISKLEFEFERKKLTKDDIRELIYREILEYHPQMLEEYLRGGNQLSFMYPSGVDRFRRQFAHLEENQGPGGRSNALQRQHASLPRERVPASKNETVEERSNDIERRTTAAVASTLDSPKASQQAEGTENGGGGGYSARNLMKSSSISGSKCIGVQSKTNIEDSIVEEQDETVAVKVASLHNS

SEQ ID NO: 19058 - protein, 580 aa, Arabidopsis thaliana
MNCAISGEVPEEPVVSKKSGLLYEKRLIQTHISLFSLLHLSICCRYFLNTDFVVIIYRLLLVPCRIMGNARLLVSHILLMTLFPSKLGRNLFKPDSISGTILQIVKPKPLHTASIPGLLGTFQTDHIELKWMNLIWEWDSLMLSNFALEQQLHTARQELSHALYQVIDGGYTFPLQHDAACRVIARLKKERDESRQLLAEAERQLPAAPEVATSNAALSNGKRGMLARLLLNVSWLCGIDDGEQGPNAKKMRLGISAEVITELTDCNAALSQQRKKRQIPKTLASVDALEKFTQLSSHPLHKTNKPGIFSMDILHSKDVIATGGIDTTAVLFDRPSGQILSTLTGHSKKVTSIKFVGDTDLVLTASSDKVTDASENDVNYTAAAFHPDGLILGTGTAQSIVKIWDVKSQFVLTSLSSLSLSFDRQMWQSLVDTMEKSPLYHSLKTTAALDGVRLWDLRKLKNFRTFDFPDANSGEVYFDTQCWELIDIGAHFDNEILKDSCANSINLLSPEMQFGVFQAASVKAEWNPIKTLPDLSGTGKATSVKFGLDSKYIAVGSMDRNLRIFGLPDDDNTEDSAQDS

SEQ ID NO: 19059 - protein, 255 aa, Arabidopsis thaliana
MTKLAIIPCTVLLETLFFRKKFSRKIQFSLTILLLGVGIATVTDLQLNMLGSVLSLLAVVTTCVAQIMTNTIQKKFKVSSTQLLYQSCPYQAITLFVTGPFLDGLLTNQNVFAFKYTSQVVFFIVLSCLISVSVNFSTFLVIGKTSPVTYQVLGHLKTCLVLAFGYVLLRDPFDWRNILGILVAVIGMVVYSYYCSIETQQKASETSTQLPQMKESEKDPLIAAENGSGVLSDGGGGVQQKTVAPVWNSNKDFQA

SEQ ID NO: 19060 - protein, 510 aa, Arabidopsis thaliana
MDINRWSLQGMTALVTGGSKGIGYAIVEELVGFGARVHICDIDETLLNECLSGWHAKGFEVSGSICDVSSRPQRVQLMQTVSSLFGAKLNILINNVGKYILKPTLESTAEDFSSLMATNLESAYYISQLAHPLLKASGNGNIVFISSVTGVVSGTSTIYGVTKGALNQLARDLACEWASDNIRANSVAPWVTATSLVQKYLEDEIFAEAMFSRTPLGRACEPREVASLVTFLCLPAASYITGQTICIDEQSQRWSLKAKTVLVTGGTKGIGHAIVEEFAGFGAVIHTCARNEYELNECLSKWQKKGFQVTGSVCDASLRPEREKLMQTVSSMFGGKLDILINNLGAIRSKPTLDYTAEDFSFHISTNLESAYHLSQLAHPLLKASGCGNIIFMSSIAGVVSASVGSIYSATKGALNQLARNLACEWASDGIRANAVAPAVIATPLAEAVYDDEFKKVVISRKPLGRFGEPEEVSSLVAFLCMPAASYITGQTICVDGGLTVNGFSYQPQG

SEQ ID NO: 19061 - protein, 446 aa, Arabidopsis thaliana
MASIPPPELDNDSLASSPRSEYDSQPRVRFMCTFGGRILPRPPDNQLCYVGGDNRMVAVHRHTTFASLLSKLAKLSGKSNISVKYQLPNEDLDALISVSTDEDVENMMDEYDRVAQNQNPRASRLRLFLFTKNVAGEEDNDSRASSISSLLDSSVNREQWFLDALNLGSSAAATAVSNGGSGRVFERVRSEVSSIVSEVPDYLFGLDNFDETAPPHELRDRDPRAKIQREVSTLSDPGSPRRDVPSPYGSTSSAPVMRISTPELPPPVFIKPESPEPVSTPKSNPQPEQVMQQSNLPVNSQWQYAPGPGQQVHYQGHTIHQSPVYYVPGSVPGNHMVQQGNHMVQPGNHMVQPVQMPGQYLQQYHHVPMGYHQPQTHQMAGPGQVYGGTVRPVMMAVDGMNRTGYYGMKTPGPVQMYQHHTGMVVPGVEEQQQYRTETDSDTGRAS

SEQ ID NO: 19062 - protein, 314 aa, Arabidopsis thaliana
MNSFSAFSEMFGSDYESSVSSGGDYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWDPFLEWNLHYVCKTEKRGKTKQISSVKKVYLSTLPENSTHGGVRRVFRPKRRLEEMKMKRRGQKIEMVVEQKKSKEDEDALSLSQGGEEEKRYEEEPYFC

SEQ ID NO: 19063 - protein, 415 aa, Arabidopsis thaliana
MFPCRTPPNWWTEELCILDVDFFSDVVSSMKQRGVKPSSLASAIITYTEKSLRDLVRDHSGRGVKYSDPGDNESDERSQQRDLVQSIVSLLPSDKGLFPVNFLCSLLRCAVFLDTSLTCKNELEKRISVVLEHVSVDDLLIPSFTYDGERLLDLDSVRRIISAFVEKEKNVGVFNGGDFNRGVCSVSLQRVAKTVDSYLAEIATYGDLTISKFNAIANLVPKSARKSDDDLYRAIDIFLKAHPNLDEIEREKVCSSMDPLKLSYDARLHASQNKRLPVNIVLHALYYDQLKLRSGVAEQEERAVVVLPEALKTRSQLQADTTLAKENEALRSELMKMKMYVSDMQKNKNGAGASSSNSSSLVSSKKSKHTFFSSVSKKLGKLNPFKNGSKDTSHIDEDLGGVDITKPRRRRFSIS

SEQ ID NO: 19064 - protein, 237 aa, Arabidopsis thaliana
MKIQCDVCEKAPATLICCADEAALCAKCDVEVHAANKLASKHQRLFLDSLSTKFPPCDICLEKAAFIFCVEDRALLCRDCDEATHAPNTRSANHQRFLATGIRVALSSTSCNQEVEKNHFDPSNQQSLSKPPTQQPAAPSPLWATDEFFSYSDLDCSNKKEQLDLGELDWLAEMGLFGDQPDQEALPVAEVPELSFSHLAHAHSYNRPMKSNVPNKKQRLEYRYDDEEEHFLVPDLG

SEQ ID NO: 19065 - protein, 540 aa, Arabidopsis thaliana
MNCAISGEVPVEPVVSTKSGLLFERRLIERHISDYGKCPVTGEPLTIDDIVPIKTGEIIKPKTLHTASIPGLLGTFQNEWDGLMLSNFALEQQLHTARQELSHALYQHDSACRVIARLKKERDEARQLLAEVERHIPAAPEAVTANAALSNGKRAAVDEELGPDAKKLCPGISAEIITELTDCNAALSQKRKKRQIPQTLASIDTLERFTQLSSHPLHKTNKPGICSMDILHSKDVIATGGVDATAVLFDRPSGQILSTLTGHSKKVTSVKFVGDSDLVLTASADKVRAVTVHPTNKYFVSASLDGTWCFYDLSSGSCLAQVSDDSKNVDYTAAAFHPDGLILGTGTSQSVVKIWDVKSQANVAKFDGHTGEVTAISFSENGYFLATAAEDGVRLWDLRKLRNFKSFLSADANSVEFDPSGSYLGIAASDIKVYQTASVKAEWNLIKTLPDLSGTGKATCVKFGSDAQYVAVGSMDRNYGYLVFLVMKKPTSMMTLRKTREQSVKNSDRTFQMSISSVISLKFLKFCCILQYLQQWGRIS

SEQ ID NO: 19066 - protein, 480 aa, Arabidopsis thaliana
MEAKIVKVSDSSYKDGLGKKRKHPGNYTPYDSGRSYAKLQWVLSPNSSTQKLEKRRNLDGENKVIVSENHVEKSLVRYFSYYKKTGVPKRVMFHENGEWIDLPDHILCDIRNDLEAKRATIEFNWCGRHFLLDFLHMYRLDLETGVKTQLAWIDIAGKCFFPETFDTLERDGCHHIRGEDPEQHDQREIKLHIEIDVNSGELPRLNLNVVTDESGDNMDDFQAVQRSSNGPNDEASEDSCSRELDDAVEKWDKTETDRFSGVKPAEEELDKDAVKQMFALGAATLGHVESLDVYQFSSEIAKARLSLFQKQADITKKHRGDANIRYAWVPAKKEVLSAVMMHGLGVGGAFIKKSMYGVGVHAANCPYFSARYCDIDDNGVRHMVLCRVIMGNMEPLRGDNTQYFTGGEEYDNGVDDVESPKHYLIWNMNMNTHIYPEFVVSFKLSIPNAEGDYHLSQEGYQMEVQGAKRIAPAVEGPDLL

SEQ ID NO: 19067 - protein, 347 aa, Arabidopsis thaliana
MSVGTEITYGNSMVPDHGWVEALNNKWDLGIVKQEASNFPELKLQAETEQRPHKVSFYVEKSKAQEVTKELSQRFLKRGLDVKIIYSGGMDLDILPQGAGKGQALAYLLKKLKTEGKLPVNTLACGDSGNDAELFSIPDVYGVMVSNAQEELLKWHAENAKDNPKVIHAKERCAGGIIQAIGHFKLGPNLSPRDVSDFLEIKVENVNPGHEVVKFFLFYERWRRGEVENSEAYTASLKASVHPGGVFVHPSGTEKSLRDTIDELRKYHGDKQGKKFRVWADQVLATDTTPGTWIVKLDKWEQDGDERRCCTTTVKFTSKEGEGLVWEHVQQTWSKETMVKDDSSWII

SEQ ID NO: 19068 - protein, 369 aa, Arabidopsis thaliana
MSLPEKGNIVRSKRQLERRAKNRRAPKSNDVDDEGYVPQKTSAKKKYKQGADNDDALQLFLWGPETKQLLTAKEEAELISHIQHLLKLEKVKTKLESQNGCEPTIGEWAEAMGISSPVLKSDIHRGRSSREKLITANLRLVVHIAKQYQNRGLNFQDLLQEGSMGLMKSVEKFKPQSGCRFATYAYWWIRQSIRKSIFQNSRTIRLPENVYMLLGKVSEARKTCVQEGNYRPSKEELAGHVGVSTEKLDKLLYNTRTPLSMQQPIWSDQDTTFQEITPDSGIETPTMSVGKQLMRNHVRNLLNVLSPKERRIIKLRFGIDGGKQRSLSEIGEIYGLSKERVRQLESRALYRLKQNMNSHGLHAYADLLV

SEQ ID NO: 19069 - protein, 178 aa, Arabidopsis thaliana
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREGDTKGSAKGGDPNAKKDGQSSQNGQFSQLAHQGPYGNSQVTFPLFSSHSSNTHHSLLIC

SEQ ID NO: 19070 - protein, 594 aa, Arabidopsis thaliana
MEFFSDYGDANRFKVQEVIGKGSYGVVCSAIDTLTGEKVAIKKIHDIFEHISDAARILREIKLLRLLRHPDIVEIKHIMLPPSRREFKDIYVVFELMESDLHQVIKANDDLTREHYQFFLYQLLRALKYIHTANVYHRDLKPKNILANANCKLKICDFGLARVAFNDTPTTIFWTDYVATRWYRAPELCGSFYSKYTPAIDIWSIGCIFAEVLMGKPLFPGKNVVHQLDLMTDLLGTPSLDTISRVRNEKARRYLTSMRKKPPIPFAQKFPNADPLSLKLLERLLAFDPKDRPTAEEALADPYFKGLAKVEREPSCQPITKMEFEFERRKVTKEDIRELISREILEYHPQLLKDHMNGADKASFLYPSAVDQFRRQFAHLEENSGKTGPVAPLERKHASLPRSTVIHSTAVARGGQPKLMNNTNTLNPETTQNIPFNHATIQAQQRNLSAAKPSTFMGPVAPFDNGRISRDAYDPRSFIRSTNLPFSQQSAATVAMGKQQERRTTMEPEKQARQISQYNRYAPDVAINIDNNPFIMARTGMNKAENISDRIIIDTNLLQATAGIGVAAAAAAAAPGGSAHRKVGAVRYGMSKMY

SEQ ID NO: 19071 - protein, 324 aa, Arabidopsis thaliana
MAGAKDSGCDDDLRIAGGCDPGKRGNPEDSSSPVEVSCSICLESVLDDGTRSKAKLQCGHQFHLDCIGSAFNMKGAMQCPNCRNVEKGQWLYANGSTRPFPEFSMEDWIPEEDLYGLSYPEMQYRVHWCPFGELSQAAASFELLILQTRKLELTFALCFRELEPATTTYHTEFHGHHAAAVNHSYLAYVGPGPAATPRTSDNNSTDDHPWNSHSNDHFHQLPVAPQYHHHSPSFSLPAAHVVDGEVDSSAARGLPYAHPFLFSHRVFYNILLELGIVGLIKGPHQQLTVTKEAAPKCVNSIMLIIIRGNNIMPMVPLSHHLSSP

SEQ ID NO: 19072 - protein, 407 aa, Arabidopsis thaliana
MSFKSLIQDMRGELGSISRKGFDVRFGYGRSRSQRVVQDTSVPVDAFKQSCWASMPPELLRDVLMRIEQSEDTWPSRKNVVSCAGVCRNWREIVKEIVRVPELSSKLTFPISLKQPGPRGSLVQCYIMRNRSNQTYYLYLGLNQAAASNDDGKFLLAAKRFRRPTCTDYIISLNCDDVSRGSNTYIGKLRSNFLGTKFTVYDAQPTNPGTQVTRTRSSRLLSLKQVSPRIPSGNYPVAHISYELNVLGSRGPRRMQCVMDAIPASAVEPGGTAPTQTELVHSNLDSFPSFSFFRSKSIRAESLPSGPSSAAQKEGLLVLKNKAPRWHEQLQCWCLNFNGRVTVASVKNFQLVAAPENGPAGPEHENVILQFGKVGKDVFTMDYQYPISAFQAFTICLSSFDTKIACE

SEQ ID NO: 19073 - protein, 749 aa, Arabidopsis thaliana
MSNWKTLLLRIGEKGPEYGTSSDYKDHIETCFGVIRREIERSGDQVLPFLLQCAEQLPHKIPLYGTLIGLLNLENEDFVQKLVESVHANFQVALDSGNCNSIRILLRFMTSLLCSKVIQPASLIVVFETLLSSAATTVDEEKGNPSWQPQADFYVICILSSLPWGGSELAEQVPDEIERVLVGIQAYLSIRKNSSTSGLNFFHNGEFESSLAEKDFVEDLLDRIQSLASNGWKLESVPRPHLSFEAQLVAGKFHELRPIKCMEQPSPPSDHSRAYSGKQKHDALTRYPQRIRRLNIFPANKMEDVQPIDRFVVEEYLLDVLFYLNGCRKECASYMANLPVTFRYEYLMAETLFSQILLLPQPPFKTLYYTLVIMDLCKALPGAFPAVVAGAVRALFEKISDLDMESRTRLILWFSHHLSNFQFIWPWEEWAFVLDLPKWAPKRVFVQEILQREVRLSYWDKIKQSIENATALEELLPPKAGPNFMYSLEEGKEKTEEQQLSAELSRKVKEKQTARDMIVWIEETIYPVHGFEVTLTIVVQTLLDIGSKSFTHLVTVLERYGQVFSKLCPDNDKQVMLLSQVSTYWKNNVQMTAVAIDRMMGYRLVSNQAIVRWVFSPENVDQFHVSDQPWEILGNALNKTYNRISDLRKDISNITKNVLVAEKASANARVELEAAESKLSLVEGEPVLGENPAKMKRLKSTVEKTGEAELSLRESLEAKEALLNRALSETEVLYISLMQHMILLFPFIY

SEQ ID NO: 19074 - protein, 204 aa, Arabidopsis thaliana
MAGMLPGVECARRRRFHGGAPPIESSNTASVAAAAGHVWTRRPSFSLYTTNHESHQAHVSFSERSVRNKSYGEDNDEKLDGAAKEAKQRLNKRLRIPPRTRFDLVKNGVQNGKDKGNKLEQGKGKPLGDLPTEVVGLKKSRGRLMEWFKRRVREQQDCAICLDRFKKGETLVHLPCAHKFHSICLLPWLDTNVYCPYCRTDIWN

SEQ ID NO: 19075 - protein, 393 aa, Arabidopsis thaliana
MLLGFNNFQSGATDGRKIGKLFLSSKEIAKGSNGTVVFEGIYEGRPVAVKRLVRSHHEVAFKEIQNLIASDQHTNIIRWYGVEYDQDFVYLSLERCTCSLDDLIKSYLEFSMTKVLENNDSTEGPQNVLISKDMTLSAKLSDMGISKRMSRDMSSLGHLATGSGSSGWQAPEQLLQGRQTRAVDMFSLGCVIFYTITGCKHPFGDDLERDVNIVKNKVDLFLVEHVPEASDLISRLLNPDPDLRPSATEVLLHPMFWNSEMRLSFLRDASDRVELENREADSEILKAMESTAPVAIGGKWDEKLEPVFITNIGRYRRYKYDSIRDLLRVIRNKLNHHRELPPEIQELVGTVPEGFDEYFAVRFPKLLIEVYRVISLHCREEEVFRKYFKCDII

SEQ ID NO: 19076 - protein, 279 aa, Arabidopsis thaliana
MASSSSSSYRFQSGSYPLSSSPSLGNFVERIKDACHFLVSAVLGTIISAILTFFFALVGTLLGALTGALIGQETESGFIRGAAIGAISGAVFSIEVFESSLDLWKSDESGFGCFLYLIDVIVSLLSGRLVRERIGPAMLSAVQSQMGAVDTAFDDHTSLFDTGGSKGLTGDLVEKIPKMTITGNNNTDASENTDSCSVCLQDFQLGETVRSLPHCHHMFHLPCIDNWLLRHGSCPILTSQFRYFYSSYIKSLLCSSSLLLEFHSHCRTPSSLMYKETQK

SEQ ID NO: 19077 - protein, 276 aa, Arabidopsis thaliana
MTLLVYKGAAKVSIVMIGQQAIMDSYLCLLHLTAGILVESLFNAFATAAFFKFVVFSIFEMRYLLSIWKATRPSTSGEGWETMRRELSFLYSRFYGILLGGILLMYEFHNYMRPILLLMYSFWIPQIVANVVRDSRKPLHPYYILGMTVTRLAIPLYVFGCPKNFMRVEPSKAWCVSLCAFMGFQAGVLLLQHYFGSRCFVPRKLLPEKYSYYRRLDHNVNRSRDCVICMTTIDLRHRINDCMVTPCEHIFHSGCLQRWMDIKMECPTCRRPLPPA

SEQ ID NO: 19078 - protein, 103 aa, Arabidopsis thaliana
MRILCDACESAAAIVFCAADEAALCCSCDEKVHKCNKLASRHLRVGLADPSNAPSCDICENAPAFFYCEIDGSSLCLQCDMVVHVGGKRTHRRFLLLRQRIEV

SEQ ID NO: 19079 - protein, 325 aa, x Doritaenopsis sp.
MESGSFPVINMELLQGSQRPAAMALLRDACENWGFFELLNHGISHELMNRVEAVNKEHYRRFREQRFKEFASKTLDSVENVDPDNLDWESTFFLRHLPTSNISQIPDLDDDCRATMKEFARELEKLAERLLDLLCEDLGLEKGYLKRVFCGGSDGLPTFGTKVSNYPPCPKPDLIKGLRAHTDAGGIILLFQDDKVSGLQLLKDREWIEVPPLRYSIVVNIGDQLEVITNGKYKSVLHRVVAQTDGNRMSIASFYNPGSDAVIFPAPALVEKEAEEEEKKEIYPKFVFQDYMNLYIRKKFEAKEPRFEAMKSMEIVMSSQPIPTA

SEQ ID NO: 19080 - protein, 318 aa, Dendrobium crumenatum
MELLEGSRRSDAMAVLRDACENWGFFELLNHGISHEPNEQSETVNKEHYREHYRRFREQRFKEFAAKTLDSGENVDGDNLDWESTFFLRHLPTSNISQVPDLDEDCGSTMKEFALGLEKLAERLLDLLCENLGLEKGYLKRVFCGGSDGLPTFGTKVSNYPPCPKPELIKGLRAHTDAGGIILLFQDDTVSGLQLLKDEEWIDVPPMRHSIVVNIGDQLEVITNGKYKSVMHRVVAQTNGNRMSIASFYNPGSDAVIFPAPELVEKEAAEKKKETYPKFVFEDYMKLYVRQKFEAKEPRFEAMKTMDAVISSQPIPTA

SEQ ID NO: 19081 - protein, 640 aa, Mus musculus
MAAALPLQPSTTASATTTATAVALGEVEDEGLLASLFRDRFPEAQWREKPDVGRYLRELSGSGLDRLRREPERLAEERAQRLQQTRDLAFANYKTFIRGAECTERIHRLFGDVEASLGRLLDRLPRFQQSCRNFVKEAEEISSSRRMNTLTLNRHTEILEILEIPQLMDTCVRNSYHEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEACRVHLFDIITQYRAIFSDEDPLLPPAMGEYTVNEGAIFHGWVLQKISQFLQVLETDLYRGIGGRLDSLLGQCMYFGLSFSRVGADFRGQLAPVFQRVAISTFQKAVEEAVEKFQDEMTSYTLISTAAILSSSNTPATVPATQPGTLQPPMVLLDFPPLACFLNNILVAFNDLRLCCPVALAQDVTGTLENALTKVTKTILAFHRAEEAVFSSGEHEIFVQFCTAFLEDLVPYLNRCLQVLFPPAQIAQTLGISPTQLSKHGNLGHVNISAIQEPLAFILPKRETVFCLDEQELGPDLVAPAPELPAEQRSMEPVTEKREPGEPLPQEPMEGEPLPAEPPSEGGGIGSVPCPQPGEQP

SEQ ID NO: 19082 - protein, 493 aa, Chlorobium vibrioforme
MDKILYDALTFDDVLLVPAYSNVLPKETVVKSRVTRNIEVNLPLVSAAMDTVTEAELAIALARAGGIGIIHKNLSIDVQARHVAKVKRFESGIIRNPITLFEDATIQEAIDLMLRHSISGIPVVERPTPEGCLLLKGIVTNRDLRMTTSSNEKITTIITTDLITAQEDIDLLAAEEILMQNKIEKLLVIDEEGYLKGLITFKDIQKRKQCPDACKDMHGRLRVGAAVGIRSNTITRVDALVEAGVDVVAVDTAHGHSQAVLDMVATIKEKYPELEVIAGNVATPEAVRDLVKAGADAVKVGIGPGSICTTRVVAGVGMPQLTAIMNCAKEAAKTDTPIIADGGIKYSGDISKALAAGADTVMMGSIFAGTDESPGETILYEGRRFKAYRGMGSLGAMSEPEGSSDRYFQDASAETKKYVPEGIEGRIPQRPLDEVVYQLIGGLKSSMGYCGVKNIEELKKNTRFVRITSAGLRESHPHDVMITREAPNYSTSH

SEQ ID NO: 19083 - protein, 444 aa, Caenorhabditis elegans
MPTWIPNNLCAQPTTRNAKPPSNGHPQATQQQSAPGSLAYRNSSNIPNGATNHVRQQKWQYTRSGHRKMADGEAVISTVNNVEEVHGQLFEVAPRYVNLSYIGEGAYGMVASALDTITRDRVAIKKISPFEHQTFCQRTLREIKILNRFKHENIINIQEIIRSETVDSLKDIYIVQCLMETDLYKLLKTQKLSNDHVCYFLYQILRGLKYIHSANVLHRDLKPSNLLLNTTCDLKICDFGLARVTDPQTDHTGFLTEYVATRWYRAPEIMLNSKGYTKSIDVWSVGCILAEMLSNRPLFPGKHYLDQLNLILAVVGSPSNADLQCIINDKARSYLISLPHKPKQPWARLYPGADPRALDLLDKMLTFNPHNRIDIEQALAHPYLEQYYDPGDEPVCEEPFTLEMEFDDLPKEKLKELIWEEAEAHHRRMEAEAAARNNGGQNPV

SEQ ID NO: 19084 - protein, 536 aa, Arabidopsis thaliana
MNAAVFSPSALSLPISFSKTRSSFLSRKKGVKGEFRVFAVFGDESGLVEKKSQWRPLFDVEDPRSKAPPYKGKFLDVNQAIEVARFDIQYLDWRARQDLLTIMILHDKVVDVLNPLAREYKSIGTVKKELAGLQEELSKAHQQVHISEARVSTALDKLAHMEELVNDRLLPGRVVTELDKPSSSTTASAVELDREKTNTGAKSLNVSGPVPPYSPHLKNFWYPVAFTADLKHDTMVPIECFEQPWVIFRGEDGKPGCVRNTCAHRACPLDLGTVNEGRIQCPYHGWEYSTDGECKKMPSTKLLKVKIKSLPCLEQEGMIWIWPGDEPPAPILPSLQPPSGFLIHAELVMDLPVEHGLLLDNLLDLAHAPFTHTSTFAKGWSVPSLVKFLTPTSGLQGYWDPYPIDMEFKPPCIVLSTIGISKPGKLEGKSTQQCATHFHQLHVCLPSSKNKTRLLCRMSLDFAPILKNLPFMEHLWRHFAEQVLNEDLRLVLGQQERMLNGANIWNLPVAYDKLGVRYRLWRNAVDRGDDKLPFSG

SEQ ID NO: 19085 - protein, 333 aa, Arabidopsis thaliana
MTGNSFNSMKDFLKQTGGYAVIDGGLATEFERHGADLNDPLWSAKCLVTSPHLIHTVHLDYLEAGADIISSASYQATIQGFEAKGFSREESESLLKKSVEIACEARNSYYDKCGTSSSMDDKILKKRPILVAASVGSYGAYLADGSEYSGIYGDSITLEKLKDFHRRRLQVLAESGADLIAFETIPNKIEAQAFADLLEEGDVKIPGWFSFNSKDGVNVVSGDSIKECISIAENCEKVVAVGINCTPPRFIEGLVLEIEKVTSKPILVYPNSGESYDADRKEWVENTGVGDEDFVSYVEKWMDAGVSLLGGCCRTTPTTIRAIHKRLVNRRSL

SEQ ID NO: 19086 - protein, 487 aa, Arabidopsis thaliana
QEPREESRPLSHALRDDRTSQLTLERRQFDELVSSREDEKFEQQLLHSTGLWNLLISPLTSETKLPAVVSPLADAELCDVVALAQKALSASKQAALLVDDTEANPSDNIKDSLSTSSSMSLPEKGNIVRSKRQLERRAKNRRAPKSNDVDDEGYVPQKTSAKKKYKQGADNDDALQLFLWGPETKQLLTAKEEAELISHIQHLLKLEKVKTKLESQNGCEPTIGEWAEAMGISSPVLKSDIHRGRSSREKLITANLRLVVHIAKQYQNRGLNFQDLLQEGSMGLMKSVEKFKPQSGCRFATYAYWWIRQSIRKSIFQNSRTIRLPENVYMLLGKVSEARKTCVQEGNYRPSKEELAGHVGVSTEKLDKLLYNTRTPLSMQQPIWSDQDTTFQEITPDSGIETPTMSVGKQLMRNHVRNLLNVLSPKERRIIKLRFGIDGGKQRSLSEIGEIYGLSKERVRQLESRALYRLKQNMNSHGLHAYADLLV

SEQ ID NO: 19087 - protein, 376 aa, Arabidopsis thaliana
  unsure (1)..(376): unsure at all Xaa locations
MTKNSNHDENEFISFEPNQNTKIRFEDADEDEVAEGSGVAGEETPQDESMFDAGESADTAEVTDDTTSADYYFDSYSHFGIHEEMLKDVVRTKTYQNVIYQNKFLIKDKIVLDVGAGTGILSLFCAXAGAAHVYAVECSQMADMAKEIVKANGFSDVITVLKGKIEEIELPTPKVDVIISEWMGYFLLFENMLDSVLYARDKWLVEGGVVLPDKASLHLTAIEDSEYKEDKIEFWNSVYGFDMSCIKKKAMMEPLVDTVDQNQIVTDSRLLKTMDISKMSSGDASFTAPFKLVAQRNDYIHALVAYFDVSFTMCHKLLGFSTGPKSRATHWKQTVLYLEDVLTICEGETITGTMSVSPNKKNPRDIDIKLSYSLNG

SEQ ID NO: 19088 - protein, 286 aa, Lycopersicon esculentum
MSSEKEDGLGLSLSLGIMSCPQNNHKTTPSLPLNLLPFMHHHQVSSGRKDEGGERVRGGIDMNEPARMIIECDDEEDEEEDQVLMVSSPNSTVSSVSGKRSHDREENEGERATSSLEDDGGDAAARKKLRLSKEQAAVLEETFKEHNTLNPKQKLALSKQLNLRPRQVEVWFQNRRARTKLKQTEVDCEYLKRCCENLTDENRRLQKEVSELRALKLSPQFYMNMSPPTTLTMCPQCERVAVSSSSSSSSVVNATRAQNHQAPVPMNKPWAAMFASKTLDVQRSQM

SEQ ID NO: 19089 - protein, 214 aa, Paeonia anomala
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAEKFGVTEFVNPKDYNKPVQEVIAEMTDGGVDRSVECTGSIMAMISAFECVHD

SEQ ID NO: 19090 - protein, 297 aa, Drosophila melanogaster
MGKDFDAVGFVKDFAAGQVSAAVSKTAVAPIERVKLLLQVQHISKQISPDKQYKGMVDCFIRIPKEQGFSSFWRGNLANVYRYFPTQALNFAFKDKYKQVFLGGVDKNTQFWRYFAGNLASGGAAGATSLCFVYPLDFARTRLAADTGKGGQREFTGLGNCLTKIFKSDGIVGLYRGFGVSVQGIIIYRAAYFGFYDTARMLPDPKNTPIYISWAIAQVVTTVAGIVSYPFDTVRRRMMMQSGRKATEVIYKNTLHCWATIAKQEGPSFFKGAFSNILRGTGGAFVLVLYDEIKKVL

SEQ ID NO: 19091 - protein, 798 aa, Gallus gallus
MVIMSEDASVPAPSAAQPRPLRVGFYDIERTLGKGNFAVVKLARHRVTKTQVAIKIIDKTRLDPSNLEKIYREVQIMKLLNHPHIIKLYQVMETKDMLYIVTEFAKNGEMFDHLTSNGHLSESEARKKFWQILSAVEYCHSHHIVHRDLKTENLLLDANMNIKLADFGFGNFYKSGEPLSTWCGSPPYAAPEVFEGKEYEGPHLDIWSLGVVLYVLVCGSLPFDGPNLPTLRQRVLEGRFRIPYFMSEDCETLIRRMLVVDPTKRITISQIKQHKWMQADPSLRQQQSLSFSMQNYNSNLGDYNEQVLGIMQTLGIDRQRTVESLQNSSYNHFAAIYYLLLERLKEYRSSQLSSRPATGRQQRPRSSEISNAEMPQDSLTSETLRSSLLYQQPQSLIQPSLQAEMDCDMNNPLQPVFFPVDPNFNGLFRNRSISPSSLLETTISEEVRQEKELEDEIKAYDHPIRIPSNTSRRHTLAEVTTHFYQHAPPCIVISSSASPTEGTSSDSCLTSSSNDSSVALSSCLAGQVMTGSPATARMTSAFLASQSDAPVLQVQGCMGGASLLPVSFQEGRRASDTSLTQGLKAFRQQLRKNARAKGFLGLNKIKGFARQVCQSSSSRAARSAMSPFQHAQPNTCIYSSSGSSREGRNLLEEVLQQQRMLQLQHHQLLQPACPQTSQTSATNGLPPSDSAGTCKASNSLLLSELQRENSFELAFGGNSQLLQPHFFGVSVSPVSSAAHLLDTHLYISSNVSPVGTTFSQQQSFSAQSPSYDAVTLQHGDCEMEDLTSNQLGKFVLVK

SEQ ID NO: 19092 - protein, 281 aa, Picea mariana
AAGSGYWKATGADKPITAKGGKKRVGVKKALVFYVGKAPNGSKTNWLMHEYRVTNVSRPVKKKNSLILDDWVLCRIYNRRISAEKLALQQKESFNDVPMETIDEKEMENQLTSTSIEHSGIEQSNPSFDHLSKLGSSPTCYNSAPLCVSPMNSNICLQNLDFFQNSTTPFSDSTLKAPVQNTTFNPISSSINHQWTNCNSTDLMSGLHNDSSCSKPSSFSEPISEKEEVQSSFRLENFSQEQQQSLFNFGLEGLQNTFTHLDQITLPGAYQDWFYPNEPFH

SEQ ID NO: 19093 - protein, 318 aa, Pimpinella brachycarpa
MMVQQRDELGLSLSLSFPGSSHEQNKSNTTNNKHNQMPHASTPLELNLMPSQPLNLLHNNTTTWTHPASHDRKMEACRVDRRSLLTGIDVNRIPAMTVDMEEETGVSSPNSTISSLSGNKRSLVNERSELANGDEILESSRSDDEDGDNSRKKLRLTKDQSAILEESFKEHNTLNPKQKIALAKRLGLRPRQVEVWFQNRRARTKLKQTEVDCEFLKRCCQTLTEENRKLQKEVQELRALKSSPQFYMQMTPPTTLTMCPSCERVGGLQSATTTLSAGPSITQAEPLRSHPMSSNHHRLPFNPWASPQRPLDALHPRS

SEQ ID NO: 19094 - protein, 319 aa, Pimpinella brachycarpa
MMVQERDELGLSLSLSFPGSSHEQNKSNTTNNKHNQMPHASTPLELNLMPSQPLNLLHNNTTTTWTHPASHDRKMEACRVDRRSLLTGIDVNRIPAMTVDMEEETGVSSPNSTISSLSGNKRSLVNERSELANGDEILECSRSDDEDGDNSRKKLRLTKDQSAILEESFKEHNTLNPKQKIALAKRLGLRPRQVEVWFQNRRARTKLKQTEVDCEFLKRCCQTLTEENRKLQKEVQELRALKSSPQFYMQMTPPTTLTMCPSCERVGGLQSATTTSSAGPSITQAEPLRSHPMNSNHHRLPFNPWASPQRPLDALHPRS

SEQ ID NO: 19095 - protein, 302 aa, Pimpinella brachycarpa
MMIHQREDHLGLSLSLSSPAHRPSSSSSPLQLNLAPSMPTPSTPPFNLFHKKETSDGYILDACRVETRSFLKGIDVNRLPATTVDMEEEAGVSSPNSTISSVSGKRSLERSENGNGDDLLDCSRGLINSDEEDGDNSRKKLRLSKDQSAILEDSFKEHNTLNPKQKLALAKRLGLRPRQVEVWFQNRRARTKLKQTEVDCEFLKRCCENLTDENRRLMKEVQELRALKLSPQFYMQMTPPTTLTMCPSCERVSAPPSSSTGPSSTPVETPRPHHSGSSHHRVAFNPWAIAPAGHRSFDAVPH

SEQ ID NO: 19096 - protein, 552 aa, Emericella nidulans
MRVLPATLLVGAATAATPAQQVLGGLQDFGNAVQDAMHENLPKINKPLEAFQEQLKSLYEAREFWEEVANAFPQNLDHNPVFSLPKKHTRRPDSHWDHIVRGADVQSVWVTGENGEKEREIEGKLEAYDLRIKKTDPSSLGIDPDVKQYTGYLDDNENDKHLFYWFFESRNDPKNDPVVLWLNGGPGCSSLTGLFMELGPSSIDENIKPVYNPYAWNSNASVIFLDQPVNVGYSYSGSTVSDTVAAGKDVYALLTLFFKQFPEYAEQDFHIAGESYAGHYIPVFTSEILSHQKRNINLKSVLIGNGLTDGLTQYEYYRPMACGEGGYPAVLDESSCRSMDNALGRCQSMIESCYNSESAWVCVPASIYCNNALLAPYQRTGQNVYDVRGKCEDESNLCYKGMGYVSEYLNKPEVRAAVGAEVDGYDSCNFDINRNFLFHGDWMKPYHRLVPGILEQIPVLIYAGDADFICNWLGNKAWTEALEWPGHKEFAAAPMEDLKIVDNEHTGKKIGQIKTHGNFTFMRLYGGGHMVPMDQPEASLEFFNRWLGGEWF

SEQ ID NO: 19097 - protein, 191 aa, Arabidopsis thaliana
MATSTLLANPIALTGSASQNSSVASFSESSLASFMGSNRVVTILISFSPEAWFRFLDNFALDFLLVPSEETVRSRNDATVSEVLHDVETYNRVFGGQSSGLIQRMQDLPFLLRRLLREMMDPQRTLPLVIRARVYIALILSAIYIISPIDIIPEGVLGVIGLLDDLLIALICFLHVAALYRSVLYSRHGGS

SEQ ID NO: 19098 - protein, 385 aa, Giardia intestinalis
MPLAVFNIKGTRFCVPDYYKVTKALGAGAYGVVAEAVDTRTNTTVAIKKISNLFVHLVDSKRTLREITILRMLDHENIVKLLDVLVPEDPSNFDDLYVVFDFMQTDMHKIISSKQDLSPDHMQYFVYQLLRGLKYLHSANCVHRDLKPSNLLLNSDCALEICDLGLARLVDDHAAKTKELKDAEKHDTQMTEYVATRWYRAPEIILGWPQYGKPVDIFSVGCIFAELIARKPLFPGRDYIHQLHLILEVLGTPEKELLDRIASDSAKSYVLALKPSAPQDLSQKFPMLDEAGIDLLTRMLTLDPLKRITVNECLSHPYFEGIHDESDEPVYTGQPLELFFEKYELTKPLLEMCFLNEARKFHPDELKDEVAKRAKALGIPESVWM

SEQ ID NO: 19099 - protein, 361 aa, Giardia intestinalis
MSDDESIDRHVLRKYEIIHRVGKGAYGVVWKAVNRKTNETVALKKIFQAFQNDTDAQRTFREIMFLQELDHDNIIRLFNVLKAENDKDIYLVFEFLDSDLHQVIKSNILEDIHKRYIIYQCVKALKYLHSAEILHRDLKPSNLLLNSECHMKMADFGLARSIAALSEPSSATNPILTDYVATRWYRSPEILLGCTRYTKGVDMWAIGCILGEMLGGSPMFPGSSTMNQLDKIMGGHWERPTPEDIEATESPFASMMLDSLQPKTGKALSEIYPNAPADALDLLKKLLQFNPNKRLTAEQALEHPYLSKFHDPATEPSAPGPIKISIDDDDKRSVSEYRDLLYSEILRKKKEIRSKSLKEDE

SEQ ID NO: 19100 - protein, 337 aa, Sus scrofa
TDQAAFDTNIVTLTRFVMEQGRKARGTGEMTQLLNSLCTAVAAISTAVRKAGIAHLYGIAGSTNVTGDQVKKLDVLSNDLVINVLKSSFATCVLVTEEDKNAIIVEPEKRGKYVVCFDPLDGSSNIDCLVSIGTIFGIYRKNSTDEPSEKDALQPGRNLVAAGYALYGSATMLVLAMVNGVNCFMLDPAIGEFILVDRNVKIKKKGSIYSINEGYAKEFDPAITEYIQRKKFPPDNSAPYGARYVGSMVADVHRTLVYGGIFMYPANKKSPKGKLRLLYECNPMAYVMEKAGGLATTGKEAVLDIVPTDIHQRAPIILGSPEDVTELLEIYQKHAAK

SEQ ID NO: 19101 - protein, 338 aa, Oryza sativa (japonica cultivar-group)
MAAAAAPAPETTIDVFVVANHTPVTAAADKSSCEGDVVAGGGRTVRRPRAVARTLECERRVVGEGFAVRRGIGRKELDSLDPFISLDEFEFSPPAGFHDHPHRGFENVTYMLEGGFSYHDFSGHKGTINTGDVQWMTAGRGVVHAEMPGGHGVQRGINLWINLSSKDKMVEPRYQELASHDIPAAERDGVSVKVIAGEALGARSPLQTRTPALCLDVAMRPGARLRAPVPPGWSACSYVIDGEAVFGDEAAAAGAHTCVVFGGGGDGVAARATERSAARFLLVAARPHGEAVVKDGPFVMNTREEVEQAREDYRNRRNGFEMAAGWSSDHVATAAAAH

SEQ ID NO: 19102 - protein, 1230 aa, Cryptococcus neoformans var. grubii
MNGFMPALRLHHTHSSSVSPTASNDAASSSPTSSQPHQLAAYSPLYATSPNRGSKITKGSSLSSSTAHHGLKYVRPSTSPLLKPPKGKSFSEYLGDWGSQELFTFLDIHKCGQYLAIFQENDINGKILLDLDVTALKSMGIDKISERVRLIGGIKDLRKRIADETIRAPFIQRCYPPERTLLPSLPSHSNVFLDKWDYSSSASRLGKGQIAFRPPPLDLQGHMPRKLLPHASQGIATIDTHDIRTTKPKIEAYIQQNPLGQPQSVPTKRSDSLTLCAPPSRNVRRRSPSSRHFEGRESQTDGFTILNMASDRQVPSSTMNSVTLGEDCHLQREEGLPLFLKVPQFRNTFASSHKTLIAGRGPLTRGDTISHQPSGPAIAGQDSPVNYRISKTVTTTKEASQGDLEHPFAVKSIGSQLGLLVGVSGMAHDPVTDGSKSKGKTSVPLTGTSSSDISAVNANSAALSLADLRRQLVKFINTEDDTIRTVNVMHVTSGEEILERALKKFGKWGTGMHSSPDVYGDEDGDETLEIDGWEVYTERTPDESSKPLSESSLLKTCTFHREGTAIQDKGLFLRKKQRLQKRKNIQHFFGETLPPPMSPTSPTLITGPHLGIVQGKSQLASEPAFSSSNRLSTLTNKGPNRASMISVMSGLGVPVINTLPSPQGNGLCPTGSVHSHKKKSMYNFFGHRPPSELISNHLADYFPSAKKSDVEKARHSLLRLSGDTVAYKKNGIDEGDNAPDHWSKPGNNQPPSLPPFEPSQDTLSDSLQAYASSTPVYLSRPKHNVALRRRRDSDSSSRSHTSVLMQTRRNRDRSDTASLLTVDEITAEVENRRASTIPKGDYIEETEDSSFIEGDTLPEYEESKGLLRTVCSDSNSIVDSGKSFQRDSDVDQQQELEDEEEDELDDEEEEEEEEKEDEDEQGKAFTSTGSKRIIKWIKGALIGAGSFGSVYLGMDAQSGLLMAVKQVELSAGSVKSEDRKKSMLSALEHEIELLKELQHENIVQYLDSSVDTNHLNIFLEYVPGGSVAALLNNYGAFEEGLVRNFVRQILTGLNYLHMRGIVHRDIKGANILVDNKGGIKISDFGISKKVENSLISGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKDPFIDSPRVRTTASNFISEAIVSEKMEVQVVEEM

SEQ ID NO: 19103 - protein, 253 aa, Plasmodium falciparum
GSVLCVKCNNDEVVIKFLHGLNCNFDCASIGEISKVIKLLPNLSRDRIIFANTIKSINSLIYARKENINLCTFDNLDVLKKIYKYHPKCSLILRINVDFKNYKSYMSSKYGANEYEWEEMLLYAKKHNLNIVGVSFHVGSNTKNLFDFCLAIKLCRDVFDMSSNMGFNFYIINLGGGYPEELEYDNAKKHDKIHYCTLSLQEIKKDIQKFLNEETFLKTKYGYYSFEKISLAINMSIDHYFTHMKDNLRVICE

SEQ ID NO: 19104 - protein, 48 aa, Synechococcus
LDLIQEGTLGLERGVEKFDPSKGYKFSTYAYWWIRQAITRAIAQQSRT

SEQ ID NO: 19105 - protein, 125 aa, Chaetopterus variopedatus
MSGRGKGGKAKGKSKTRSSRAGLQFPVGRIHRLLRKGNYAERARAGAPAYLAAVMEYLAAEVLELAGNAARDNKKSRIIPRHLQLAIRNDEELNKLLSGVTIAQGGVLPNIQAVLLPKKTQKPAK

SEQ ID NO: 19106 - protein, 67 aa, Arbacia lixula
DNIQGITKPAIRRLARRGGVKRISGLIYEETRGVLKVFLENVIRDAVTYCEHAKRKTVTAMDVVYAL

SEQ ID NO: 19107 - protein, 321 aa, Nostoc punctiforme
MSNLTFSDTKASNTNKATTDTVRAYLKEIGRIPLLTQEQEIIFAQEVQQLMTILAESEKLTIELKRTPTLSEWANQMQLSEQELLQQLNQGKKAKHKMITANLRLVVSIAKQYQRRNLELMDLIQEGTLGLERGVEKFNPALGYRKTTYAYWWIRQGITRAIAQQGRAIRLPIHINEKLNKIKRVQRELSQTLGRIPTSTEIANALSLKPSQIREFLLLATRTISLDIRVSSAKDLRLQDLIEDYKYSSNSYITEESLNQEVNSLLSNLSRQQQEILNLHFGLTDGEELSLQQIGQRLGISRERVRQIEKQALKLLQQQLS

SEQ ID NO: 19108 - protein, 684 aa, Drosophila melanogaster
  unsure (1)..(684): unsure at all Xaa locations
MTVANKENDPDSHFTGTIVTTGATAQPATPTTSNSTALPATPTVAAGQDLGDGACXSKNTDSKFQSYVNGNGNGVYKIIKTLGKGNFAKVKLAIHVPTGREVAIKVIDKTQLNTSARQKLYREVKIMKLLNHPNIVRLFQVIESERTLYLVMEYASRGELFDHLVKNGRMRERDARVIFRQLVSAIQYCHSKFVVHRDLKAENLLLDQHMNIKISDFGFGNTSDPNAQLETFCGSPPYAAPELFMGRNYAGPEVDAWSLGMVLYTLVSGSLPFDGGTLKELRERVLRGKYRVPYYISMDCENLMRKFLVLNPAKRTSLSAVMSDKWINLGHDESDRLRPFREKPMELQDAARFDLLMSMGHKRRDVEQSVKGQLFDDIYCTYMLLGVAKPRSSNRSTKPEAIPTVDLTTPAVSSPLPNITTPTVTIAHVHACAGQESAHPLLLSIGLDPLRHVVANAPNTPTSTPPTGTPAKPTRRTPARTPARKATNHTSGQGRPEPSSLPHTPQSKRASANMDVKPTLLSAQRQLVQTQKLANTPPRFQYPVAQTPNQAQGSSRRPTTLYEKAEPAVTPLLVPKSPAMGARLLERIPGGGAVEKTSDKPFTRQNVARATFHFGQARSGKRGGGSGNGASGDEDSYQTPPLSADDTKPASRVGFFSKLTARFGRRVIHLNEKDVTEQRKNLTK

SEQ ID NO: 19109 - protein, 604 aa, Drosophila melanogaster
  unsure (1)..(604): unsure at all Xaa locations
MTAANTNKTTDKENDPGPNTSISTTATPPSAAAQNVGGCVGSSGGRSSPKFXSYVNGNGYGVYKIIKTLGKGNFAKVKLAIHLPTGREVAIKLIDKTALNTIARQKLYREVNIMKKLNHPNIVRLLQVIESERTLYLVMEYVSGGELFNYLVKNGRMRERDARVLFRQLVSAIEYCHSKSIVHRDLKAENLLLDQQMKLKIADFGFSTTFEPKAPLETFCGSPPYAAPELFKGKKYSGPEVDSWSLGVVLYTLVSGSLPFDGTNLKELRDRVLRGKYRVPYYVSIECESLXRKFLVLNPTQRTSLSAVMADRWINMGYEQGNGLRPFQEKPMDLHDVNRLSLLSNMGHKPRDVXQSLKNQKFDDIYCAYMLLDVAKPRSTACSEKSGSSFRETPTAMPGSSRIPVPIAAPNVTISQVTFALDKSTPNRPGATSIRPMAPRLANALTPLPLTPPPKKYICCSASKAANPRRSEPSSIPQSAMPKKGVGSPVDVKTTLLSAQRKLAVNHKLTSASHQIRSPITQSSSQASECTRTPPTHFEMLDSTSTPLKVLKLVASNSQTPPSTENINRPTRVGFFSKLSARFVRRSLHKGEKDISEQGRNLTK

SEQ ID NO: 19110 - protein, 300 aa, Pneumocystis carinii
MEQYQRLEKIGEGTYGVVYKAKDLESGTIVALKKIRLEAEDEGVPSTAIREISLLKEMHNDNVVRLLNIIHQESRLYLVFEFLDLDLKKYMNSIPKDMMLGAEMIKKFMSQLVSGVKYCHSHRILHRDLKPQNLLIDREGNLKLADFGLARAFGVPLRGYTHEVVTLWYRAPEVLLGGRQYATALDIWSIGCIFAEMATKKPLFPGDSEIDEIFRIFRILGTPDENSWPGITSYPDFKATFPKWSPKNLGELITELDSDGIDLLQKCLRYYPAERISAKKALDHPYFDDFINLNRSNVVL

SEQ ID NO: 19111 - protein, 300 aa, Pneumocystis carinii
MEQYQRLEKIGEGTYGVVYKAKDLESGTIVALKKIRLEAEDEGVPSTAIREISLLKEMHNDNVVRLLNIIHQESRLYLVFEFLDLDLKKYMNSIPKDMMLGAEMIKKFMSQLVSGVKYCHSHRILHRDLKPQNLLIDREGNLKLADFGLARAFGVPLRGYTHEVVTLWYRAPEVLLGGRQYATALDIWSIGCIFAEMATKKPLFPGDSEIDEIFRIFRILGTPDENSWPGITSYPDFKATFPKWSPKNLGELITELDSDGIDLLQKCLRYYPAERISAKKALDHPYFDDFININRSNVVL

SEQ ID NO: 19112 - protein, 112 aa, Rhodobacter sphaeroides
MKLIIAAIKPFKLEEVREALTTIGVRGMMVTEIKGFGSQSGHTEIYRGAEYAVNFVPKVRLEIVVSDGLAESVVETIRTTAKTDKIGDGKIFVLDVEQAVRVRTGEINDDAL

SEQ ID NO: 19113 - protein, 502 aa, Arabidopsis thaliana
MATAAVIGLNTGKRLLSSSFYHSDVTEKFLSVNDHCSSQYHIASTKSGITAKKASNYRPSFPSSNRHTQSAKALKESVDVASTEKPWLPNGTDKELEEECYDDDDLISHSVEAILLLQKSMLEKSWNLSFEKAVSSEYPGKGTIRKKKIPVITCSGISARQRRIGAKKKTNMTHVKAVSDVSSGKQVRGYVKGVISEDVLSHAEVVRLSKKIKSGLRLDDHKSRLKDRLGCEPSDEQLAVSLKISRAELQAWLMECHLAREKLAMSNVRLVMSIAQRYDNLGAEMSDLVQGGLIGLLRGIEKFDSSKGFRISTYVYWWIRQGVSRALVDNSRTLRLPTHLHERLGLIRNAKLRLQEKGITPSIDRIAESLNMSQKKVRNATEAVSKVFSLDRDAFPSLNGLPGETHHSYIADTRLENNPWHGYDDLALKEEVSKLISATLGEREKEIIRLYYGLDKECLTWEDISKRIGLSRERVRQVGLVALEKLKHAARKRKMEAMILKN

SEQ ID NO: 19114 - protein, 458 aa, Hemicentrotus pulcherrimus
MAFSIGNSNASDIMANMAQGGQQFGKKTKRDDNTSRNGPQACKRAALGTITNVSSTRVQPSRAAKHFRVSGENSFPVFQDENAHSRIPQGKPFGIPSAGAAPAFSIHVDTTSSYVQSSTSTSIKSTDKENEHILLDNALSLPVPQAQRIPLRTFPDVEDNNVSLNEESLTSSEFSPMLLDTSLDAKCISPRTVDIRDLSLGEPEYAEEIYQYLKTAESKHRPKHGYMRKQPDITNSMRCILVDWLVEVSEEYRLHNETLYLAAAFIDRFLSQMSVLRAKLQLVGTASMFVASKYEEIYPPDVKEFVYITDDTYSIKQVLRMEHLILKVLSFDLAAPTINSFLPRFIKAAQANSKTEHLTQYLAELTLQEYDFIKYAPSMIAASAVCLANHTLNNEEWTPTMAHYTDYQLGDIYPCVQDLHQLFIKAPTMEQQAVREKYKSQKYSGASMTPVPTTLPTQ

SEQ ID NO: 19115 - protein, 439 aa, Penicillium purpurogenum
MLSSVTVAALLLTLKCADALILPDDVGRLPALGWNSWNAYGCNVNETKIVTAATKLNTTGLQALGYQYVNIDDCWSVKSGRDNVTNRIIPNPDTFPNGINGTAQQVHDLGLKIGIYSSAGYETCAGYPASLGYETIDAQTFAEWGIDYLKYDNCNYPSEWDDEYNACIPDSDYPGVNPNGTCPGLTNPAPAGYDWSTSNTTKRFNIMRDALVAVQDQRVILYSLCEWGYADVPSWGNGTGNSWRVTGDINATWDRITAIANMNAHELSSVDFWGHNDPDMLEVGNGDLTIEENRAHFALWAIMKSPLIIGTDLSTLPDTHLSILKNADLIAFNQDPVIGKPALPYKQGYNNGTYNPNYPPEYWSGATSYGWNLVLLFNSEDVAASRSAVWSEIPQLGKHSNRYRVEDVWTGKDLGCVHKEYTAQLEAHDVAVLKVTGTC

SEQ ID NO: 19116 - protein, 379 aa, Arabis gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPRKGQSVAIFGLGAVGLAAAEGARIAGASRIIGVDLNSQRFAQAKEFGVTEFVNPRDHGKPVQQVIAEMTNGGVDRSVECTGSVQAMIQAFECVHDGWGVAVLVGVPSKDDAFETHPMNFLNERTLKGTFFGNYKPKTDIPGVVEKYMNKELELEKFITHTVPFSEINKAFDYMLKGESIRCIITMGA

SEQ ID NO: 19117 - protein, 379 aa, Arabis gemmifera
MSTTGQIIRCKAAVAWEAGKPLVMEEVEVAPPQKHEVRIKILFTSLCHTDVYFWEAKGQTPLFPRIFGHEAGGIVESVGEGVTDLHPGDHVLPIFTGECGDCPHCHSEESHMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAIECVHDGWGVAVLVGVPSKDDAFKTHPMNFLNERTLKGTFFGNYKPKTDIPGVEEKYMNKELELEKFITHTVPFSEINKAFDYMLKGESIRCIITMGA

SEQ ID NO: 19118 - protein, 379 aa, Arabis gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 19119 - protein, 379 aa, Arabis gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFSGNYKPKTDMPGVVEKYMNKELELEKFITHTVPFSEINKAFDYMLKGESIRCIITMGA

SEQ ID NO: 19120 - protein, 379 aa, Arabis gemmifera
MSTTGQIIRCKAAVAWEAGKPLVMEEVEVAPPKKHEVRIKILFTSLCHTDVYFWEAKGQTPLFPRIFGHEAGGIVESVGGGVTDLQPGDHVLPIFTGECGDCPHCHSEESNMCDLLRINTERGGMIHDGESRFSINGKPIHHFLGTSTFSEYTVVHSSQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 19121 - protein, 379 aa, Arabis gemmifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPDCHSEESTMCDLLRINTERGGMIHDGESRFSINGKPIHHFLGTSTFSEYTVVHSGQVAKINPDAPLDKVCIVSCGLSTGLGATLNVAKPKKGQGVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEIKKAFDYMLKGESIRCIITMGA

SEQ ID NO: 19122 - protein, 379 aa, Arabis gemmifera
MSTTGQIIRCKAAVAWEAGKPLVMEEVEVAPPQKHEVRIKILFTSLCHTDVYFWEAKGQTPLFPRIFGHEAGGIVESVGEGVTDLHPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKGFDYMLKGESIRCIITMGA

SEQ ID NO: 19123 - protein, 379 aa, Arabidopsis thaliana
MSTTGQIIRCKAAVAWEAGKPLVIEEVEVAPPQKHEVRIKILYTSLCHTDLYFWEAKGQTPLFPRIFGHEAGGIVESVGEGVTDLQPGDHVLPIFTGECGECRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 19124 - protein, 299 aa, Rattus norvegicus
MDLVLSAADYYFFTPYVYPATWPEDNIIRQTVSLLVVTNLGAYILYFFCATLSYYFVYDHSLMKHPQFLKNQVSREIMFTVKSLPWISIPTVSLFLLELRGYSKLYDDIGDFPNGWIHLIMSVISFLFFTDMLIYWIHRGLHHRLLYKHIHKPHHIWKIPTPFASHAFHPVDGFLQSLPYHIYPFVFPLHKVVYLGLYVLVNVWTISIHDGDFRVPQIFRPFINGSAHHTDHHMLFDYNYGQYFTLWDRIGGSFKHPSSFEGKGPHSYVKNMTEKESNSLAENGCKSKKLCNGEFTKNE

SEQ ID NO: 19125 - protein, 374 aa, Rattus norvegicus
MARSLTWGCCPWCLTEEEKTAARIDQEINKILLEQKKQERGELKLLLLGPGESGKSTFIKQMRIIHGAGYSEEDRRAFRLLVYQNIFVSMQAMIEAMDRLQIPFSRPDSKQHASLVMTQDPYKVSSFEKPYAVAMQYLWRDAGIRACYERRREFHLLDSAVYYLSHLERIAEDDYIPTAQDVLRSRMPTTGINEYCFSVQKTKLRIVDAGGQKSERKKWIHCFENVIALIYLASLSEYDQCLEENSQENRMKESLALFSTILELPWFKSTSVILFLNKTDILEDKIHTSHLASYFPSFQGPRRDAEAAKRFILDMYARVYASCAEPHDGGRKGSRARRLFAHFTCATDTHSVRSVFKDVRDSVLARYLDEINLL

SEQ ID NO: 19126 - protein, 528 aa, Rattus norvegicus
MCSLAAGNGQGAELGPEPLELSDSGDDAGWEDEDADAEPAQGRQHTPCLFCDRLFRSAEETFSHCKLEHQFNIDGMVHKHGLEFYGYIKLINFIRLKNPTVEYMNSIYNPVPWDKDEYLKPVLEDDLLLQFDVEDLYEPVSAPFTYPNGLSENTSAVEKLKLMEARALSAEAALARAREDLQKMKQFAQDFVMNVDVRTCSSTTTIADLQEDEDGVYFSSYGHYGIHEEMLKDKVRTESYRDFIYQNPHIFKDKVVLDVGCGTGILSMFAAKAGAKKVIAVDQSEILYQAMDIIRLNKLEDTIVLIKGKIEEVSLPVEKVDVIISEWMGYFLLFESMLDSVLYAKSKYLAKGGSVYPDICTISLVAVSDVSKHADRIAFWDDVYGFNMSCMKKAVIPEAVVEVVDHKTLISDPCDIKHIDCHTTSISDLEFSSDFTLRTTKTAMCTAVAGYFDIYFEKNCHNRVVFSTGPQSTKTHWKQTIFLLEKPFPVKAGEALKGKITVHKNKKDPRSLIVTLTLNSSTQTYSLQ

SEQ ID NO: 19127 - protein, 1170 aa, Homo sapiens
MNMFLYFQTIIKEGMLTKQNNSFQRSKRRYFKLRGRTLYYAKTAKSIIFDEVDLTDASVAESSTKNVNNSFTVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASIGKDIIEDADGIAMPHQWLEGNLPVSAKCTVCDKTCGSVLRLQDWRCLWCKAMVHTSCKESLLTKCPLGLCKVSVIPPTALNSIDSDGFWKASCPPSCTSPLLVFVNSKSGDNQGVKFLRRFKQLLNPAQVFDLMNGGPHLGLRLFQKFDTFRILVCGGDGSVGWVLSEIDSLNLHKQCQLGVLPLGTGNDLARVLGWGSACDDDTQLPQILEKLERASTKMLDRWSVMAYEAKLPRQASSSTVTEDFSEDSEVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGRPIPLPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 19128 - protein, 1214 aa, Homo sapiens
MAAAAGAPPPGPPQPPPPPPPEESSDSEPEAEPGSPQKLIRKVSTSGQIRQKTIIKEGMLTKQNNSFQRSKRRYFKLRGRTLYYAKTAKSIIFDEVDLTDASVAESSTKNVNNSFTVITPCRKLILCADNRKEMEDWIAALKTVQNREHFEPTQYSMDHFSGMHNWYACSHARPTYCNVCREALSGVTSHGLSCEVCKFKAHKRCAVRATNNCKWTTLASIGKDIIEDADGIAMPHQWLEGNLPVSAKCTVCDKTCGSVLRLQDWRCLWCKAMVHTSCKESLLTKCPLGLCKVSVIPPTALNSIDSDGFWKASCPPSCTSPLLVFVNSKSGDNQGVKFLRRFKQLLNPAQVFDLMNGGPHLGLRLFQKFDTFRILVCGGDGSVGWVLSEIDSLNLHKQCQLGVLPLGTGNDLARVLGWGSACDDDTQLPQILEKLERASTKMLDRWSVMAYEAKLPRQASSSTVTEDFSEDSEVQQILFYEDSVAAHLSKILTSDQHSVVISSAKVLCETVKDFVARVGKAYEKTTESSEESEVMAKKCSVLKEKLDSLLKTLDDESQASSSLPNPPPTIAEEAEDGDGSGSICGSTGDRLVASACPARPQIFRPREQLMLRANSLKKAIRQIIEHTEKAVDEQNAQTQEQEGFVLGLSESEEKMDHRVCPPLSHSESFGVPKGRSQRKVSKSPCEKLISKGSLSLGSSASLPPQPGSRDGLPALNTKILYPNVRAGMSGSLPGGSVISRLLINADPFNSEPETLEYYTEKCVMNNYFGIGLDAKISLDFNNKRDEHPEKCRSRTKNMMWYGVLGTKELLHRTYKNLEQKVLLECDGRPIPLPSLQGIAVLNIPSYAGGTNFWGGTKEDDTFAAPSFDDKILEVVAVFGSMQMAVSRVIRLQHHRIAQCRTVKISILGDEGVPVQVDGEAWVQPPGYIRIVHKNRAQTLTRDRAFESTLKSWEDKQKCELPRPPSCSLHPEMLSEEEATQMDQFGQAAGVLIHSIREIAQSHRDMEQELAHAVNASSKSMDRVYGKPRTTEGLNCSFVLEMVNNFRALRSETELLLSGKMALQLDPPQKEQLGSALAEMDRQLRRLADTPWLCQSAEPGDEESVMLDLAKRSRSGKFRLVTKFKKEKNNKNKEAHSSLGAPVHLWGTEEVAAWLEHLSLCEYKDIFTRHDIRGSELLHLERRDLKDLGVTKVGHMKRILCGIKELSRSAPAVEA

SEQ ID NO: 19129 - protein, 401 aa, Catharanthus roseus
MPKSWPIVISSHSFCFLPNSEQERKMKDLNFHAATLSEEESLRELKAFDETKAGVKGIVDTGITKIPRIFIDQPKNLDRISVCRGKSDIKIPVINLNGLSSNSEIRREIVEKIGEASEKYGFFQIVNHGIPQDVMDKMVDGVRKFHEQDDQIKRQYYSRDRFNKNFLYSSNYVLIPGIACNWRDTMECIMNSNQPDPQEFPDVCRDILMKYSNYVRNLGLILFELLSEALGLKPNHLEEMDCAEGLILLGHYYPACPQPELTFGTSKHSDSGFLTILMQDQIGGLQILLENQWIDVPFIPGALVINIADLLQLITNDKFKSVEHRVLANKVGPRISVAVAFGIKTQTQEGVSPRLYGPIKELISEENPPIYKEVTVKDFITIRFAKRFDDSSSLSPFRLNN

SEQ ID NO: 19130 - protein, 160 aa, Homo sapiens
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVGSTQFCL

SEQ ID NO: 19131 - protein, 163 aa, Homo sapiens
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVRKENQWCEEK

SEQ ID NO: 19132 - protein, 264 aa, Danio rerio
LCQAFSDVLLNIKDVDADDYDNPMLCSEYVKDIYLYLRQLETEQAVRPKYLAGKEVTGNMRAILIDWLVQVQIKFRLLQETMYMTVAIIDRFLQDHPVPKKQLQLVGVTAMFIASKYEEMYPPEIADFAFVTDRAYTTSQIREMEMKVLRVLNFGFGRPLPLQFLRRASKIGDVTAEHHTLAKYFLELTMVDYDMVHYPPSQMASAAYALTLKVFNCGDWTPTLQHYMGYTEDELVPVMQHIAKNVVRVNEGLSKHLAVKNKYS

SEQ ID NO: 19133 - protein, 389 aa, Bacillus circulans
MGGMQVQITNLTEWLADQGVRQDVLTTGIPGIPRTLQLRDRLTVHSVRFMTLPFKSSQTGTVFLDQSWFMGAVKWIVLNGKKNNYDAIHVHASGVVWPLLAGMFAQKYLKKPLILTIHCSRIFTYKPMNKWDQFVHDFVKSVELKSIKLSHKAVVLTDKRLDSYNRLLEDSSKMTAISDCIGSNHLSHSIDCPFCSRLKTELLGKKTVLFLGRIAHEKGWSTFVSVAKELADKIGDLQFIVCGDGPQREAMEEQIKAANLQNQFRITGFISHKFVSCYLHHAQLFLLPSHHEEFGGSLIEAAIAGVPIISTNNGGPADIFTHGETAILKDPGDVSGIADEAYKILTNDSVAESLRLHSRPEVVSKFLPHCVYPNYLNLYSSKEAAVHEG

SEQ ID NO: 19134 - protein, 428 aa, Bacillus circulans
MNLDQAEITALTKRFETPFYLYDGDFIEAHYRQLRSRTNPAIQFYLSLKANNNIHLAKLFRQWGLGVEVASAGELALARHAGFSAENIIFSGPGKKRSELEIAVQSGIYCIIAESVEELFYIEELAEKENKTARVAIRINPDKSFGSTAIKMGGVPRQFGMDESMLDAVMDAVRSLQFTKFIGIHVYTGTQNLNTDSIIESMKYTVDLGRNIYERYGIVCECINLGGGFGVPYFSHEKALDIGKITRTVSDYVQEARDTRFPQTTFIIESGRYLLAQAAVYVTEVLYRKASKGEVFVIVDGGMHHHAASTFRGRSMRSNYPMEYIPVREDSGRRELEKVTIAGPLCTPEDCLGKDVHVPALYPGDLVCVLNSGAYGLSFSPVHFLGHPTPIEILKRNGSYELIRRKGTADDIVATQLQTESNLLFVDK

SEQ ID NO: 19135 - protein, 271 aa, Clostridium beijerinckii
MKNTWLNLEGKTAIVTGGASGIGKAVAQEFLNNGANVVVCDMNPNKPEFDDHNGHMEYIVTNVADRDSVEKMIEKAKEITGTIDIIVNNAGINIPRLLVDKKEPKGKFELDENVWDKVMNVNVKGVFLCAQVAAREMASQGKGVIINMSSESGLEGSEGQSVYAASKNAVNSLTRSWAKELGKLGIRVIGVAPGILEATGLRTLEYETALAYTRGITVEELRAGYSKTSTTPLGRSGKLSEVADLVCYLASDRASYIHGVTYNIAGGKTRG

SEQ ID NO: 19136 - protein, 103 aa, Dioscorea tokoro
GGVMIGDGQSRFSINGKPIYHFVGTSTFSEYTVVHVGCVAKINPSAPLDKVCVLSCGISTGLGAALNVAKPVKGSSVAVFGLGAVGLACRRGKDCRGFENYWC

SEQ ID NO: 19137 - protein, 103 aa, Dioscorea tenuipes
RGVMIGDGQSRFSINGKPIYHFVGTSTFSEYTVVHVGCVSKINPSAPLDKVCVLSCGISTGLGAALNVAKPVKGSSVAVFGLGAVGLACRRGKDCRGFENYWC

SEQ ID NO: 19138 - protein, 119 aa, Dioscorea tokoro
GGVMIGDGQSRFSINGKPIYHFVGTSTFSEYTVVHVGCVAKINPSAPLDKVCVLSCGISTGLGAALNVAKPVKGSSVAVFGLGAVGLAAAEGARIAGASRIIGVDINPKRFNAAKKFGV

SEQ ID NO: 19139 - protein, 119 aa, Dioscorea tokoro
GGVMIGDGQSRFSINGKPIYHFVGTSTFSEYTVVHVGCVAKINPSAPLDKVCVLSCGISTGLGAALNVAKPVKGSSVAVFGLGAVGLAAAEGARIAGALRIIGVDINPKRFNAAKKFGV

SEQ ID NO: 19140 - protein, 485 aa, Nocardioides sp.
MTTPRKFDEYRWNVLVDGVPLNVESRYPISDPSTGRYLTQVPDCAEADVDRAVQASRQAQAEWGALPPRARAAKLRELITLLREHREEFAMLDAIDGGFPISMMRNDVDAALELMDIFADMALDLGGKTIPVSTNLHFTTHEPFGVVARIGAFNHPFFFAASKVAAPLMAGNSVILKAPDQTPLSSLRLAEVAAEVLPQNLLITISGRGRVAGRAIVRHPQIKRIGFIGSTDTGRSIQRDAAEVAVKHISLELGGKNAQIVFADADLEQAALGAVNGMNFTWTAGQSCGSTSRLLVHESVADQVIARVVELVSAIAVGPPLDENAQMGPLVSQAQYDKSVHAIGEGIREGAKVVAGGGRPEGVGEGGWYLAPTVLADVRPGSFIEQNEIFGPVLSVIIFATDDEAVAIANGVEYGLTASVWTSDITRAHLIARRVEAGYVLVNGGSRHYWGLPFGGVKSSGVGSEESMEELISYTETKTTTVVLG

SEQ ID NO: 19141 - protein, 301 aa, Hemicentrotus pulcherrimus
MEDFTKIEKLGEGTYGVVYKGRHKRTGKIVALKKIRLESEEEGVPSTAIREISLLKELYHPNIVLLEDVLMEPNRLYLVFEYLTMDLKKYMESLKGKQMDPALVKSYLHQMVDGILFCHSRRILHRDLKPQNLLIDNNGTIKLADFGLARAFGIPVRVYTHEVVTLWYRAPEVLLGSTRYACPIDMWSLGCIFAEMVTKRPLFHGDSEIDQLFRIFRTLGTPTDEIWPGVTQLQDYKSTFPMWTKPNIKGAVKGMDEEGLDLLEKMLIYDPAKRITAKASMRHPYFDNIPDLSDRLQPIRS

SEQ ID NO: 19142 - protein, 335 aa, Pseudomonas oleovorans
MALSKEVPEFDIDDDLLLMETGIVLETDVVSDEPAVSSVRTRAKSGSSLKQHKYIDYSRALDATQLYLNEIGFSPLLSPEEEVHFARLSQKGDPAGRKRMIESNLRLVVKIARRYVNRGLSLLDLIEEGNLGLIRAVEKFDPERGFRFSTYATWWIRQTIERAIMSQTRTIRLPFHVVKELNVYLRAARELTQKLDHEPSPEEIATLLEKPVAEVKRMLGLNERVSSVDVSLGPDSDKTLLDTLTDDRPTDPCELLQDDDLSQSIDQWLGELTDKQREVVVRRFGLRGHESSTLEDVGLEIGLTRERVRQIQVEGLERLREILEKNGLSSESLFQ

SEQ ID NO: 19143 - protein, 767 aa, Pyrus communis
MAVLLSTLATEIVIPVAAVVGIVFSLVQWFLVSLVKVTPERNAPPSGPNSNKNGCNDYLIEEEEGLNDQNVVVKCAEIQNAISEGSTSFLFTMYQYVGVFMVVFAILIFLFLGSVEGFSTKSQPCTYDAAKTCKPALATAIFSTVAFVLGGITSVLSGFLGMKIATYANARTTLEARKGVGKAFITAFRSGAVMGFLLAANGLLVLFITINLFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIVCLITTLFATDFFEIKAVKEIEPALKKQLIISTVLMTIGIAIVSWIALPSSFTIFNFGVQKVVKNWQLFLCVAVGLWAGLIIGFVTEYYTSNAYSPVQDVADSCRTGAATNVIFGLALGYKSVIIPIFAIAVSIYVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTAKPDYATCVKISTDASIKEMIPPGALVILTPLIVGTFFGVETLSGVLAGSLVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 19144 - protein, 489 aa, Homo sapiens
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKKRKSSSSVQLMESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 19145 - protein, 478 aa, Homo sapiens
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 19146 - protein, 249 aa, Azoarcus sp. EbN1
MTQRLKDKLAVITGGANGIGRAIAERFAVEGADIAIADLVPAPEAEAAIRNLGRRVLTVKCDVSQPGDVEAFGKQVISTFGRCDILVNNAGIYPLIPFDELTFEQWKKTFEINVDSGFLMAKAFVPGMKRNGWGRIINLTSTTYWLKIEAYTHYISTKAANIGFTRALASDLGKDGITVNAIAPSLVRTATTEASALSAMFDVLPNMLQAIPRLQVPLDLTGAAAFLASDDASFITGQTLAVDGGMVRH

SEQ ID NO: 19147 - protein, 862 aa, Lotus japonicus
MWSHHGFHLPQNCAAKEQIWGLVATVRHHRNHLFLLRSAVFHSIIFSFSYVVCNGNGSLTLEDSSWKSGNYRCSSKKYEQCTLSQGMTVHDGTFEAGFFHFENPQHHYFGVWYKSISPRTIVWVANRDAPLRNSTAPTLKVTHKGSILIRDGAKGVIWSTNTSRAKEQPFMQLLDSGNLVAKDGDKGENVIWESFNYPGDTFLAGMKIKSNLAIGPTSYLTSWRNSEDPASGEFSYHIDIRGFPQLVVTKGAAITLRAGPWTGNKFSGAFGQVLQKILTFFMQFTDQEISLEYETVNRSIITREVITPLGTIQRLLWSVRNQSWEIIATRPVDLCADYVFCGANSLCDTSKNPICDCLEGFMPQFQAKWNSLDWAGGCVSMEKLSCQNGDGFMKHTGVKLPDTSSSWFGKNMSLDECRTLCLQNCSCTAYAGLDNDVDRSVCLIWFGDILDMSKHPDPDQGQEIYIRVVASKLDRTRNKKSINTKKLAGSLVVIIAFVIFITILGLAISTCIQRKKNKRGDEGIINHWKDKRGDEDIDLATIFDFSTISSATNHFSLSNKLGEGGFGPVYKGLLANGQEIAVKRLSNTSGQGMEEFKNEIKLIARLQHRNLVKLFGCSVHQDENSHANKKMKILLDSTRSKLVDWNKRLQIIDGIARGLLYLHQDSRLRIIHRDLKTSNILLDDEMNPKISDFGLARIFIGDQVEARTKRVMGTYGYMPPEYAVHGSFSIKSDVFSFGVIVLEIISGKKVGRFYDPHHHLNLLSHAWRLWIEERPLELVDELLDDPVIPTEILRYIHVALLCVQRRPENRPDMLSIVLMLNGEKELPKPRLPAFYTGKHDPIWLGSPSRCSTSITISLLEAR

SEQ ID NO: 19148 - protein, 730 aa, Lotus japonicus
MAQKQSIQDDETLVSPEGTFEAGFFRFGNSLRRYFGIWYKSISPRTIVWVANRDAPVQNSTATLKLTDQGNLLILDGLKGIVWSSNASRTKDKPLMQLLDSGNFVVKDGDKEENLIWESFDYPGDTFLAGMKIKSNLATGPTSYLTSWRNAEDPASGEFSYHIDTHGYPQLVVTKGATVTLRAGPWIGNKFSGASGLRLQKILTFSMQFTDKEVSLEYETANRSIITRTVITPSGTTQRLLWSDRSQSWEIISTHPMDQCAYYAFCGANSMCDTSNNPICDCLEGFTPKFQAQWNSLDWTGGCVPIKNLSCQNGDGFPKHTGVQFPDTSSSWYGNSKSLDECGTICLQNCSCTAYAYLDNVGGRSVCLNWFGDILDMSEHPDPDQGQEIYLRVVASELDHRRNKKSINIKKLAGSLAGSIAFIICITILGLATVTCIRRKKNEREDEGGIETRIINHWKDKRGDEDIDLATIFDFSTISSTTNHFSESNKLGEGGFGPVYKGVLANGQEIAVKRLSNTSGQGMEEFKNEVKLIARLQHRNLVKLLGCSIHHDEMLIYEFMHNRSLDYFIFDSRLRIIHRDLKTSNILLDSEMNPKISDFGLARIFTGDQVEAKTKRVMGTYGYMSPEYAVHGSFSVKSDVFSFGVIVLEIISGKKIGRFCDPHHHRNLLSHSSNFAVFLIKALRICMFENVKNRKAWRLWIEERPLELVDELLDGLAIPTEILRYIHIAL

SEQ ID NO: 19149 - protein, 1230 aa, Cryptococcus neoformans var. neoformans
MSSFTPAFRLHHTHSSSVSPTASNDVAPSSPTPNQPHQLAARSPLYATSPNCASKITKGSSLSSSTAHHGLKYVRPSTSPLLRSPKGESFSAYLGNWGSQELITFLNIHKCGQYLAIFQKNDINGKILLDLDMTALKSMGIGKISERVRLIGGIKDLRRCVADESIRAPFTQRSYPSERTLLPSLPSHSNVLLDKWDCSSSASRLGKRQITLRPPPLDLQGHMPPRLLSHASLGIATIDTHDIHTTNSKIEVYIQQNPPGQPQSMPTKRSDSLTLCAAPSRNVGRRSPSSRHFEGCKSQTDGLTTLNLTLDRQVPSSTMNNVTLREDCHLQREERLPLSHQVPHSRNAFASPHKTSLSGRCPLARGDTTSHQPSGPAIAEQDSPVNYRISNTVTNTKEISQGDLKQPFVMKSLESQSHLLAGVSDMSHDPVTDGFKPKGKASVPLTVMSSSDISAVNANPAALSLADLRRQLVKFINTEDDTIRTVNVMHVTSGVEILERALKKFGKFGTGIHGSPDVYGDEDGDGTLEIDGWEVYTESTPDESSKPLSEFNLLKTCTFHREGTAIQDKGLFLRKKQRMQKRKNIQDFFGETPPPSMSPTSPTLITGPHLSLVQGKSQPTSGSAFSSSSRLSTLTHKGRNRASMISVMSGLGVPIINTLPSPQGNGLRLTGSVHSHEKKSMYNFFGHRPPSELISNHLTDYFPSAKKSDVEKARHSLLRLSGGTVAYKKSGIYEGDSTPDHWSKPGDNQPPSLPPFEPSQDTLSDSLQAFASSTPVHLSRPKHTVALRRRRDSDSSSRSHTSMLMQTRRNRDHSDTTSLLTVDEITAEVENRRVSTIQRGDYIEETEDSSSIEGDTLPQDDESKGVLRAICSDSNKLVDSGKSYQGDSDIDQQHELEDEEEDKLDDDEEEEEEEEEEDNEQGKAFTSTGSKRIIKWIKGALIGAGSFGSVYLGMDAQSGLLMAVKQVELSAGSAKNEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKHPFIGSPRVRTAASNFINGAIASETMEVQVVEES

SEQ ID NO: 19150 - protein, 982 aa, Pseudomonas sp. Y2
MPGAWNVMSATDLPGDSVRSVGNVILNPDDSPQTHSEKMARIILDRMYHFAGLLDRDGTILEINLPALEGAGVRIEDIRGTPFWEARWLAVSEESKELQHQLVQRAAAGEFIRCDLEVYGEGSGEQTIVVDYSLTPLRDNHGEVAFLLAEGRNITSKKKYEQEIARKNAELEKLVEQIRMLDEQKNRFFSNLSHELRTPLSLILGPVDEMLVSSEFSEHQHTNLASIRRNAVTLLRHVNELLDLAKIDAGKLQLAYELIDITGLVKEITAHFEAHAKQRRIHCAVLSPGPILLEADPEKISHVVFNLVANAFNATPDGGRISCHVEIGEGNRCLLTVSDTGPGVPPDMRQRIFERFQQGVEEHGEARAGSGLGLAIVKEFIELHGGTVTVGEAPSSGAIFQVELPAAAPPQVLVRKGSVREQTFSPELPSGGDVSLLPGRGLVSDGRTDLPRVLVVEDNEEMLHLIARTLSNEFSVECASNGKQGFAYMLANPPDLVITDLMLPGMSGEKLIRRMREEGALTQIPVLVLSARADEELRMTLLATLVQDYVTKPFFIPELLSRVRNLVMTRRARLALQDELKTHNADFVQLARELISGRRAIQRSLEAQQKSELRWRAIHENSAVGIAVVDLQWRFVNANPAFCRMLGYTQEELLGHSVLEHTHPDDRNITDQRLHHLLDGRLRTYHHQKRFLHKDGHSLWTRSSVSVIPGSGDTPPLMIGVVEDIDAQKRAEHELERARSELARVMRVTAMGELVASITHELNQPLAAMVANSHACRRWLNSSPPNLKEGIASVEAVVRDSQRAAEVVLRLRMFMRRGETQHEPLNLSGVVEEVLGYVRESLVMQGISLETTLPTDLPMVLADRVQLQQVVLNLVLNAIEAIQAASPSVPRLTLRICRSPDNGPLRLEVEDNGCGVPSSQTERIFEPFYTTKSHGMGMGLAICRTILEAHGGQLNLLPPSDNCSASGSVFQVILPTDQGTLL

SEQ ID NO: 19151 - protein, 502 aa, Pseudomonas sp. Y2
MTRSLTMNSSLSAIDGLRLPHQMLIGGQWVSAQSGKTLNVYNPATGDILTEVPDGDVEDVNAAVESAAGTLRSDTWRRMPPSARERILLRLADLLEVHGDELARLETLNNGKLLIYSKLMEVGASAQWLRYMAGWATKLTGSTLDLSLPLPPEVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 19152 - protein, 394 aa, Medicago truncatula
MGAEKPRSCATYFENSKPYFAMILLQFGYAGMNIITKLSLNGGMSHYVLVVYRHAFATIAIAPFAIIFEWKDQPKITFSVFMQILLLALLGPVIDQNFYYAGLKLTSPTFSCAMSNMLPAMTFVMAVLCRMEIVNLKKLRCQAKVIGTILTVAGAMLMTLYKGPVLELMWTKYIPHSNANITSSSSKDNWFLGSILLIIATLAWSSLFVLQAKAIETYKNHQLTLTSLICFFGTILAFATTLIMENKDSVWTIGWDMNLLAAAYAGIVTSSISYYIQGLVIKKKGPVFATSFSPLMMIIVAIMGFFILAEQLFLGSVIGSILVVIGLYSVLWGKHKEQVECKVSPDDIPLPIKSARINGNMGAFSASFDKHSEVKLDQKEESNISLVIINYNRS

SEQ ID NO: 19153 - protein, 569 aa, Medicago truncatula
MSLLKAVFVWCICLGLFELSLAKGKSHYKFDVEYIYKKPDCKEHVVMGINGQFPGPTIRAEVGDTLVIDLTNKLHTEGTVIHWHGIRQFGTPWADGTAAISQCAINPGETFQYKFKVDRPGTYFYHGHYGMQRAAGLYGSLIVDLPKSQREPFHYDGEFNLLLSDLWHTSSHEQEVGLSSAPMRWIGEPQNLLINGRRQFHCSLASKYGSTNLPQCNLKGGEECAPQILHVEPKKTYRIRIASTTSLASLNLAISNHKLIVVEADGNYVHPFAVDDIDIYSGETYSVLLTTDQDPKKNYWLSIGVRGRKPSTPQALTILNYKPLSASVFPTSPPPVTPLWNDTDHSKAFTKQIISKMGNPQPPKSSHRSIHFLNTQNKIGSFTKWAINNVSLTLPTTPYLGSIKFNLKNTFDKNPPPERFPMDYDIFKNPVNPNTTTGNGVYTFQLNEVVDVILQNANQLNGNGSEIHPWHLHGHDFWVLGYGEGRFRPGVDERSFNLTRAPLRNTAVIFPYGWTALRFKADNPGVWAFHCHIEPHLHMGMGVIFAEAVHKVRNIPKEALKCVLQPRCS

SEQ ID NO: 19154 - protein, 526 aa, Coriolus versicolor
MGKFHSFVNVVALSLSLSGRVFGAIGPVTDLTISNADVTPDGITRAAVLAGGVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDPNASLYDVDDDTTVITLADWYHTAAKLGPAFPAGPDSVLINGLGRFSGDGGGATNLTVITVTQGKRYRFRLVSISCDPNFTFSIDGHNMTIIEVDGVNHEALDVDSIQIFAGQRYSFILNANQSIDNYWIRAIPNTGTTDTTGGVNSAILRYDTAEDIEPTTNATTSVIPLTETDLVPLDNPAAPGDPQVGGVDLAMSLDFSFNGSNFFINNETFVPPTVPVLLQILSGAQDAASLLPNGSVYTLPSNSIEISFPIITTDGALNAPGAPHPFHLHGHTFSVVRSAGSSTFNYANPVRRDTVSTGNSGDNVTIRFTTDNPGPWFLHCHIDFHLDAGFAIVFAEDTADTASANPVPTAWSDLCPTYDALDSSDL

SEQ ID NO: 19155 - protein, 179 aa, Melilotus alba
AHATFYGGSDASGTMGGACGYGNLYSQGYGVNTAALSTALFNSGLSCGACFELKCSNDPSWCHPGSPSILVTATNFCPPNFAQPSDNGGWCNPPRPHFDLAMPMLLKIAQYRAGIVPVSYRRVPCRKQGGIRFSINGFRYFNLVLITNVAGAGDIVKTSVKGSKTGWMSMSRNWGQNWQ

SEQ ID NO: 19156 - protein, 544 aa, Oryza sativa (japonica cultivar-group)
MADTPTSRMIHPFSNIPSQNLKQFQYSDNPQHPCHPYRAPSDTHVVPHHYGLKSHSPDAGYESQATPNKYTLDSSEGAGCMRHDSPSSQSFTTRSGSPLSQEDSHSDSTDGSPVGASCVTEDPNDLKQKLKDLEAVMLGPDSEIVNSLENSVANQLSLEPEKWVRMMGIPRGNLKELLIACARAVEEKNSFAIDMMIPELRKIVSVSGEPLERLGAYMVEGLVARLASSGISIYKALKCKEPKSSDLLSYMHFLYEACPYFKFGYMSANGAIAEAVKGEDRIHIIDFHISQGAQWISLLQALAARPGGPPTVRITGIDDSVSAYARGGGLELVGRRLSHIASLCKVPFEFHPLAISGSKVEAAHLGVIPGEALAVNFTLELHHIPDESVSTANHRDRLLRMVKSLSPKVLTLVEMESNTNTAPFPQRFAETLDYYTAIFESIDLTLPRDDRERINMEQHCLAREIVNLIACEGEERAERYEPFGKWKARLTMAGFRPSPLSSLVNATIRTLLQSYSDNYKLAERDGALYLGWKSRPLVVSSAWH

SEQ ID NO: 19157 - protein, 315 aa, Helianthus tuberosus
MSISCSDCFSDLLCCEDSGILSGDDRPECSYDFEYSGDFDDSIAEFIEQERKFVPGIDYVERFQSQVLDASAREESVAWILKVQRFYGFQPLTAYLSVNYLDRFIYCRGFPVANGWPLQLLSVACLSLAAKMEETLIPSILDLQVEGAKYIFEPKTIRRMEFLVLSVLDWRLRSVTPFSFIGFFSHKIDPSGMYTGFLISRATQIILSNIQEASLLEYWPSCIAAATILCAASDLSKFSLINADHAESWCDGLSKEKITKCYRLVQSPKILPVHVRVMTARVSTESGDSSSSSSSPSPYKKRKLNNYSWIEEDKR

SEQ ID NO: 19158 - protein, 294 aa, Helianthus tuberosus
MEQYEKVEKIGEGTYGVVYKARDKVTNETIALKKIRLEQEDEGVPSTAIREISLLKEMQHGNIVRLQDVVHSDKRLYLVFEYLDLDLKKHMDSCPEFSKDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRIMGTPNEETWPGVTSLPDFKSAFPKWSSKDLATVVPNLEKAGLDLLCKMLWLDPSKRITARTALEHEYFKDIGFVP

SEQ ID NO: 19159 - protein, 304 aa, Helianthus tuberosus
MEDKYEKLEKVGEGTYGKVYKAKDKNTGELVALKKTRLEMDEEGIPPTALREISLLQMLSTSIYIVRLLCVQHIQHKGKPILYLVFEYLDTDLKKFIDSHRKGPNPSPLPPSQIQSFLYQLLKGVAHCHGHGVLHRDLKPQNLLVDKEKGILKIADLGLGRAFTVPLKSYTHEIVTLWYRAPEVLLGSAHYSTGVDMWSVGCIFAEMSRRQALFPGDSEFQQLLHIFRLLGTPTEEVWPGVSSLKDWHVYPRWEAQNLARSVPSLGPEGVDLLSKMLKYDPADRISAKLAMDHPYFDSLDRSQF

SEQ ID NO: 19160 - protein, 464 aa, Edwardsiella tarda
  unsure (1)..(464): unsure at all Xaa locations
MKKGTDTRGGYLDSRFGSEAIRTAAEAHHFPQGEMREDIAFQVINDELFLDGNARQNLATFCQTWDDDYVHRLMDISINKNWIDKEEYPQSAAIDLRCVNMVADLWHAPRPADGQAVGTNTIGSSEACMLGGMAMKWRWRAKRLAQGKSVDKPNMVCGPVQVCWHKFARYWDVELREIPMAPGKLXMDPERMIAACDENTIGVVPTFGVTYTGNYEMPDVLHKALDDLQARTGLDIDMHVDAASGGFLAPFCAPDIVWDFRLPRVKSISASGHKFGLAPLGCGWVVWRDAASLPDDLIFKVDYLGGQVGTFAINFSRPAGRVIAQYYEFLRLGREGYTKVHTASYQVAQFLAAEIAKLGPYEFICSGDPQQGIPAVCFRIPAGKALGYSLYDLSERLRLRGWQVPAFALNGEMSDVVVMRIMCRRGFEMDFAQLLMEDFRAALAYLKAHPAVANVAHQNSFKHS

SEQ ID NO: 19161 - protein, 349 aa, Solanum tuberosum
MSPPLLGVGEEEGQSNVTLLASSTSLGSICKKGSALKERNYMGLSDCSSVDSCNISTSSEDNNGCGLNLKATELRLGLPGSQSPERGEETCPVSSTKVDEKLLFPLHPAKDTAFSVSQKTVVTGNKRGFSDTMDGFSEGKFLSNSGVKSGDAKETSRVQPSKMKDANTQSTVPERPSAVNDASNRAGSGAPATKAQVVGWPPIRSFRKNTLASASKNNEEVDGKAGSPALFIKVSMDGAPYLRKVDLRTYSAYQELSSALETMFSCFTIGQYGSHGAPGKDMLSESKLKDLLHGSEYVLTYEDKDGDWMLVGDVPWEMFIDTCKRLRIMKGSDAIGLAPRAMEKCRSRN

SEQ ID NO: 19162 - protein, 197 aa, Gossypium gossypioides
VVEHVGLNINGEPFVACHECNFPICKSCFEYDLKEGRKACLRCGSPYDENLLDDVEKATGDQSTMAAHLSKSQDVGIHARHISSVSTLDSEMAEDNGNPIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVIC

SEQ ID NO: 19163 - protein, 197 aa, Gossypium davidsonii
VVEHVGLNVNGEPFVACHECNFPICKSCFEYDLKEGRKACLRCGSPYDENLLDDVEKATGDQSTMAAHLSKSQDVGIHARHISSVSTLDSEMAEDNGNPIWKNRVESWKEKKNKKKKPATTKVEREAEIPPEQQMEDKPAPDASQPLSTIIPISKSRLAPYRTVIIMRLIILGLFFHYRVTNPVDSAFGLWLTSVIC

SEQ ID NO: 19164 - protein, 197 aa, Gossypium schwendimanii
VVEHVGLNVNGEPFVACHECNFPICKSCFEYDLKEGRKACLRCGSPYDENLLDDVEKATGDQSTMAAHLSKSQDVGIHARHISSVSTLDSEMTEDNGNPIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVIC

SEQ ID NO: 19165 - protein, 197 aa, Gossypium trilobum
VVEHVGLNVNGEPFVACHECNFPICKSCFEYDLKEGRKACLRCGSPYDENLLDDVEKATGDQSTMAAHLSKSQDVGIHARHISSVSTLDSEMAEDNGNPIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVIC

SEQ ID NO: 19166 - protein, 197 aa, Gossypium turneri
VVEHVGLNVNGEPFVACHECNFPICKSCFEYDLKEGRKACLRCGSPYDENLLDDVEKATGDQSTMAAHLSKSQDVGIHARHISSVSTLDSERAEDNGNPIWKNRVESWKEKKNKKKKPATTKVEREAEIPPEQQMEDKPAPDASQPLSTIIPIPKSRLAPYRTVIIMRLIILGLFFHYRVTNPVDSAFGLWLTSVIC

SEQ ID NO: 19167 - protein, 189 aa, Gossypium gossypioides
HVGLNGNGKPFVACHDCNFPICKTCFDYELKEGRKACLRCGNPYDENLLDDAEKASGDRSTLAAHMDKSQDAGIHARHISSVSTLDSEMTEDNGNPIWKNRVESWKETKNKKKKTSIKVEIEAQVPPEQLMEDKPAADAFQPLSTVIPIPKSRLAPYRTVIIMRLIILGLFFHYRVTNPVDSAFALWLT

SEQ ID NO: 19168 - protein, 189 aa, Gossypium davidsonii
HVGLNGNGKPFVACHDCNFPICKTCFDYELKEGRKACLRCGNPYDENLLDDAEKASGDRFTIAAHMDKSQDAGIHARHISSVSTLDSEMTEDNGNPIWKNRVESWKEKKNKKKKTSIKVEIEAQVPPEQLMEDKPAADAFQPFSTVIPIPKSRLAPYRTVIIMRLIILGLFFHYRVTNPVDSAFALWLT

SEQ ID NO: 19169 - protein, 189 aa, Gossypium schwendimanii
HVGLNGNGKPFVACHDCNFPICKTCFDYELKEGRKACLRCGNPYDENRLDDAEKASGDRSTIAAHMDKSQDAGIHARHISSVSTLDSEMTEDNGNPIWKNRVESWKEKKNKKKKTSIKVEIEAQVPPEQLMEDKPATDAFQPLSTVIPIPKSRLAPYRAVIIMRLIILGLFFHYRVTNPVGSAFALWLT

SEQ ID NO: 19170 - protein, 189 aa, Gossypium trilobum
HVGLNGNGKPFVACHDCNFPICKTCFGYELKEGRKACLRCGNPYDENLLDDAEKASGDRSTIAAHMDKSQDAGIHARHISSVSTLDSEMTEDNGNPIWKNRVESWKEKKSKKKKTSIKVEIEAQVPPEQLMEDKPAADAFQPLSTVIPIPKSRLAPYRTVIIMRLIILGLFFHYRVTNPVDSAFALWLT

SEQ ID NO: 19171 - protein, 189 aa, Gossypium turneri
HVGLNGNGKPFVACHDCNFPICKTCFDYELKEGRKACLRCGNPYDENLLDDAVKASGDRSTIAAHMDKSQDAGIHARHISSVSTLDSEMTEDNGNPIWKNRVESWKEKKNKKKKTSIKVEIEAQVPPEQLMEDKPAADAFQPLSTVIPIPKSRLAPYRTVIIMRLIILGLFFHYRVTNPVDSAFALWLT

SEQ ID NO: 19172 - protein, 315 aa, Gaeumannomyces graminis var. tritici
MTSKDDIRIMGMPPFMIDFLMGGVSAAVSKTAAAPIERIKLLVQNQEEMLKAGRLDRRYDGIMDCFRRTTADEGVMALWRGNTANVIRYFPTQALNFAFRDKFKKMFGYRKEKDGYAKWMAGNLASGGAAGATSLLFVYSLDYARTRLANDNKSAKGGGARQFNGLVDVYRKTLASDGIAGLYRGFGPSVAGIVVYRGLYFGMYDSIKPVVLTGNLETNFLASFALGWCVTTGAGIASYPLDTVRRRMMMTSGEAVKYSSSLDAFRQIVAKEGVKSLFKGAGANILRGVAGAGVLSIYDQLQLIIFGKAFKGGSG

SEQ ID NO: 19173 - protein, 224 aa, Triticum aestivum; identical to SEQ ID NO: 6392

SEQ ID NO: 19174 - protein, 211 aa, Triticum aestivum
MASNQNQASYHAGETKARTEEKTGQVMGATKDKAGQTTEATKQKAGQTTEATKQKAGETAEATKQKAGQATEATKQKAGETAEATKQKAAEAKDKTAQTAQAAKERAAETKDQTGSYLGEKTEMAKQKAAETTEAAKQKASETAQYTKESVAGKDKTGSVLQQAGETVVNAVDGAKDAVANTLGNGPDNATKDTSTGATTKDTTTTTTRNH

SEQ ID NO: 19175 - protein, 211 aa, Triticum aestivum
MASNQNQASYMAGETKARTEEKTGQMMDKAGQATEATKQKAGETAEATKQKAGEAKDKTAQTAQAAKDRAAESKDQTGSFLGEKTEAAKQKAAEATEAAKQKTSETAQYAQERSSDAAQYTKESAVAGKDKTSGVLQQASETVVNAVVGAKDAVANTLGMGGDNTNTAKDTTTEKDHQGSLANLLPLLVWSFAGLLHNCRFPSCVISAHLV

SEQ ID NO: 19176 - protein, 556 aa, Emericella nidulans
MLEDPSYAEIVRWGDDGDSFVVLECEKFTKTILPKHFKHSNFASFVRQLNKYDFHKVRQNNEENGQSPYGQNAWEFKHPEFRANSKESLDNIRRKAPAPRKQAQAHDDSVPTQQIDLLNQQIVAQQQQIQHISDRYAQMSVDHQLMLQEVLRVQKTVVNHENVIHQLVNYLVSIDARQKRDNKAGSFQAQVGASPSQVTPMDDGVSTPLQQASKLLSDMNAEVQFNLVPVESMGEPPKTGVVSTPTMETAPRRMEPVVYPVGATNGIDPMYGEHVNNVPYTVPPKQDMDDRRQFPDNRKKSNHVDPGWMRSPRILLVEDDATCRQIGGKFLYSFSCEIDTALDGLEAVNKVQDGSKYDLILMDIIMPNLDGVSACHLIRQFDRTPIIAMTSNIRSDDIQALLPAWYAASVICSRMDDVLPKPFTRKSLLEMLEKHLVHLKTVPQGMEGHQATTPVTIAGQSSAAQSVTIKEDTSSPSQSPAAAMTAWQSPNQFQPMAAVPANLQQVQGQYVPANPATTAYAMDQEWYAISSTAYGSDGRCWARSKCDRSHVGTSLN

SEQ ID NO: 19177 - protein, 805 aa, Phaseolus vulgaris
MAADRLTRVHSLRERLDETLSANRNEILALLSRIEAKGTGILQHHQVIAEFEEIPEESRQKLIDGAFGEVLRSTQEAIVLPPWVALAVRPRPGVWEYLRVNVHALVVEVLQPAEYLRFKEELVDGSSNGNFVLELDFEPFTASFPRPTLNKSIGNGVQFLNRHLSAKLFHDKESLHPLLEFLRLHSVNGKTLMLNDRIQNPDALQHVLRKAEEYLGTVPPETPYSEFEHKFQDIGLERGWGANAELVLESIQLLLDLLEAPDPCTLETFLGRIPMVFNVVILSPHGYFAQDNVLGYPDTGGQVVYILDQVRALENEMLHRIKQQGLDIVPRILIITRLLPDAVGTTCGQRLEKVFGTEHSHILRVPFRTENGIVRKWISRFEVWPYLETYTEDVAHELAKELQGKPDLIVGNYSDGNIVASLLAHKLGVTQCTIAHALEKTKYPESDIYWKKLEERYHFSCQFTADLFAMNHTDFIITSTFQEIAGSKDTVGQYESHTAFTLPGLYRVVHGIDVFDPKFTIVSPGADQTIYFSPKETSRRLTSFHPEIEELLYSSVENEEHICVLKDRTKPIIFTMARLDRVKNIPGLVEWYGKNEKLRELVNLVVVAGDRRKESKDLEEKAEMKKMYSLIETYKLNGQFRWISSQMNRVRNGELYRVISDTRGAFVQPAVYEAFGLTVVEAMTCGLPTFATCNGGPAEIIVHGKSGFHIDPYHGDRAADLLVEFFEKCKVEPSHWDTISQAGLQRIEEKYTWQIYSQRLLTLTGVYGFWKHVSNLDRLESRRYLEMFYALKYRKLAESVPLAVE

SEQ ID NO: 19178 - protein, 540 aa, Brassica napus
MNTFTSNSSDLTSTTTQTSPFSNMYLLTTLQAFAAITLVMLLKKVFTTDKKKLSLPPGPTGWPIIGMVPTMLKSRPVFRWLHSIMKQLNTEIACVRLGNTHVITVTCPKIAREILKQQDALFASRPMTYAQNVLSNGYKTCVITPFGEQFKKMRKVVMTELVCPARHRWLHQKRAEENDHLTAWVYNLVKNSGSVDFRFVTRHYCGNAIKKLMFGTRTFSENTAPDGGPTAEDIEHMEAMFEALGFTFSFCISDYLPMLTGLDLNGHEKIMRDSSAIMDKYHDPIVDARIKMWREGKRTQIEDFLDIFISIKDEQGNPLLTADEIKPTIKELVMAAPDNPSNAVEWAMAEMVNKPEILHKAMEEIDRVVGKERLVQESDIPKLNYVKAILREAFRLHPVAAFNLPHVALSDATVAGYHIPKGSQVLLSRYGLGRNPKVWADPLSFKPERHLNECSEVTLTENDLRFISFSTGKRGCAAPALGTALTTMMLARLLQGFTWKLPENETRVELMESSHDMFLAKPLVMVGELRLPEHLYPTVK

SEQ ID NO: 19179 - protein, 289 aa, Zea mays
MPAGQPHAHEAAAAACVGSGANHSNHRVPAHSPPPLPAEVVPAYPPPESEDDETWVWTQIKAEARRDADAEPALASFLYATVLSHPSLPRSLSFHLANKLCSSTLLSTLLYDLFLATLTAHPSLRAAVVADLLAAHSRDPACVGFSHCLLNYKGFLAIQAHRVAHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARSTAVGTLPG

SEQ ID NO: 19180 - protein, 385 aa, Frankia sp. ACN14a
MAAVPDDGDELDVSAVAEVIARGREAGEISRSELRDALESADIGLELLPALIAKLSAAGVELLEEEETTDDVTAATRSTAEHAGTADLVRMYLREIGKVPLLNAAQEVELSKRVEAGLFAEHKLESDPDLPADLRRDLGLLVKDGHAAKQQLVSANLRLVVSVAKKYSGRGMTLLDLVQEGNLGLIRAVEKFDYAKGYKFSTYATWWIRQAIGRALADQARTIRIPVHVVEQINKITRLQRQLVSTLGREPTDEELALELDMPIEQVVELRRYAQDTVSLETSVGDDGDSVLGDFIEDSDATSPADAASYGAMQDEIENVLGGLNPREREVMRLRFGLADGKQHTLAEVGNRLGLTRERIRQIERDTLRELRKPAVAGRLREFLD

SEQ ID NO: 19181 - protein, 185 aa, Frankia sp. ACoN24d
  unsure (1)..(185): unsure at all Xaa locations
SGRGMTLLDLVQEGNLGLIRPVKKFDYAKGYKFSTYATWWIRQAIGRALADQGRTIRIPVXVVEQINKITRLQRQLVSTLGREPTDEELALELDMPIEQVVELRRYAQDTVSLETSVGDDGDSVLGDFIEDSDATSPADAASYGAMQDEIENVLGGLNPREREVMRLRSASPTASSTPSPRWVTG

SEQ ID NO: 19182 - protein, 237 aa, Gossypium barbadense
LTDDHCQYFLYQLMRGLKYIHSANALHRDLKPSNLLLNANCDLKICDFGLARTTSETDFMTEYVVTRWYRAPESLLNCSEYTAAIDIWSVGCILMEIIRREPLFSGKDYVQQLGLITQLLGSPEDSDLGFLRSDNARKYVKQLPHFPKQPFAGKFPDVSPLAIDLAEKMLVFDPSKRITVEEALNHPYLSSLHEINEEPTCPSPFVFDFEQMALNEEDIKELIWRESLNFNQDKMPE

SEQ ID NO: 19183 - protein, 1112 aa, Bordetella avium
  unsure (1)..(1112): unsure at all Xaa locations
MIYPDRDSALHALADGKIDAVDDVDGAALMGQHFRQHPXLYQQSXRTGGAALNAPPPSDLGXLLIAVNPRSQPAAMVHEGPQLRWQTYPNPLLGLSAVAYGQADAYIGDPLAIAYYITAGVFNDLQVQRHNDLGTRANTYTLSTNSKTLRAILNQTIASIPEIWRQNVVYRWGLPGGVLFPPPMPALTEREKRWLQRHKEVSVVSLNVFPPFSMQNRNDTELSGMSIDVLRRIGQITGLRFNLRGVDSSAEMESALKDGTAEMSAGLFWSEEREDTLDFSSPYLTTAFVLVGRRDTAHLPANTDLAGMRIASISSSPVLEALRKHYPQSEIVLVGSPNEALLAVLNGKVDYAVQTQIGANFYLSNYFRNELAIATALNTPPVRLAFAFSRDQDELRGIIDKAITSLPADDQIYLLNRWRMETAPDIKHLVLPIVGEIYLLIGAGIIFCLDFLAWIYYLRRQIGKXRVAERXLSDQLAFMXVLIDGIPNPVFVRXREGRMVTCNRSYLETFDVTRDAVQGRTLIDSPIGLEDPEQAKTVTSNIWTPAAQQRRRFQDIEVTLHGEKRYIYHWLXXYSDSXGRVKGLIGGWTDLTERIRLLXDLHEAKEEADAANRAKSTFLATMSHEIRTPMNAIIGMLELELRRPADQATDRSALQITYDSARSLLDLIGDILDISKIEADRLELSPHPTDLRKLLDGIINVFQGLARQHGLSLTLQIDPPHPXXVLLDATRLKXVISXLVSNALKFTEVGGVIVSLKVRTXEDXRAKIELAVDDSGPGISSADRQRLFEPFXXVHDQAKAARAAGTGLGLVISRRLIEAMGGHFDLSSIPGKGTRIDVLLNADITTAVEETASPETEPATTPARLNVLVIDDHPPNRLLMCQQLAFIGHDAQEAADGPKGLALWRQHDFDVILTDCNMPGMSGYALAREIRRIETEESRPRTPIYAITASAQAEEFARCEAAGMDGCLFKPLDIDALSKHLLPIALAKSSAPMQQTSPPSSPVTFQPQGLLDLTQGDAVMIRNLVETLINTNREDAEHLLQSIDDPEAVADLAHRIAGGARVVAATQTADLAVALEADARGGQTDNAQAVQALVEAMRQLEAELQAWLASRA

SEQ ID NO: 19184 - protein, 2621 aa, Bordetella avium
  unsure (1)..(2621): unsure at all Xaa locations
MYVPIAEIKTAGRKKSTRARRKLGGVPRACRLSSAILLAFAIPDFAAAEVVAANNKSAVIEARTGVPVINIAAPNAQGLSHTQLQQLNVGRPGVVFNNSLHDGQSHIAGRVLANPNLSGHAAKSILAEVTGTSPSSLAGTLEVFGNKADLIVANPNGITVNGLTTLNAGSLTLTTGVPTVRGDSVSLAVDKGRLTVGDEGVNTDGLKTFDMVAKLIQIDGAIGSSGQKSDIKAIAGTSVFDTATRTHTAKTRVARAAAQDGGGYAIDGSAAGAMHGKAITLIATDAGLGVRQPGSLSSENDISVQADGNIQVGKTQGKNISTVSGAAASVGTAVARQNLTLKAQSGLSIDAFNVKGDANLQTASGVLWLGPETGAVSDGKSSTGGRLSVAASDGGVVVSRYVDTDSLELKASNLHINHALIDVKGSDKQPATIDVSGSITMAGTLSAVRVDGETINNASITLENGVPVVRDGLTGQALPGAEISSDAGIRAHQGDIQLKAGSLHNNGGMLLSAHGLEVKATSLIENKGILRTKNQLALSGQNIDNAFAVLSDQDVQLLAAGKFSNTGTVLADKGALLIGANASINNQGVLNAGGRLTLGGLAADAGQEGSPDIVSAGRILSDGLTVSGRQFDNQGKLTVRGGGVSIKVEDALRSTGEVQVGVGSEVQATANTIHLGGKFVSLSQVSLSAAGDTDIDGKGRVSVKQLSLSTHNLHNTGSVSISGAGNIQARGSVENQGKLQGVNLTLEAQHLDNKGSSAVLRGTRSLDATVKGYVNNEGRVESQALVVQAQNLRNQAEATIIGNKGATLKVAEQLRNGGTIRSNASLTVSAGSLDNLLGAKLQADTATLDVRDQMRNAGEVLVKQQLSVKAAELDNVESGSISASDAGLNASALNNTGKIAAVNDIVSNVGDYRNTGHISAGANASFXVTNTDGLDIDPERRAAVANGALTYEARSLRVRDAIQNPGNIVLKATQGDIDNDSQIVTPQNLMLTAQGDIINEAGALMWAGQNISLSGRNINNERDAWIMTQDGDITLQGSNRVRNRVGRIDAGKNLVIDAPRTENLSELSGEVGGFSSDTPENVITQKNLGHWRVGRWVRTKIDDFSVRRPMSTLSVKQGLMLASGDIHLNQHEQKGQGSQIYNEGIVLAGKVLKADGSTDNRSLSKPLNVIDFFKQNVGGHYVTSVVDSLALANVDERAFPSLYDLLDFVFSDPNRWVTLFVAYGYHPADVATVLMSADMTHAPEFNKMLNHVMGSDWRALDATQRHVRWTEAKAGKRAAMDFYPDAQTVMAGRKGVEITGGKIMLGGNATQSASEAQLTAAQRGHANIGKADVAIVTGTLDAVFASSDGMSYVGKDDLISQDPVLQELLGNRFVFGRAPDKLAAQASEASGDALPKPYYETRLAYIDQGQFYGSSYFFQQVGYQPHQGVRVLGDNYFDTQMIQRERARLLAGAEGRDILQGASLVKAMMDNAAAQAGALGLKVGEALTEKQISGLENDIVWYVWANIEGKPVMVPRVYLAKQSKKAAEDSRKRGGAVIASAGAINAKTNGADVAVYNAVFMGDAGVHVDARGAGADSGNIAFTSTGGVLGGAFSKENVDLHGQNIRISGGAINAKRVTLDAKDKLEIIVGMTHDDKGRLVRDLRADQVNGQQSVNLSAKAITTEGATIASQGSVSLKADNVHLGDVKEVGSEYRHTVHNGLGEFFSFLSQTNTIEKSAQANSAGTDISTKALKINTTGDLTVTGGNVQATNSDIDVGGNLKLEAGKNDSYHDFKEDKRQILVGMDVGAGGYSASAGFDTEDGLQTYAGRAGPNSGGATFNLGASISSEKETRQAETYSNGVFNVGNGLIKVGSMADIGGADINNHRAGDDQSQQQDGGLSLTANEIKTTKYVDKEKRDYSKVGFSVGYQAYAKSSLLTTSSRFGDMIAQTVDDPKRKVDPALAAAMAATEATQLLFDDTVSAGEHVGADVFWQRQSSTHTKENTQRIGGNVSFNATKGDIDLVGTQFSGGNKVELDARGDVSLRAAKSTTTSSGEDHRVGLDVGRSYGVNAPLRSAGAGIWATLSGTHLVSHENSTTYENATLGAQNIDIKAGKNLGLIGATVKADHSANVVVGGDTTIKSLQNDIKREANGGNWAVGAVISVNSNTLVSASASLGGSAEHHHDNARVVTQQAGITAGGPLTLKTGGSLGMTGSHLVSSTKEGHIGVGGSINATKLHDKIDKDGGKGGANFAVNPTTGLPMVNFEYGRDARDHVESTNNVVINVGTKARGGVHGSVSTDPSKEVVVTREEYYAGGESVLSVPTSKPKFLMRERKNKIDPSPPPPPPPPPPPPPPPKVKKVDPPPPPPPPKVKKVDPPPPPPPPPPKVKKVDPPPPPPPPPPKVKKVDPPPPPPPPPPPKVKKVDPPPPPPPPPPKVKKVDPPPPPPPPPPKVKKVDPPPPPPPPPPPKVKKVDPPPPPPPPPPKVKKVDPPPPPPPPPPKVKKVDPPPPPPPPPKVKKVDPPPKDEVDGPKPAPKPKAQPRPSPSTARYEVQKQVKDLQGKVSAMNLMKDGPGGKLQKPVTLTVVGPDGPTTVVLKKRGDVMKLDGFLMMSSPAQGAKQELRLKIIDEGGQNYRVTYRSVK

SEQ ID NO: 19185 - protein, 282 aa, Mus musculus
GCTFKDKVLAAARRNASAVVVYNLESNGNATEPMSHAGTGNIVVIMISYPKGREIFDLVQKGIPVKMRIEIGTRHMQEFISGQSVVFVAIAFITMMIISLAWLIFYYIQRFLYTGSQFGSQNHRKETKKVIGQLPLHTVKHGEKGIDVDAENCAVCIENFKVKDVIRILPCKHIFHRICIDPWLLDHRTCPMCKLDVIKALGYWGDPEDTQELPTPEAAPGRVSVGNLSVTSQDEERSESNLPSSSSSESGPHRPCLKEDAGEDTALLGAGRSEPQHGGSIC

SEQ ID NO: 19186 - protein, 316 aa, Mus musculus
MLLCVSCLSVNGEMNPLGPTPSVHRSVSFWLLRLSVFLLLSFRDSKGKAIWTAHLNITFQVGNRIISELGESGVFGNHSPLERVSGAVVLPEGWNQNACSPLTNFSRPDQTDTWLALIERGGCTFTHKINLAAEKGANGVIIYNYPGTGNKVFPMSHQGTENIVAVMIGNLKGMELLHLIQQGVYVTIIIEVGRMHMPWLSHYVMSLFTFLAATVTYLFLYCAWRPRVSNSSTRRQRQLKADVKKAIGQLQLRVLQDGDKELDPNEDSCVVCFDMYKAQDVIRILTCKHFFHKTCIDPWLLAHRTCPMCKCDILKP

SEQ ID NO: 19187 - protein, 340 aa, Mus musculus
MNISFHVGNRMLSELGETGVFGRSSILKRVAGVVVPPEGKIQNACDPNTTFILPRNKEPWIALIERGGCAFTQKIKVASEHGARGVIIYNFPGTGNQVFPMSHQAFEDIVVVMIGNIKGMEILHLIRKGVHVTVMVEVGREHVIWLNHYFVSFMIVTTATLAYFTFYHIRRLWVARIENRRWKRLTRELKKAFGQLQVRVLKEGDEEVNPNADSCVICFEAYKPNEIVRILTCKHFFHKNCIDPWILAHGTCPMCKCDILKALGIQMDIEDGTDSLQVLMSNELPGTLSPVEEETNYELPPARTSSKVTHVQEHPTSSANAGSQPPEAEETSHPSHGQQV

SEQ ID NO: 19188 - protein, 528 aa, Lycopersicon esculentum
SDAIRILREIKLLRLLRHPDIVDIKRIMLPPSKRDFKDIYVVFELMESDLHHVIKANDDLSHEHHRFFLYQMLRALKYMHTANVYHRDLKPKNILANANCKLKVCDLGLARVSFSDTPTTALWTDYVATRWYRAPELCGSFFSKYTPAIDIWSIGCIFAEVLTGKPLFPGKSVVHQLHLMTDPLGTPSADSKSGVRNEKARKYLTSMRKKNPVPFTEKFPGADPLVLRLLQRLLAFDPKDRPTAEEALSDPYFKGLAKIEREPSCRPISNLEFEFERRRVTKEDIKELIFREILEYHPQLQKDYIAGNDGTNFLYPSATDQFRRQFAYLEENNDKSGPVIPLGREHVSLPRSAVNSSTDPPKLAEFSGFDHTQVTEKSSTDVRVAEKTSGTIQNISRPPHGVHAAKPGRVVGPILPYDGRMLTQNTGLLPHGISPHYMFRMNPGNREKCGTESKDATQVRPLPAQCNMSVEMNTNPYYPAQEKVAQLGGQIAIDAKLLQAQTKFGAVGAAAVAVAAHREVGTIQYSLT

SEQ ID NO: 19189 - protein, 1744 aa, Mus musculus
LKPECALDKSWCQEELPVAVRRAVSLLHTHTIPSRVGKGEPDAAPLSAPAFSLVFPMLKMVLTEMPYHSEEEEEQMAQILQILTVHAQLRASPDTPPERVDENGPELLPRVAMLRLLTWVIGTGSPRLQVLASDTLTALCASSSGEDGCAFAEQEEVDVLLAALQSPCASVRETALRGLMELRLVLPSPDTDEKSGLSLLRRLWVIKFDKEDEIRKLAERLWSTMGLDLQSDLCSLLIDDVIYHEAAVRQAGAEALSQAVARYQRQAAEVMGRLMEIYQEKLYRPPPVLDALGRVISESPPDQWEARCGLALALNKLSQYLDSSQVKPLFQFFVPDALNDRNPDVRKCMLDAALATLNAHGKENVNSLLPVFEEFLKDAPNDASYDAVRQSVVVLMGSLAKHLDKSDPKVKPIVAKLIAALSTPSQQVQESVASCLPPLVPAVKEDAGGMIQRLMQQLLESDKYAERKGAAYGLAGLVKGLGILSLKQQEMMAALTDAIQDKKNFRRREGALFAFEMLCTMLGKLFEPYVVHVLPHLLLCFGDGNQYVREAADDCAKAVMSNLSAHGVKLVLPSLLAALEEESWRTKAGSVELLGAMAYCAPKQLSSCLPNIVPKLTEVLTDSHVKVQKAGQQALRQIGSVIRNPEILAIAPVLLDALTDPSRKTQKCLQTLLDTKFVHFIDAPSLALIMPIVQRAFQDRSTDTRKMAAQIIGNMYSLTDQKDLAPYLPSVTPGLKASLLDPVPEVRTVSAKALGAMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVDRRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLFFSESLVPTARKALCDPLEEVREAAAKTFEQLHSTIGHQALEDILPFLLKQLDDEEVSEFALDGLKQVMAVKSRVVLPYLVPKLTTPPVNTRVLAFLSSVAGDALTRHLGVILPAVMLALKEKLGTPDEQLEMANCQAVILSVEDDTGHRIIIEDLLEATRSPEVGMRQAAAIILNMYCSRSKADYSSHLRSLVSGLIRLFNDSSPVVLEESWDALNAITKKLDAGNQLALIEELHKEIRFIGNECKGEHVPGFCLPKRGVTSILPVLREGVLTGSPEQKEEAAKGLGLVIRLTSADALRPSVVSITGPLIRILGDRFNWTVKAALLETLSLLLGKVGIALKPFLPQLQTTFTKALQDSNRGVRLKAADALGKLISIHVKVDPLFTELLNGIRAVEDPGIRDTMLQALRFVIQGAGSKVDAAIRKNLVSLLLSMLGHDEDNTRISTAGCLGELCAFLTDEELNTVLQQCLLADVSGIDWMVRHGRSLALSVAVNVAPSRLCAGRYSNEVQDMILSNAVADRIPIAMSGIRGMGFLMKYHIETGGGQLPPRLSSLLIKCLQNPCSDIRLVAEKMIWWANKEPRHPLEPQTIKPILKALLDNTKDKNTVVRAYSDQAIVNLLKMRRGEELLQSLSKILDVASLEALNECSRRSLRKLACQADSVEQVDDTILT

SEQ ID NO: 19190 - protein, 791 aa, Mus musculus
GPAPAHQCTSGRSFQTLVLRSPSRAQPGEDSSSSRPQTTQPPPATGSISKPAMSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGGPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASASRRGTTKSPGPSRRSKSPASTSSVNGTPGSQLSTPRSGKSPSPSPTSPGSLRKQRISQHGGSSTSLSSTKVCSSMDENDGPGEEESEEGFQIPATITERYKVGRTIGDGNFAVVKECIERSTAREYALKIIKKSKCRGKEHMIQNEVSILRRVKHPNIVLLIEEMDVPTELYLVMELVKGGDLFDAITSTSKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGGDDQEVLFDQILMGQVDFPSPYWDNVSDSAKELINMMLLVNVDQRFSAVQVLEHPWVNDDGLPENEHQLSVAGKIKKHFNTGPKPSSTAAGVSVIATTALDKERQVFRRRRNQDVRSRYKAQPAPPELNSESEDYSPSSSETVRSPNSPF

SEQ ID NO: 19191 - protein, 317 aa, Oryza sativa (japonica cultivar-group)
MSTARVYADVNVHRPREYWDYEALAVEWGEQDDYEVVRKVGRGKYSEVFEGINVTNDERCIIKILKPVKKKKIKREIKILQNLCGGPNIVKLHNIVRDQQSKTPSLIFEYVNSTDFKVLYPTLTDYDIRFYIYELLKALDYCHSQGIMHRDVKPHNVMIDHELRKLRLIDWGLAEFYFPEKEYFKGPELLVDFQSYDYSLDMWSLGCMFAGMIFRKEPFFYGHDNHDQLVKIAKVLGTDQLNAYLNKYRIALDPQLEALIGRHTRKPWSKFINPENRHLVSPEAIDFLDKLIRFDHHDRLTAREAMVGSCQAIHSQA

SEQ ID NO: 19192 - protein, 1095 aa, Drosophila melanogaster
MTKKYEFDWIIPVPPELTTGCVFDRWFENEKETKENDFERDALFKVDEYGFFLYWKSEGRDGDVIELCQVSDIRAGGTPKDPKILDKVTKKNGTNIPELDKRSLTICSNTDYINITYHHVICPDAATAKSWQKNLRLITHNNRATNVCPRVNLMKHWMRLSYCVEKSGKIPVKTLAKTFASGKTEKLVYTCIKDAGLPDDKNATMTKEQFTFDKFYALYHKVCPRNDIEELFTSITKGKQDFISLEQFIQFMNDKQRDPRMNEILYPLYEEKRCTEIINDYELDEEKKKNVQMSLDGFKRYLMSDENAPVFLDRLDFYMEMDQPLAHYYINSSHNTYLSGRQIGGKSSVEMYRQTLLAGCRCVELDCWNGKGEDEEPIVTHGHAYCTEILFKDCIQAIADCAFVSSEYPVILSFENHCNRAQQYKLAKYCDDFFGDLLLKEPLPDHPLDPGLPLPPPCKLKRKILIKNKRMKPEVEKVELELWLKGELKTDDDPEEDASAGKPPEAAAAPAPAPEAAAAAEGAAEGGGGAEAEAAAANYSGSTTNVHPWLSSMVNYAQPIKFQGFDKAIEKNIAHNMSSFAESAGMNYLKQSSIDFVNYNKRQMSRIYPKGTRADSSNYMPQVFWNAGCQMVSLNFQSSDLPMQLNQGKFEYNGGCGYLLKPDFMRRADKDFDPFADAPVDGVIAAQCSVKVIAGQFLSDKKVGTYVEVDMFGLPSDTVKKEFRTRLVANNGLNPVYNEDPFVFRKVVLPDLAVLRFGVYEESGKILGQRILPLDGLQAGYRHVSLRTEANFPMSLPMLFVNIELKIYVPDGFEDFMAMLSDPRGFAGAAKQQNEQMKALGIEEQSGGAARDAGKAKEEEKKEPPLVFEPVTLESLRQEKGFQKVGKKQIKELDTLRKKHAKERTSVQKTQNAAIDKLIKGKSKDDIRNDANIKNSINDQTKQWTDMIARHRKEEWDMLRQHVQDSQDAMKALMLTVQAAQIKQLEDRHARDIKDLNAKQAKMSADTAKEVQNDKTLKTKNEKDRRLREKRQNNVKRFMEEKKQIGVKQGRAMEKLKLAHSKQIEEFSTDVQKLMDMYKIEEEAYKTQGKTEFCA

SEQ ID NO: 19193 - protein, 733 aa, Mus musculus
MSGSRQAGSGSAGTSPGSSAASSVTSASSSLSSSPSPPSVAASAATLVSGGVAPAAGSGGLGGPGRPVLVAAAVSGSASAGGAVSAGQSRLSCAARPSAGVGGSSSSLGSSSRKRPLLVPLCNGLLNSYEDKSNDFVCPICFDMIEEAYMTKCGHSFCYKCIHQSLEDNNRCPKCNYVVDNIDHLYPNFLVNELILKQKQRFEEKRFKLDHSVSSTNGHRWQIFQDLLGTDQDNLDLANVNLMLELLVQKKKQLEAESHAAQLQILMEFLKVARRNKREQLEQIQKELSVLEEDIKRVEEMSGLYSPVSEDSTVPQFEAPSPSHSSIIDSTEYSQPPGFSGTSQTKKQPWYNSTLASRRKRLTAHFEDLEQCYFSTRMSRISDDSRTASQLDEFQECLSKFTRYNSVRPLATLSYASDLYNGSSIVSSIEFDRDCDYFAIAGVTKKIKVYEYGTVIQDAVDIHYPENEMTCNSKISCISWSSYHKNLLASSDYEGTVILWDGFTGQRSKVYQEHEKRCWSVDFNLMDPKLLASGSDDAKVKLWSTNLDNSVASIEAKANVCCVKFSPSSRYHLAFGCADHCVHYYDLRNTKQPIMVFKGHRKAVSYAKFVSGEEIVSASTDSQLKLWNVGKPYCLRSFKGHINEKNFVGLASNGDYIACGSENNSLYLYYKGLSKTLLTFKFDTVKSVLDKDRKEDDTNEFVSAVCWRALSDGESNVLIAANSQGTIKVLELV

SEQ ID NO: 19194 - protein, 514 aa, Solanum tuberosum
MDGTAVQGTSSVDSFLRNYKLGKTLGIGSFGKVKIAEHTLIGHKVAVKILNRRKIRNMDMEEKVSREIKILRLFMHGHISRLYEVIETPSDIYVVMEYVKSGELFDYIVEKGRLQEDEARNFFQQIISGVEYCHINMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGYITLPSHLSAGARDLIPRMLIVDPMKRMTIPEIRLHPWFQAHLPRYLAVPPPDTMQQAKKIDEEILQEVVKMGFDRNNLTESLRNRVQNEGTVPYYLLLDNRHRVSTGYLGAEFQESMEYGYNRINSNETAASPVGQRFPGIMDYQQAGARQFPIERKWALGLQSRAHPREIMTEVLKALQELNVCWKKIGQYNMKCRWVPSVPGHHEGMGVNSMHGNQFFGDDSSIIENDGDTKLTNVVKFEVQLYKTREEKYLLDLQRIQGPQFLFLDLCAAFLAQLRVL

SEQ ID NO: 19195 - protein, 666 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKAPRVPDILSSVRRGSGAPEAEGPLPCPSPAPFSPLPAPSPRISDILNSVRRGSGTPEAEGPLSAGPPPCLSPALLGPLSSPSPRISDILNSVRRGSGTPEAEGPSPVGPPPCPSPTIPGPLPTPSRKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 19196 - protein, 542 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 19197 - protein, 518 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 19198 - protein, 517 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAKSLLNKKADGVKPQTNSTKNSAAATSPKGTLPPAALEPQTTVIHNPVDGIKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 19199 - protein, 503 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKPQTNSTKNSAAATSPKGTLPPAALESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 19200 - protein, 492 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKEPQTTVIHNPVDGIKESSDSANTTIEDEDAKARKQEIIKTTEQLIEAVNNGDFEAYAFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 19201 - protein, 479 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSAAKSLLNKKADGVKESSDSANTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 19202 - protein, 449 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 19203 - protein, 156 aa, Drosophila sp.
FQNIFMAMQSMIKAMDMLKISYGQGEHSELADLVMSIDYETVTTFEDPYLNAIKTLWDDAGIQECYDRRREYQLTDSAKYYLSDLARIEQADYLPTEQDILRARVPTTGILEYPFDLDGIVFRMVDVGGQRSERRKWIHCFENVTSIIFLVALSEY

SEQ ID NO: 19204 - protein, 335 aa, Vibrio cholerae
MSVSNTVTKVEEFDFEDEALEVLETDAELTSDEELVAVEGASEDVREEFDASAKSLDATQMYLSEIGFSPLLTAEEEVLYARRALRGDEAARKRMIESNLRLVVKISRRYSNRGLALLDLIEEGNLGLIRAVEKFDPERGFRFSTYTTWWIRQTIERALMNQTRTIRLPIHVVKELNIYLRTARELSQRLDHEPTPEEIALELDRPVDDVTKMLRLNERISSVDTPIGGDGDKALLDILPDSHNADPEFSTQDDDIRESLLNWLDELNPKQKEVLARRFGLLGYEPSTLEEVGREINLTRERVRQIQVEGLRRLREILVKQGLNMEALFNVEYDN

SEQ ID NO: 19205 - protein, 563 aa, Physcomitrella patens
  unsure (1)..(563): unsure at all Xaa locations
MMAVALPGQLNLDETPTWGSRSVDVYEKIEHIGEGTYGQVYMAKDKSTGEVVALKKVRMDNEKEGFPITAIREIKILKKLQHANVIKLKEIVTSKGPEKEDNIKPGDASKFKGSIYMVFEYMDHDLTGLADRPGMRFSIPQIKCYMKQLLTGLHYCHVNQVLHRDIKGSNLLIDNNGILKLADFGLARSFSNDQNGQPLTNRVITLWYRPPELLLGSTKYTPAVDMWSVGCIFAELLNGKPILPGRNESEQFQKICELCGSPDEXNWPRVSQLPYYNQFKPERLMKRRVKDVFKHFDRHALELLERMLTLDPDHRISAKDALDAEYFWVEPFPCQPSSLPKYEASHEYQTKKKRQQQRQQQEEQAKRMKVLHHPAPHTRLPPIQQQPLRPGPHQPGHNLGPPIHANGMANQHNNYNRGQGASNQGRAPGGGRPPHGGPNQNGGYGGPNRGGPGGAYGGPAQPGGFAAPNMGHQGGRGGAYGGPAGGVYPAGPYGGGRGPPVGGRGQQFGGMPGGPQPPAYGGQHYMQQPTAQYVDIDGAYARASHSGFQPPSPHRPDYRQQQR

SEQ ID NO: 19206 - protein, 500 aa, Plasmodium knowlesi
MKNSNEISSSQSLKNNGSDGFFNTSLMYVLAACLASFLFGYQVSVLNTIKDFIVIEFGWCAGKEVNCDDSTLKSSFLLASVFIGAVVGSGFSGFLVQHGRRFSLLVIYNFFILVSILTSITHHFHTILFSRLLSGFGIGLITVSVPMYISEMTHKDKKGAYGVLHQLFITFGIFIAVLLGMAMGNVPEEVNNPLGTFQQIWWRLMFFFPCIISILGIVLLTFFFKEETPYYLFEKGKVEESKEILKKIYGSDDVDEPLKAIKDAVEQNEAAKKNSISLMRAMKIPSYRYVILLGCILSGLQQFTGINVLVSNSNALYKGFLTNEWITTLSVIMTVVNFLMTFPAIYIVEKLGRKTLLLCGCAGIVCAFLPTAIANLINNTSDVVKKLSISATFVMIVSFAVSYGPVLWIYLHEMFPSEIKDSAASLASLVNWMCAIIVVFPSDIIIKQSPTILFFIFSGMSIVAFLFIFFFIKETKGGEIGTSPYITLEERQKHMGKSVV

SEQ ID NO: 19207 - protein, 498 aa, Plasmodium vivax
MKKSSKEISSSQSLKNGGSDHFFYTSFMYVLGRCLASFIFGSQVSVLNTIKNFIVIEFGWCTGNKVECDDSTLKSSFLLASVFIGAVVGSGFSGYLVQHGRRFSLLVIYNFFILVSILTSITHHFHTILFSRLLSGFGIGLITVSVPMYISEMTHKDKKGAYGVLHQLFITFGIFVAVLLGMAMGEAPDAQKAASLEEFQKIWWRLMFFFPCLISILGIVLLTFFYKEETPYYLFENGKIEESKKILKKIYGTDNVDEPLKAIKDAVEQNEAAKISLMRAMQIPSYRNVILLGCILSGLQQFTGINVLVSNSNELYKEFLSNKLITTLSVIMTVVNFLMTFPAIYIVEKLGRKTLLLCGCAGVICAFLPTAIANQIDRSSDFVRNLSIAATFVMIISFAVSYGPVLWIYLHEMFPSEIKDSAASLAFLVNWVCAIIVVFPSDIIIKKVPTICFSSSRHVHFVLPLIFFFIKETKGGEIGTSPYITMEERQKHMGKSAV

SEQ ID NO: 19208 - protein, 1009 aa, Anopheles gambiae
MAVRNSTLTAGRHRLPALVLVTATILPILSLMVPIGHSQSVITDCDTSKCQPLSNISEVSLEPGQRIRRELDPCCEILRLYCDTSACPPLIEFCDAERTIRPKNIAGTCCTLQRCDNFCEVYANGEVTTRSVGEKWFNMVNETTCMNYECLRNDANETFINSIGIQCNTTCPEGFEAQLSEQHCCPQCVQSQCKFNDQFYREGQSWASPDGCIVYRCVKENGFLSISSSRKQCPAVGDCPDQHIVERDCCRVCNYTEAQMAPGLTTASPVEPEEGVDFYEELSYDNHPCKRACTLGRKPETCYYRFRLEWYRTLSKACYNCPYNATDCERPHCITGDGVRRNVAVINRMMPGPAIEVCENDIIVVDVENHLMGESTTIHWHGLHQRRTPYMDGVPHVSQCPISPGTTFRYTFRADNPGTHFWHSHTGMQRGDGAFGALIIRKDNDIQELLYDHDLSEHVITVQDWGHEQGVSLFASHHHSTGDNKPPNLLINGRGKYFQRFAKTTPLTTTTTSTEEPALEPETIMAVEPESTTLMEELPTTTVPITDAITPDDTELLQASSNTNLKTVLRAEEVRHRTKRQSRTVNFNAIVVPESKHIPLKVFHVDKGRRYRFRLINAEFLNCPVELSIENHNLTVIASDGFGIQPLEDLGSFVSYAGERFDFIVKANQPIGNYLIRFRGLMDCDERFTSAYQFAVLRYRGAPTDTEYESWPPYDYEAPGVQLNSLNRGPGAENVITIAETSALDQEDLLLLRNETDYKFYVYYDFYGKDNPHFHVPSLYGFQQVVNNTNRLYTPQLNHISMRMPPVPFLPGKDVLDESQFCNETSVRDRNCRQEFCECSHVLQIPLHATVEMVMIDEGFTFDANHPFHLHGHAFRVVGMDRVSRNTTIEDIRRMDEEGRLPRRLKRAPIKDTVTIPDGGYTIIRFIANNPGYWLFHCHIEFHAEIGMSLVLKVGDSSEMLPAPANFPTCYDFKPKLGQLGSGGARHGHSLTSSLLVVVLIVVSLQRLL

SEQ ID NO: 19209 - protein, 801 aa, Manduca sexta
MHRGSWRHIVCSILLVIISTHGINSQTESTAEDNESTTVGLNSENTESVSANLEDVSLDNDQQSSVQIKKAEGLESASRVIMPVKPNISRNDVSYASKENVQRHPVEELDEELAKQILSKYAMKKSNIRAHVRYDEVTGELVGGAHPCERECKEGEEPMVCYYHFNLEWYQTMSKACYNCPFNETDCSRPDCIPADGMNRALSVVNRKMPGPAIEVCQDDRIIVDVENDLMTEGTTVHWHGQHQRGTPYMDGTPYVTQCPILPETTFRYQFTARHSGTHFWHSHSGMQRADGAAGAFIIRKPKSQEPYESLYDYDRSDHVMIVTDWIHQLAVGMFTDHHHSSGDNKPPTLLINGVGRFKIFNNDTEKPVYMKAARFNVEQGYRYRFRVINAEFLNCPIEMSVDGHNITVIASDGYDLEPITATSLVTYAGERYDFILDANNEIDNYWIRFRGLMDCDEIYTRAKQVAVLHYEGAMDLEPPGDPSWFELHNEGLQLNALNKGEEENETISVAEMRSLAGYDDSLKEIADYQFYIAYDFYAKNNSHFHRSPYYGYYQVPEQVNRLYTPQLNHISMKMPTSPLLITRPSPENFCNASSIDEGCKEGYCECPHVLSVKLNAIVEVIIVDEGVTFDANHPFHLHGHSFRVVGLRRLNRTTTIEEIKAFDEAGLLKRNLKNAPIKDTVTVPDGGYTVIRFKADNPGYWLFHCHIEFHVEVGMALVFKVGEHKDMAPLPRDFPTCGNYMPDDMSLQTEKPKEENPVISISQWWPVVYVNNTISSATSVSVSGFLILCSVWILKINVDT

SEQ ID NO: 19210 - protein, 760 aa, Manduca sexta
MGCSGRYCLLTLFLCLVTELALGVRVVPKRKKEAINVPDDQSTSASWWQAGTATPFRESSNSFSSTHGLVQTHPTADDPFGSSFGGIGSTIGPSSNPYGHSGSGPLSGGVRNNPLPSIARSANGKLSLKHLDFTSSATAELRRNPALSAPDECARACRENEPPRICYYHFTLELYTVMGAACQVCAPNATNVVWSHCQCVLADGVERGILTANRMLPGPSIQACENDKVVIDVENHMEGMEVTIHWHGIWQRGSQYYDGVPFVTQCPIQQGNTFRYQWQGNAGTHFWHAHTGLQKLDGLYGSIVVRQPPSKDPNSHLYDYDLTTHVMLISDWLHDDAAERYPGRLAVNTGQDPESVLINGKGQFRDPNTGFMTNTPLETFTITAGRRYRFRMINAFASVCPAQVTFEGHNLTVIATDGEPVQPVQVNTIISFSGERYDFVIEANNIPGAYWIQVRGLGECGIKRAQQLGILRYARGPYQPSLPAPTYDIGIPQGVVMNPLDARCNILRNDAICVSQLKNAKHIDPAILQERPDIKIFLPFRFFVYGPETLFQPNTYNRYLVAPSGDHVISLIDEISYMSPPAPLLSQYDDINPEQFCNGDNRPANCGQNCMCTHKVDIPLNAVVEIVLVDEVQITNLSHPFHLHGYAYNVIGIGRSPDQNVKKINLKHALDLDRRGLLERHLKQGDLPPAKDTIAVPNSGYVILRFRATNPGFWLLHCHFLFHIVIGMSLVLQVGTQADLPPVPPGFPTCGDHLPPIPLH

SEQ ID NO: 19211 - protein, 406 aa, Homo sapiens
MADSQLFCVAEERSGHCAVVDGNFLYVWGGYVSIEDNEVYLPNDEIWTYDIDSGLWRMHLMEGELPASMSGSCGACINGKLYIFGGYDDKGYSNRLYFVNLRTRDETYIWEKITDFEGQPPTPRDKLSCWVYKDRLIYFGGYGCRRHSELQDCFDVHDASWEEQIFWGWHNDVHIFDTKTQTWFQPEIKGGVPPQPRAAHTCAVLGNKGYIFGGRVLQTRMNDLHYLNLDTWTWSGRITINGESPKHRSWHTLTPIADDKLFLCGGLSADNIPLSDGWIHNVTTNCWKQLTHLPKTRPRLWHTACLGKENEIMVFGGSKDDLLALDTGHCNDLLIFQTQPYSLLRSCLDCIGKNSIMLESQISLLPPKLLQQVLKKITFWAAANHREEQRVQKEETENKYQWISSN

SEQ ID NO: 19212 - protein, 420 aa, Mus musculus musculus
MEGHVKRPMNAFMVWSRGERHKLAQQNPSMQNTEISKQLGCRWKSLTEAEKRPFFQEAQRLKTLHREKYPNYKYQPHRRAKVSQRSGILQPAVASTKLYNLLQWDRNPHAITYRQDWSRAAHLYSKNQQSFYWQPVDIPTGHLQQQQQQQQQQQQQFHNHHQQQQQFYDHHHQQQQQQQQQQQQQQQQQQQQQFHDHHQQKQQFHDHHQQQQQFHDHHHHHQQQQFHDHHQQQQQFHDHQQQQQQQQQQQFHDHHQQKQQFHDHHHHQQQQQFHDHQQQQQQFHDHHQQQQQFHDHQQQQHQFHDHPQQKQQFHDHPQQQQQFHDHHHQQQQKQQFHDHHQQKQQFHDHHQQKQQFHDHHQQQQQFHDHHHHQQQQQQQQQQQQQQFHDQQLTYLLTADITGEHTPYQEHLSTALWLAVS

SEQ ID NO: 19213 - protein, 418 aa, Mus musculus musculus
MEGHVKRPMNAFMVWSRGERHKLAQQNPSMQNTEISKQLGCRWKSLTEAEKRPFFQEAQRLKTLHREKYPNYKYQPHRRAKVSQRSGILQPAVASTKLYNLLQWDRNPHAITYRQDWSRAAHLYSKNQQSFYWQPVDIPTGHLQQQQQQQQQQQQQFHNHHQQQQQFYDHHHQQQQQQQQQQQQQQQQQFHDHHQQKQQFHDHHQQQQQFHDHHHHHQQQQFHDHHQQQQQFHDHQQQQQQQQQQQFHDHHQQKQQFHDHHHHQQQQQFHDHQQQQQQFHDHHQQQQQFHDHQQQQHQFHDHPQQKQQFHDHPQQQQQFHDHHHQQQQKQQFHDHHQQKQQFHDHHQQKQQFHDHHQQQQQFHDHHHQQQQQQQQQQQQQQQQQFHDQQLTYLLTADITGEHTPYQEHLSTALWLAVS

SEQ ID NO: 19214 - protein, 416 aa, Mus musculus musculus
MEGHVKRPMNAFMVWSRGERHKLAQQNPSMQNTEISKQLGCRWKSLTEAEKRPFFQEAQRLKTLHREKYPNYKYQPHRRAKVSQRSGILQPAVASTKLYNLLQWDRNPHAITYRQDWSRAAHLYSKNQQSFYWQPVDIPTGHLQQQQQQQQQQQQFHNHHQQQQQFYDHHHHQQQQQQQQQQQQQQQQQFHDHHQQKQQFHDHHQQQQQFHDHHHHHQQQQFHDHHQQQQQFHDHHQQQQQQQQQQFHDHHQQKQQFHDHHHQQQQQQFHDHQQQQQQFHDHHQQQQQFHDHQQQQHQFHDHPQQKQQFHDHPQQQQQFHDHHHQQQQKQQFHDHHQQKQQFHDHHQQKQQFHDHHQQQQQFHDHHHQQQQQQQQQQQQQQQFHDQQLTYLLTADITGEHTPYQEHLSTALWLAVS

SEQ ID NO: 19215 - protein, 509 aa, Listeria monocytogenes
MAKELKGIAASDGIAIAKAYLLVEPDLSYEKTEVTDVESEVKRFESALEVSRTELSMIREKAAKDLGEDKAQIFDAHLLVLNDPELTGPIEESIKNSKTNAETALQETTDMFIGMFESMDNEYMRERAADIKDVRKRVLSHLLGVTIPNPALIDEEVVVVAADLTPSDTAQLNRNFVKGFVTDIGGRTSHSAIMARSLEIPAVVGTKEVTASVAKNDIVIIDGLEGNVIIHPTEEQIAHYEKIKSDFALQQAEWDKLKNEKTVSKDGVHVELAANIGTPNDLEGVISNGGEAVGLYRTEFLYMGRDNFPTEEEQFEAYKAVVSGMDGKSVVVRTLDIGGDKTLPYLELPEEMNPFLGFRAIRLCFANEELFRTQLRALLRASVYGNLKIMFPMIATVNEFRQARDILLDEKAKLKAAGTEVSDSIELGIMIEIPAAAVLADQFAKEVDFFSIGTNDLIQYTMAADRMNERVSYLYQPYNPSILRLVKMVIDASHKEGKWTGMCGEMAGD

SEQ ID NO: 19216 - protein, 345 aa, Kluyvera cryocrescens
MIRCIAWGSRVGATLMSQNTLKVHDLNEDAEFDENGAETFDEKVLNEEEPSDSELAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADENENGPEDTTQDDDMKQSIVKWLFELNAKQREVLARRFGLLGYEAATLEDVGREIGLTRERVRQIQVEGLRRLREILQGQGLNIEALFRE

SEQ ID NO: 19217 - protein, 504 aa, Escherichia coli CFT073
MKNEKRKTGIEPKVFFPPLIIVGILCWLTVRDLDAANVVINAVFSYVTNVWGWAFEWYMVVMLFGWFWLVFGPYAKKRLGNEPPEFSTASWIFMMFASCTSAAVLFWGSIEIYYYISTPPFGLEPNSTGAKELGLAYSLFHWGPLPWATYSFLSVAFAYFFFVRKMEVIRPSSTLVPLVGEKHAKGLFGTIVDNFYLVALIFAMGTSLGLATPLVTECMQWLFGIPHTLQLDAIIITCWIILNAICVACGLQKGVRIASDVRSYLSFLMLGWVFIVSGASFIMNYFTDSVGMLLMYLPRMLFYTDPIAKGGFPQGWTVFYWAWWVIYAIQMSIFLARISRGRTVRELCFGMVLGLTASTWILWTVLGSNTLLLIDKNIINIPNLIEQYGVARAIIETWAALPLSTATMWGFFILCFIATVTLVNACSYTLAMSTCREVRDGEEPPLLVRIGWSVLVGIIGIVLLALGGLKPIQTAIIAGGCPLFFVNIMVTLSFIKDAKQNWKD

SEQ ID NO: 19218 - protein, 267 aa, Escherichia coli CFT073
MAIPAFGLGTFRLKDDVVISSVKTALELDYRAIDTAQIYDNEAAVGQAIAESGVPRHELYITTKIWIENLSKDKLIPSLKESLQKLRTDYVDLTLIHWPSPSDEVSAEEFMQALLEAKKQGLTREIGISNFTIPLMEKAIAAVGAENIATNQIELSPYLQNRKVVAWAKQHGIHITSYMTLAYGNALKDKVIARIAAKHNATPAQVILAWAMGEGYSVIPSSTKRENLESNLKAQNLQLDAEDKKAIAALDCNDRLVSPEGLAPEWD

SEQ ID NO: 19219 - protein, 266 aa, Escherichia coli CFT073
MDFINMFSLKGKNALVTGASYGIGFEIAKALSNAGATIIFNDVIEENIKKGLAAYKENNINAHGYLFDITDEQSVKENIKKIESDVGIIDILVNNAGIIQRKPMLETTAADYRKIIDIDLTGQFIMAKAVLPSMIKKGHGKIINICSMMSELGRETVVGYASAKGGLKMLTKNICSEFGEKNIQCNGIGPGYIATPQTAPLREIQPDGSRHPFDQFIISKTPAGRWGKPDDLAGAAIFLASDASNFINGHILYVDGGILAYIGKQP

SEQ ID NO: 19220 - protein, 283 aa, Escherichia coli CFT073
MQKVKLNNGIEMPLLGFGVFQMTDAAECERAVIDAINSGYRLIDTAASYQNEIQVGNALKQSGIARNELFVTTKLWLQDTSYEGAKAQFERSLNRLQLDYVDLYLIHQPYGDVHGAWRAMEELQQAGKIRAIGVSNFHPDRLADLIAFNNVVPAVNQVEVNPFNQQLQAVPWMQSRGIQPEAWAPFAEGKNGLFQHPVLTAIGEKYGKSVGQVVLRWIYQRGIVSLAKSVRKERMEENINILDFELSPEDMLQITALDTATSAFFSHRDPAMVEWLTGRKLDV

SEQ ID NO: 19221 - protein, 294 aa, Escherichia coli CFT073
MEGLTVEFSVLSNNLKMPMMGFGVFQVTDKDVCKQSVLNAIRTGYRLIDTAAVYGNEDAVGEAVREAISEGLCTREELFITSKLWVQDMLNQDIAAAGIEASLKKSGLECFDLYLLHQAMRDYFSAWRALEDAYEEGKLKAIGVSNFYPHVLANFCETVRVKPMVNQVELHPYFAQPEALATMKYYNVQPEAWAPLGGGRHKPFENNLLQSIADAHQKSISQVILRWNIQRGVVVIPKSTHQQRIEENFAIWDFSLTEKEMAQISSLDLGYVGESVKHFNPEFVRGCLAVKIHD

SEQ ID NO: 19222 - protein, 491 aa, Escherichia coli CFT073
MMSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTDHPGIAKVSFTGGVASGKKVMANSAASSLKEVTMELGGKSPLIVFDDADLDLAADIAMMANFFSSGQVCTNGTRVFVPTKCKAAFEQKVLARVERIRAGDVFDPQTNFGPLVSFPHRDNVLRYIAKGKEEGARVLCGGNVLKGDSFDNGAWVAPTVFTDCSDDMTIVREEIFGPVMSILTYESEDEVIRRANDTDYGLAAGIVTADLNRAHRVIHQLEAGICWINTWGESPAEIPVGGYKHSGIGRENGVMTLQSYTQVKSIQVEMAKFQSIF

SEQ ID NO: 19223 - protein, 677 aa, Escherichia coli CFT073
MTDLSHSREKDKINPVVFYTSAGLILLFSLTTILFRDFSALWIGRTLDWVSKTFGWYYLLAATLYIVFVVCIACSRFGSVKLGPEQSKPEFSLLSWAAMLFAAGIGIDLMFFSVAEPVTQYMQPPEGAGQTIEAARQAMVWTLFHYGLTGWSMYALMGMALGYFSYRYNLPLTIRSALYPIFGKRINGPIGHSVDIAAVIGTIFGIATTLGIGVVQLNYGLSVLFDIPDSMAAKAALIALSVIIATISVTSGVDKGIRVLSELNVALALGLILFVLFMGDTSFLLNALVLNVGDYVNRFMGMTLNSFAFDRPVEWMNNWTLFFWAWWVAWSPFVGLFLARISRGRTIRQFVLGTLIIPFTFTLLWLSVFGNSALYEIIHGGAAFAEEAMVHPERGFYSLLAQYPAFTFSASVATITGLLFYVTSADSGALVLGNFTSQLKDINSDAPGWLRVFWSVAIGLLTLGMLMTNGISALQNTTVIMGLPFSFVIFFVMAGLYKSLKVEDYRRESANRDTAPRPLGLQDRLSWKKRLSRLMNYPGTRYTKQMMETVCYPAMEEVAQELRLRGAYVELKNLPPEEGQQLGHLDLLVHMGEEQNFVYQIWPQQYSVPGFTYRARSGKSTYYRLETFLLEGSQGNDLMDYSKEQVITDILDQYERHLNFIHLHREAPGHSVMFPDA

SEQ ID NO: 19224 - protein, 369 aa, Escherichia coli CFT073
  unsure (1)..(369): unsure at all Xaa locations
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTEXCGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFELARRFGATDCINPNDYDKPIKDVLLDINKWGIDHTFECIGNVNVMRAALESAHRGWGQSVIIGVAGSGQEISTRPFQLVTGRVWKGSAFGGVKGRSQLPGMVEDAMKGDIDLEPFVTHTMSLDEINDAFDLMHEGKSIRTVIRY

SEQ ID NO: 19225 - protein, 620 aa, Escherichia coli CFT073
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKNRRTVCVIGDGAITAGMAFEAMNHAGDIRPDMLVVLNDNEMSISENVGALNNHLAQLLSGKLYSSLREGGKKVFSGVPPIKELLKRTEEHIKGMVVPGTLFEELGFNYIGPVDGHDVLGLITTLKNMRDLKGPQFLHIMTKKGRGYEPAEKDPITFHAVPKFDPSSGCLPKSSGGLPSYSKIFGDWLCETAAKDNKLMAITPAMREGSGMVEFSRKFPDRYFDVAIAEQHAVTFAAGLAIGGYKPIVAIYSTFLQRAYDQVLHDVAIQKLPVLFAIDRAGIVGADGQTHQGAFDLSYLRCIPEMVIMTPSDENECRQMLYTGYHYNDGPSAVRYPRGNAVGVELTPLEKLPIGKGIVKRRGEKLAILNFGTLMPEAAKVAESLNATLVDMRFVKPLDEALILEMAASHEALVTVEENAIMGGAGSGVNEVLMAHRKPVPVLNIGLPDFFIPQGTQEEMRAELGLDATGMEAKIKAWLA

SEQ ID NO: 19226 - protein, 493 aa, Escherichia coli CFT073
MNKHASQPRAIYYVVALQIWEYFSFYGMRALLILYLTNQLKYSDNHAYELFSAYCSLVYVTPILGGFLADKVLGNRMAVMLGALLMAIGHVVLGASEIHPSFLYLSLAIIVCGYGLFKSNVSCLLGELYEPTDPRRDGGFSLMYAAGNVGSIIAPIACGFAQEEYSWAMGFGLAAVGMIAGLVIFLCGNRHFTHTRGVNKKVLRATNFLLPNWGWLLVLLVATPALITVLFWKEWSVYALIVATIIGLGVLAKIYRKAENQKQRKELGLIVTLTFFSMLFWAFAQQGGSSISLYIDRFVNRDMFGYTVPTAMFQSINAFAVMLCGVFLAWVVKESVAGNRTVRIWGKFALGLGLMSAGFCILTLSARWSAMYGHSSLPLMVLGLAVMGFAELFIDPVAMSQITRIEIPGVTGVLTGIYMLLSGAIANYLAGVIADQTSQASFDASGAINYSINAYIEVFDQITWGALACVGLVLMIWLYQALKFRNRALALES

SEQ ID NO: 19227 - protein, 576 aa, Escherichia coli CFT073
MLGLVSLCALILILWRVVYRSVTRPLAEQTQALQRLLDGDIDSPFPETAGVRELDTIGRLMDAFRSSVHALNRHREQLAAQVKARTAELQELVIEHRQARAEAEKASQAKSAFLAAMSHEIRTPLYGILGTAQLLADNPALNAQRDDLRAITDSGESLLTILNDILDYSAIEAGGKNVSVSDEPFEPRPLLESTLQLMSGRVKGRPIRLATEIADDVPTALMGDPRRIRQVITNLLSNALRFTDEGHIILRSRTDGEQWLVEVEDSGCGIDPAKLAEIFQPFVQVSGKRGGTGLGLTISSRLAQAMGGELSATSTPEVGSCFCLRLPLRIATAPVPKTVNQAVRLDDLRLLLIEDNPLTQRITVEMLNTSGAQVVAVGNAAQAIEALQNSEPFAAALVDFDLPDIDGITLARQLAQQYPSLVLIGFSAHVIDETLRQRTSSLFRGIIPKPVPREVLGQLLAHYLQLQVNNDQPLDVSQLNEDAHLMGAEKIHEWLILFKQHALPLLDEIDIARASQDNEKIKRAAHQLKSSCSSLGMRSASQQCAQLEQQPLSAPLPHEEITRSVAALEAWLIRKT

SEQ ID NO: 19228 - protein, 243 aa, Escherichia coli CFT073
MSRSVLVTGASKGIGRAIACQLAADGFNIGVHYHRDAAGAQETLNAIVANGGNGRLLSFDVANREQCREVLEHEIAQHGAWYGVVSNAGIARDAAFPALSNDDWDAVIHTNLDSFYNVIQPCIMPMIGARQGGRIITLSSVSGVMGNRGQVNYSAAKAGIIGATKALAIELAKRKITVNCIAPGLIDTGMIEMEESALKEAMSMIPMKRMGQAEEVAGLASYLMSDIAGYVTRQVISINGGML

SEQ ID NO: 19229 - protein, 268 aa, Escherichia coli CFT073
MAKITAFETGWCTHISCIALKGAGLKVCKFPARAWLLEVGDKRWLWDTGYSSWFEHYTQSGVFRLYRQVTPVYFDPQQALVRQLSATGLAAKDVDAIILSHFHADHIAGLRDFPDVSCICSGEGWRQVRTLRGVTALRQAFVPGLIPENFDSSLRFIESFASVNLPAQLAPFECGYLLPESNGEIILVPLPGHAAGHIGAFVLTDNGWTLLAGDAAWAPANYRELRGPSPLAHLVMSDSHAYYHTLGQLHQLWQNGVVEIRLCHEGDL

SEQ ID NO: 19230 - protein, 479 aa, Escherichia coli CFT073
MSVPVQHPMYIDGQFVTWRGDAWIDVVNPATEAVISRIPDGQAEDARKAIDAAERAQPEWEALPAIERASWLRKISAGIRERATEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKSIYDQFVNRLGEAMQAVQFGNPAERNDIAMGPLINAAALERVEQKVARAVEEGARVALGGKAVEGKGYYYPPTLLLDVRQEMSIMHEETFGPVLPVVAFDTLEEAISMANDSDYGLTSSIYTQNLNVAMKAIKGLKFGETYINRENFEAMQGFHAGWRKSGIGGADGKHGLHEYLQTQVVYLQS

SEQ ID NO: 19231 - protein, 474 aa, Escherichia coli CFT073
MQHKLLINGELVSGEGEKQPVYNPATGDVLLEIAEASAEQVNAAVRAADAAFAEWGQTTPKARAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINVLFGRGKTVGDPLTGHPKVRMVSLTGSIATGEHIISHTAPSIKRTHMELGGKAPVIVFDDADIEAVVEGVRTFGYYNAGQDCTAACRIYAQKGIYDTLVEKLGAAVATLKSGSPDDESTELGPLSSLAHLERVSKAVEEAKATGHIKVITGGEKRKGNGYYYAPTLLAGALQDDAIVQKEVFGPVVSVTLFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 19232 - protein, 489 aa, Escherichia coli CFT073
MHLLTLSINPTFLMRSNHFKEFKMDKKQVTDLRSELLDSRFGAKSISTIAESKRFPLHEMRDDVAFQIINDELYLDGNARQNLATFCQTWDDDNVHKLMDLSINKNWIDKEEYPQSAAIDLRCVNMVADLWHAPAPKNGQAVGTNTIGSSEACMLGGMAMKWRWRKRMEAAGKPTNKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 19233 - protein, 470 aa, Escherichia coli CFT073
MTHKGDTPMTITPATHAISINPATGEQLSVLPWAGVDDIENALQLAAAGFRDWREANIDYRAEKLRDIGKALRARSEEMAQMITREMGKPINQARAEVAKSANLCDWYAEHGPAMLKAEPTLVENQQAVIEYRPLGTILAIMPWNFPLWQVMRGAVPIILAGNGYLLKHAPNVMGCAQLIAQVFKDAGIPQGVYGWLNADNDGVSLMIKDSRIAAVTVTGSVRAGAAIGAQAGAALKKCVLELGGSDPFIVLNDADLELAVKAAVAGRYQNTGQVCAAAKRFIIEEGIASAFTERFVAAAAALKMGDPRDEENALGPMARFDLRDELHHQVEKTLAQGARLLLGGEKMAGAGNYYPPTVLANVTPEMTAFREEMFGPVAAITIAKDAEHALELANDSEFGLSATIFTTDETQARQMAARLECGGVFINGYCASDARVAFGGVKKSGFGRELSHFGLHEFCNIQTVWKDRI

SEQ ID NO: 19234 - protein, 306 aa, Escherichia coli CFT073
MKFRGGRMSRKDGVLALLVVVVWGLNFVVIKVGLHNMPPLMLAGLRFMLVAFPAIFFVARPKVPLNLLLGYGLTISFAQFAFLFCAINFGMPAGLASLVLQAQAFFTIVLGAFTFGERLHGKQLAGIALAIFGVLVLIEDSLNGQHVAMLGFMLTLAAAFSWACGNIFNKKIMSHATRPAVMSLVIWSALIPIIPFFVASLILDGSATMIHSLVTIDMTTILSLMYLAFVATIVGYGIWGTLLGRYETWRVAPLSLLVPVVGLASAALLLDERLTGLQFFGAVLIMTGLYINVFGLRWRKAVKVRG

SEQ ID NO: 19235 - protein, 255 aa, Escherichia coli CFT073
MFNSDNLRLDGKCAIITGAGAGIGKEIAITFATAGASVVVSDINADAANHVVNEIQQLGGQAFACRCDITSEQELSALADFAVSKLGKVDILVNNAGGGGPKPFDMPMADFRRAYELNVFSFFHLSQLVAPEMEKNGGGVILTITSMAAENKNINMTSYASSKAAASHLVRNMAFDLGEKNIRVNGIAPGAILTDALKSVITPEIEQKMLQHTPIRRLGQPQDIANAALFLCSPAASWVSGQILTVSGGGVQELN

SEQ ID NO: 19236 - protein, 457 aa, Escherichia coli CFT073
MQKYISEARLLLALAIPVILAQIAQTAMGFVDTVMAGGYSATDMAAVAIGTSIWLPAILFGHGLLLALTPVIAQLNGSGRRERIAHQVRQGFWLAGFVSVLIMLVLWNAGYIIRSMQNIDPALADKAVGYLRALLWGAPGYLFFQVARNQCEGLAKTKPGMVMGFIGLLVNIPVNYIFIYGHFGMPELGGVGCGVATAAVYWVMFLAMVSYIKRARSMRDIRNEKGTAKPDPAVMKRLIQLGLPIALALFFEVTLFAVVALLVSPLGIVDVAGHQIALNFSSLMFVLPMSLAAAVTIRVGYRLGQGSTLDAQTAARTGLMVGVCMATLTAIFTVSLREQIALLYNDNPEVVTLAAHLMLLAAVYQISDSIQVIGSGILRGYKDTRSIFYITFTAYWVLGLPSGYILALTDLVVEPMGPAGFWIGFIIGLTSAAIMMMLRMRFLQRLPSAIILQRAAR

SEQ ID NO: 19237 - protein, 322 aa, Escherichia coli CFT073
MAKRNNNMDNLDVICIGAAIVDIPLQPVSKNIFDVDSYPLERIAMTTGGDAINEATIISRLGHRTALMSRIGKDAAGQFILDHCRKENIDIQSLKQDVSIDTSINVGLVTEDGERTFVTNRNGSLWKLNIDDVDFARFSQAKLLSLASIFNSPLLDGRALTEIFTQAKARQMIICADMIKPRLNETLNDICEALSYVDYLFPNFAEAKLLTGKETLDEIADCFLACGVKTVVIKTGKDGCFIKRGDMTMKVPAVAGITAIDTIGAGDNFASGFIAALLEGKNLRECARFANATAAISVLSIGATTGVKNRKLVEQLLEEYEG

SEQ ID NO: 19238 - protein, 479 aa, Escherichia coli CFT073
MTVNKLEPDNGTPNDELFTVAGMFDGSLYKLLLRMALPMFVGMLTQVTYAIADIFWLSHIDVTNSGIIAGVGLVFPVGMGLFAIANGIQIGMGSLLSRAIGMQRLDRAQRILSVGIIIALFFAIVITVLGYVYAQPLLRSLGATKSIIGYATEFYYYSLLTVFSIMLIGVMMGLFQGAGKIMVIMKASLLGALVNIMLDPIMIFVFDFGVKGVALASFLAQLSMVAYFIYTLMGLHIGLSIRIALRPFSWKIYREFLSVGMAQMLMQLIIAVGIVIYNFFIVRLDVNAMAAFTLTGRIDYFIITPMLAIATALLTVVGQNWGHGNVTRTLNAYWAAVALAFSIVLVLAVMHIVLAPWMYPLFTRVVAVSDYAVLQTRIMALALPFVAISLLASEYYQAIGKPWYSVLLTLMRHVFISVPVVYLLAIVLEMRITGVYFGAMSGTFVAALLAWRLLRLSPRLLRWNQEAVRSQHLDMEVAP

SEQ ID NO: 19239 - protein, 162 aa, Escherichia coli CFT073
MLEDLRANSWSLRPCCMVLAYRAAHFCSVWRKKNVLNNLWAAPLLVLYRIITECFFGYEIQAAATIGRRFTIHHGYAVVINKNVVAGDDFTIRHGVTIGNRGADNMACPHIGNGVELGANVIILGDITIGNNVTVGAGSVVLDSVPDNALVVGEKARVKVIK

SEQ ID NO: 19240 - protein, 949 aa, Escherichia coli CFT073
MKYLASFRTTLKASRYMFRALALVLWLLIAFSSVFYIVNALHQRESEIRQEFNLSSDQAQRFIQRTSDVMKELKYIAENRLSAENGVLSPRGRETQTDVPAFEPLFADSDCSAMSNTWRGSLESLAWFMRYWRDNFSAAYDLNRVFLIGSDNLCMANFGLRDMPVERDTALKALHERINKYRNAPQDDSGSNLYWISEGPRPGVGYFYALTPVYLANRLQALLGVEQTIRMENFFLPGTLPMGVTILDENGHTLISLTGPESKIKGDPRWMQERSWFGYTEGFRELVLKKNLPPSSLSIVYSVPVDKVLERIRMLILNAILLNVLAGAALFTLARMYERRIFIPAESDALRLEEHEQFNRKIVASAPVGICILRTADGVNILSNELAHTYLNMLTHEDRQRLTQIICGQQVNFVDVLTSNNTNLQISFVHSRYRNENVAICVLVDVSSRVKMEESLQEMAQAAEQASQSKSMFLATVSHELRTPLYGIIGNLDLLQTKELPKGVDRLVTAMNNSSSLLLKIISDILDFSKIESEQLKIEPREFSPREVMNHITANYLPLVVRKQLGLYCFIEPDVPVALNGDPMRLQQVISNLLSNAIKFTDTGCIVLHVRADGDYLSIRVRDTGVGIPAKEVVRLFDPFFQVGTGVQRNFQGTGLGLAICEKLISMMDGDISVDSEPGMGSQFTVRIPLYGAQYPQKKGVEGLSGKRCWLAVRNASLCQFLETSLQRSGIVVTTYEGQEPTPEDVLITDEVVNKKWQGRAVVTFCRRHIGIPLEKAPGEWVHSVAAPHELPALLARIYLIEMESDDPANALPSTDKAVSDNDDMMILVVDDHPINRRLLADQLGSLGYQCKTANDGVDALNVLNKNHIDIVLSDVNMPNMDGYRLTQRIRQLGLTLPVIGVTANALAEEKQRCLESGMDSCLSKPVTLDVIKQTLTVYAERVRKSRES

SEQ ID NO: 19241 - protein, 1197 aa, Escherichia coli CFT073
  unsure (1)..(1197): unsure at all Xaa locations
MKFLPYIFLLCXGLWSTISFADGDYIEYHGISSNNRVTLDPLRLSNKELRWLASKKNLVIAVHKSQTATLLHTDSQQRIRGINADYLNLLKRALNIKLTLREYADHQKAMDALEDGEVDIVLSHLVASPPLNDDIAATNPLIITFPALVTTLHDSMRPLTSSKPVNIARVANYPPDEVIHQSFPKATIISFTNLYQALASVSAGQNDYFIGSNIITSSMISRYFTHSLNVVKYYNSPRQYNFLLTRKDSIVLNEVLNRFVDALTNEVRYEVSQNWLDTGNLAFLNKPLELTEHEKQWIKQHPDLKVLENPYSPPYSMTDETGSVRGVMGDILNIITLQTGLNFSPITVSHNIHAGTQLNPGGWDILPAAIYSEDRENNVSFAEVFITTPYVFVMQKAPDSEQTLKKGMKVAIPYYYELHSQLKEMYPEVEWIKVDNASAAFHKVKEGELDALVATQLNSRYMIDHYYPNELYHFLIPGVQNASLSFAFPRGEPELKDIINKALNAIPPSEVLRLTEKWIKMPNVTIDTWDLYSEQFYIVTTLSVLLVGSSLLWGFYLLRSVRRRKVIQGDLENQISFRKALSDSLPNPTYVVNWQGNVISHNSAFEHYFTADYYKNAMLPLENSESPFKDVFSNTHEVTAETKENRTIYTQVFEIDNGIEKRCINHWHTLCNLPASEHAVYICGWQDITETRDLIHALEVERNKAINATVAKSQFLATMSHEIRTPISSIMGFLELLSGSGLSKEQRVEAISLAYATGQSLLGLIGEILDVDKIESGNYQLQPQWVDIPTLVQNTCHSFAAIAASKSIALSCSSTLPERYLVKIDPQAFKQVLSNLLSNALKFTTEGAVKITTSLGHIDDNHAVIKMTIMDSGSGLSQEEQQQLFKRYSQTSAGRQQTGSGLGLMICKELIKNMQGDLSLESHPGIGTIFTITIPVEITQQVAAVEAKAEQPITLPEKLSILIADDHPTNRLLLKRQLNLLGYDVDEATDGVQALHKVSMQHYDLLITDVNMPNMDGFELTRKLREQNSSLPIWGLTANAQANEREKGLNCGMNLCLFKPLTLDVLKTHLSQLHQVAHIAPQYRHLDIEALKNNTANDLQLMQEILMTFQHETHKDLPAAFHALEAGDNRTFHQCIHRIHGAANILNLQKLINISHQLEITPVSDDSKPEILQLLNSVKEHIAELDQEITVFCQQND

SEQ ID NO: 19242 - protein, 315 aa, Escherichia coli CFT073
MRADVTLEVLHKAATKLRFSLISELIRSNILFILYFQREWSVTLCINKESIKMGKLTGKTALITGALQGIGEGIARTFARHGANLILLDISPEIEKLADELCGRGHRCTAVVADVRDPASVAAAIKRAKEKEGRIDILVNNAGVCRLGSFLDMSDEDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPMRRLADPLEVGELAAFLASDESSYLTGTQNVIDGGSTLPETVSVGI

SEQ ID NO: 19243 - protein, 511 aa, Escherichia coli CFT073
MQSVTLCIMPRQYLLTTLVEILPMLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLSQPVSVYMTPKERLVTVREGEAREVVLAKMHEKRVEKALVVDDEFHLIGMITVKDFQKAERKPNACKDEQGRLRVGAAVGAGAGNEERVDALVAAGVDVLLIDSSHGHSEGVLQRIRETRAKYPDLQIIGGNVATAAGARALAEAGCSAVKVGIGPGSICTTRIVTGVGVPQITAVADAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDELRTKAEFVRISGAGIQESHVHDVTITKESPNYRLGS

SEQ ID NO: 19244 - protein, 396 aa, Escherichia coli CFT073
MLDAQTIATVKATIPLLVETGPKLTAHFYDRMFTHNPELKEIFNMSNQRNGDQREALFNAIAAYASNIENLPALLPAVEKIAQKHTSFQIKPEQYNIVGEHLLATLDEMFSPGQEVLDAWGKAYGVLANVFINREAEIYNENASKAGGWEGTRDFRIVAKTPRSALITSFELEPVDGGAVAEYRPGQYLGVWLKPEGFPHQEIRQYSLTRKPDGKGYRIAVKREEGGQVSNWLHNHANVGDVVKLVAPAGDFFMAVADDTPVTLISAGVGQTPMLAMLDTLAKAGHTAQVNWFHAAENGDVHAFADEVKELGLSLPRFTAHTWYRQPNEADRAKGQFDSEGLMDLSKLEGAFSDPTMQFYLCGPVGFMQFAAKQLVDLGVKQENIHYECFGPHKVL

SEQ ID NO: 19245 - protein, 178 aa, Escherichia coli CFT073
MRRAFIIGVFFLSEVEFSHEYWMRHAMTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 19246 - protein, 482 aa, Escherichia coli CFT073
MKLNDSNLFRQQALINGEWLDANNGEVIDVTNPANGDKLGSVPKMGADETRAAIDAANRALPVWRALTAKERANILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGVPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQNGVYDRFAEKLQQAVSKLHIGNGLEKGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIIGINTGIISNEVAPFGGIKASGLGREGSKYGIEDYLEIKYMCIGL

SEQ ID NO: 19247 - protein, 172 aa, Escherichia coli CFT073
MNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRE

SEQ ID NO: 19248 - protein, 286 aa, Escherichia coli CFT073
MRKVTSLSRGKLPFFFFALRKLELTMSIESLNAFSMDFFSLKGKTAIVTGGNSGLGQAFAMALAKAGANVFIPSFVKDNGETKEMIEKQGVEVDFMQVDITAEGAPQKIIAACCERFGTVDILVNNAGICKLNKVLDFGRADWDPMIDVNLTAAFELSYEAAKIMIPQKSGKIINICSLFSYLGGQWSPAYSATKHALAGFTKAYCDELGQYNIQVNGIAPGYYATDITLATRSNPETNQRVLDHIPANRWGDTQDLMGAAVFLASPASNYVNGHLLVVDGGYLVR

SEQ ID NO: 19249 - protein, 420 aa, Escherichia coli CFT073
MPHSLFSTDTDLTAENLLRLPAEFGCPVWVYDAQIIRRQIAALKQFDVVRFAQKACSNIHILRLMREQGVKVDSVSLGEIERALAAGYNPQTHPDDIVFTADVIDQATLERVSELQIPVNAGSVDMLDQLGQVSPGHRVWLRVNPGFGHGHSQKTNTGGENSKHGIWYTDLPAALDVIQRHHLQLVGIHMHIGSGVDYAHLEQVCGAMVRQVLEFGQDLQAISAGGGLSIPYQQGEEAVDTEHYYGLWNAAREQIARHLGHPVKLEIEPGRFLVAQAGVLITQVRSVKQMGSRHFVLVDAGFNDLMRPAMYGSYHHISALAAEGRSLEHAPTVETVVAGPLCESGDVFTQQEGGNVETRALPEVKAGDYLVLHDTGAYGASMSSNYNSRPLLPEVLFDNGQARLIRRRQTIEELLALELL

SEQ ID NO: 19250 - protein, 515 aa, Escherichia coli CFT073
MEYPSHNDMSQQFNPYLCYFRPDTCVSCSRIFSLCLTLCWQEKMVTINTESALTPRPLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGV

SEQ ID NO: 19251 - protein, 253 aa, Escherichia coli CFT073
MILNAFSLEGKVAVVTGCDTGLGQGMALGLAQAGCDIVGINIVEPTETIKQVTAQGRRFLSLTADLRKIDGIPGLLDRAVAEFGHIDILVNNAGLIRREDALEFSETDWDDVMNLNIKSVFFMSQAAAKHFIAQGNGGKIINIASMLSFQGGIRVPSYTASKSGVMGVTRLMANEWAKHNINVNAIAPGYMATNNTQQLRADEQRSAEILDRIPAGRWGLPSDLMGPVVFLASSASDYVNGYTIAVDGGWLAR

SEQ ID NO: 19252 - protein, 468 aa, Escherichia coli CFT073
MEGIMPDAKKQGRSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 19253 - protein, 275 aa, Escherichia coli CFT073
MANPTVIKLQDGNVMPQLGLGVWQASNEEVITAIQKALEVGYRSIDTAAAYKNEEGVGKALKNASVNREELFITTKLWNDDHKHPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIVENFDVWDFRLDKDELGEIAKLDQGKRLGPDPDQFGG

SEQ ID NO: 19254 - protein, 246 aa, Escherichia coli CFT073
MKAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATTESLRAATHDVLAGLTAREAKVLRMRFGIDMNTDHTLEEVGKQFDVTRERIRQIEAKALRKLRHPSRSEVLRSFLDD

SEQ ID NO: 19255 - protein, 778 aa, Escherichia coli CFT073
MKQIRLLAQYYVDLMMKLGLVRFSMLLALALVVLAIVVQMAVTMVLHGQVESIDVIRSIFFGLLITPWAVYFLSVVVEQLEESRQRLSRLVQKLEEMRERDLSLNVQLKDNIAQLNQEIAVREKAEAELQETFGQLKIEIKEREETQIQLEQQSSFLRSFLDASPDLVFYRNEDKEFSGCNRAMELLTGKSEKQLVHLKPADVYSPEAAAKVIETDEKVFRHNVSLTYEQWLDYPDGRKACFEIRKVPYYDRVGKRHGLMGFGRDITERKRYQDALERASRDKTTFISTISHELRTPLNGIVGLSRILLDTELTAEQEKYLKTIHVSAVTLGNIFNDIIDMDKMERRKVQLDNQPVDFTSFLADLENLSALQAQQKGLRFNLEPTLPLPHQVITDGTRLRQILWNLISNAVKFTQQGQVTVRVRYDEGDMLHFEVEDSGIGIPQDELDKIFAMYYQVKDSHGGKPATGTGIGLAVSRRLAKNMGGDITVTSEQGKGSTFTLTIHAPSVAEEVDDAFDEDDMPLPALNVLLVEDIELNVIVARSVLEKLGNSVDVAMTGKAALEMFKPGEYDLVLLDIQLPDMTGLDISRALTKRYPREDLPPLVALTANVLKDKQEYLNAGMDDVLSKPLSVPALTAMIKKFWDTQDDEESTVTTEENSKSEALLDIPMLEQYLELVGPKLITDGLAVFERMMPGYVSVLESNLTAQDKKGIVEEGHKIKGAAGSVGLRHLQQLGQQIQSPDLPAWEDNVGEWIEEMKEEWRHDVEVLKAWVAKATKK

SEQ ID NO: 19256 - protein, 487 aa, Escherichia coli CFT073
MLPLRINPTFLLPSNKFKEFEMDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 19257 - protein, 542 aa, Escherichia coli CFT073
MIAVVKLLPTGEDFASHVYPCYTSHRKETIMTNNPPSAQIKPGEYGFPLKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEIDSETVAYHFHEPLGVVGQIIPWNFPLLMASWKMAPALAAGNCVVLKPARLTPLSVLLLMEIVGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTIEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 19258 - protein, 1227 aa, Escherichia coli CFT073
MSSKVEQLRAQLNERILVLDGGMGTMIQSYRLNEADFRGERFADWPCDLKGNNDLLVLSKPEVIAAIHNAYFEAGADIIETNTFNSTTIAMADYQMESLSAEINFAAAKLARACADEWTARTPEKPRYVAGVLGPTNRTASISPDVNDPAFRNITFDQLVAAYRESTKALVEGGADLILIETVFDTLNAKAAVFAVKTEFEALGVELPIMISGTITDASGRTLSGQTTEAFYNSLRHAEALTFGLNCALGPDELRQYVQELSRIAECYVTAHPNAGLPNAFGEYDLDADTMAKQIREWAEAGFLNIVGGCCGTTPQHIAAMSRAVEGLAPRKLPEIPVACRLSGLEPLNIGEDSLFVNVGERTNVTGSAKFKRLIKEEKYSEALDVARQQVENGAQIIDINMDEGMLDAEAAMVRFLNLIAGEPDIARVPIMIDSSKWDVIEKGLKCIQGKGIVNSISMKEGVDAFIHHAKLLRRYGAAVVVMAFDEQGQADTRARKIEICRRAYKILTEEVGFPAEDIIFDPNIFAVATGIEEHNNYAQDFIGACEDIKRELPHALISGGVSNVSFSFRGNDPVREAIHAVFLYYAIRNGMDMGIVNAGQLAIYDDLPTELRDAVEDVILNRRDDGTERLLELAEKYRGSKTDDTANTQQAEWRSWEVNKRLEYSLVKGITEFIEQDTEEARQQATRPIEVIEGPLMDGMNVVGDLFGEGKMFLPQVVKSARVMKQAVAYLEPFIEASKEQGKTNGKMVIATVKGDVHDIGKNIVGVVLQCNNYEIVDLGVMVPAEKILRTAKEVNADLIGLSGLITPSLDEMVNVAKEMERQGFTIPLLIGGATTSKAHTAVKIEQNYSGPTVYVQNASRTVGVVAALLSDTQRDDFVARTRKEYETVRIQHGRKKPRTPPVTLEAARDNDFAFDWQAYTPPVAHRLGVQEVEASIETLRNYIDWTPFFMTWSLAGKYPRILEDEVVGVEAQRLFKDANDMLDKLSAEKMLNPRGVVGLFPANRVGDDIEIYRDETRTHVINVSHHLRQQTEKTGFANYCLADFVAPKVSGKADYIGAFAVTGGLEEDALADAFEAQHDDYNKIMVKALADRLAEAFAEYLHERVRKVYWGYAPNENLSNEELIRENYQGIRPAPGYPACPEHTEKATIWELLEVEKHTGMKLTESFAMWPGASVSGWYFSHPDSKYYAVAQIQRDQVEDYARRKGMSVTEVERWLAPNLGYDAE

SEQ ID NO: 19259 - protein, 452 aa, Escherichia coli CFT073
MNNKSSEITIVYIEDSDDVRFACEQTLTLAGYRVISCCDAEHSIPLIQSQANIIILTDVRLPGISGLELLSYINEMDSKIPVILITGHGDVEMAVDAMRNGAFDFIEKPSSSDKLLSIIARAVEKRRLVLENQQLLANLQQENGPVLIGRSPQMQQLRKMILNVADTGADVLIYGETGCGKEVVARMLHHWSTRRQGQFVALNCAGLPETLFESEIFGHEAGAFTGAVKKRIGKIEHANGGTLFLDEIEGMPSGMQVKLLRVLQERTIERLGANQLIPVNCRVIAATKEDLLRRSEEHLFRLDLYYRLNVVSLNIPPLRQRREDIPELFYWFASQAAQKYNRPLPDISPMLLAWLQSQSWPGNVRELKHNAERFVLGLLTHHQPVPMTQQEESGLTACIDAFEKKLIEDMLRQTEGQVSLTARLLQLPRKTLYDKLNKHQIQPQVYRPESSS

SEQ ID NO: 19260 - protein, 549 aa, Escherichia coli CFT073
MEIFFTILIMTLVVSLSGVVTRVMPFQIPLPLMQIAIGALLAWPTFGLHVEFDPELFLVLFIPPLLFADGWKTPTREFLEHGREIFGLALALVVVTVVGIGFLIYWVVPGIPLIPAFALAAVLSPTDAVALSGIVGEGRIPKKIMGILQGEALMNDASGLVSLKFAVAVAMGTMIFTVGGATVEFMKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILETSLMAAEIDPNVEIWMLFTDIILIYAALMLVRFGWLWTMKKFSNRFLKKKPMEFGSWTTREILIASFAGVRGAITLAGVLSIPLLLPDGNVFPARYELVFLAAGVILFSLFVGVVMLPILLQHIEVADHSQQLKEERIARAATAEVAIVAIQKMEERLAADTEENIDNQLLTEVSSRVIGNLRRRADGRNDVESSILEENLERRFRLAALRSERAELYHLRATREISNETLQKLLHDLDLLEALLIEENQ

SEQ ID NO: 19261 - protein, 353 aa, Escherichia coli CFT073
MGLFVKIVAVALLHKHCRESFMKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 19262 - protein, 557 aa, Escherichia coli CFT073
MRKPVYYMEILLTILILTLVVSLTSVLTRLSPVQIPLPLIQIAAGAVLAQPIFGLHVEFNPELFLLLFIPPLLFAESSKIQPKELIKHSREIISLALVLVLITIFGVGYVIHLLLPNVPLIAAFALAAVLSPTDAVALLGIVGKGRISKNIQEVLEGEALMNDASGLVALKFAVAVTMGTMEFSVHGATIAFFVVALGGIAVGIAVTWLYGKGLLLISRYAHDEPSIQIVLMLLLPFIVYLVAEHFGLSGILAAVAAGLTTSRIGVVHHAPIRLRIKAKSSWSMLEYVFNGMVFLILGLQLPGIISESLIRAENDPLVDTGSLLLDVIWIYLALMVVRLGWLWLMRLYSRKRPGKHPMLFAGYKTRHMLLATFAGVRGAITLAGVLSIPLLLPDGTPFPGRYLLVFLATGVILFSLVCGIIILPLLLGKNVGIFSDNRQKEEEAADLFMAKMAILSVQKTEQRLLRARTENLDNELIMETGARVIGYMRHSEEDMSPNDNSLHMQRAKLERTFNLAALNAKRAAIYQMRARQEVSDETLAKIVSELDVLETLIMDSR

SEQ ID NO: 19263 - protein, 667 aa, Caenorhabditis elegans
MTAYSPADSNAEARLLSGGSDPISDTENLLDLAYEVGTSSSDNTRYDRESENDEEEIGVGWEDTTSSSLNKRMCKSATFHDFCDDSEYSRRPVTTLHEEDFDEEEEDEFEDASDRRNLDEDDVEYEDEDDEDDIVVEEEEITPEDIEHSPTGVTTQTTPPSNNTSKSKKKKKRKSDEEDGLRKMKKSSTFASFLNMFVSRRRSGRDSGERLMSRSTCMLRPSISLSVVQESMILGSDGESVEVSPCTSDQTPTGVPPRYIVNVKMRQKTARKWSEEEIQKRLSLPADLRLPVAVVDKLNRTPTLDQPLTRKNRRASLSEIGFGKLETYEKLDKLGEGTYATVFRGRSILTNKFVALKEIRLEQEEGAPCTAIREVSLLRNLRHANVVTLHDIIHTDRLLTLVFEYVDRDLKQYMDSCNNAMQMNNIRLFLYQLLRGLAYCHQRRVLHRDLKPQNLLITAKGELKLADFGLARAKSVPTKTYSNEVVTLWYRPPDVLLGSTDYSTHIDMWGVGCILFEMIAGRALFPGGTPTEQLGLIFRTLGSPRPDRHPTICEKPTFYPYANRHYNPDPLCRQIPRIDAHGFELLMKFLQYEGKDRVSAAEAVKHPFLRTIAVKCCHLRDEQSVLEADGIHIERELLASDHHHSSRRHHRGTLVKDKYRMHSSHHT

SEQ ID NO: 19264 - protein, 478 aa, Homo sapiens [sequence omitted]

SEQ ID NO: 19265 - protein, 486 aa, Acinetobacter sp.
MKDIKHYINGQYVGSASGKLFDNVNPANGKLISKVHEAGREEVDAAVNAAKAALRGPWGKMTLEERTSILHKVADGINARFDEFLKAECLDTGKPKSMASHIDIPRGAAHFKVFADMIKNVPTESFEMPTPDGTGALNYAVRRPKGVIGVISPWNLPLLLMTWKVGPALACANTVVVKPSEETPTTTALLGEVMKEAGIPTGVYNVVHGFGGDSAGAFLTEHPQVDGFTFTGETVPGEVIMKAAAKGIRDISLELGGKNAALVFADCDMDKAIEGTMRSAFANCGQVCLGTERVYVERSIFDEFVGRLKEAAEGLKIGPPDDAEANLGPLVSLKHREKVLSYYQKAVDDGATVVTGGGVPEMPEELAGGAWVQPTIWTGLPKDSAVITDEIFGPCVHVCPFDTEEEAIELANSLPYGLASAIWSENITRAHRVAGQIEAGIIWVNSWFLRDLRTPFGGSKQSGIGREGGVHSLEFYTEMKNICVKL

SEQ ID NO: 19266 - protein, 134 aa, Aspergillus niger
MTGGKSGGKASGSKNAQSRSSKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQNLLPKKTPKSGKGPGSQEL

SEQ ID NO: 19267 - protein, 426 aa, Trypanosoma brucei
MNPTALREVSNLSTGSGDVKQRLAQRRSANLESCRYPYSSSAVRHGSDSLLSLRSSLYSPVGTAGKESSVSPHADRLRENNPVYCSDVIKDITTMYMESEKEAIYGQVLPSPRYLTYQPEINEKMRMILVDWLIDVHLKFKLHPETLYLTVSIVDRYLSSVNTRRTTGRYIPRSKLQLVGITAILLAAKYEEIWPPEVKECVYICANTYTRDEVIRMEREMCTELSFRFTVPTPFPFIVRLLDVVEGLERQQQTQQLSHQLQQIQSQSQSQSQQTQMQASQSQPQSLSRSRSQSRSQPRSDEECTAYVVQLRHTAFFFLDHGMLDYKCLQFSPSQQAKAALFLALVTLHMKEQGSSYVLNNDIIWTRQLQYYSKAQVRDFKACARTMLDFVSYVSTTRYQSVRRKYSSSKYGEVAKLTMPSEVPDF

SEQ ID NO: 19268 - protein, 157 aa, Mus musculus
MFDVGGQRSERKKWIHCFEGVTCIIFCAALSAYDMVLVEDDEVNRMHESLHLFNSICNHKFFAATSIVLFLNKKDLFEEKIKKVHLSICFPEYDGNNSYEDAGNYIKSQFLDLNMRKDVKEIYSHMTCATDTQNVKFVFDAVTDIIIKENLKDCGLF

SEQ ID NO: 19269 - protein, 622 aa, Mus musculus
MVPVENTEGPNLLNQKGREAETEGSCGASGGGHPACAGGPSMFTFLTSVTAAISGLLVGYELGLISGALLQIRTLLALTCHEQEMVVSSLLIGAFLASLTGGVLIDRYGRRLAIILSSCLLGLGSLVLIMSLSYTLLIMGRVAIGVSISLSSIATCVYIAEIAPQHRRGLLVSLNELMIVTGILFAYISNYAFANISNGWKYMFGLVIPLGVLQAIAMYFLPPSPRFLVMKGQEESAGKVLRKLRVISDTTEELTLIKSSLKDEYQYSFWDLFRSKDNMRTRILIGLTLVFFVQTTGQPNILFYASTVLKSVGFQSNEAASLASTGVGVVKVVSTIPATLLVDHIGSKTFLCIGSSVMSASLLTMGIVNLNINMNFTNICRSHSLLNQSLEEFVFYATGNLSISNSSLREHFKRITPYSKGSFMPMGNGMEPKGEMTFTSSLPNAGLSRTEHQGVTDTAVVPAAYKWLSLASLLVYVAAFSIGLGPMPWLVLSEIFPGGIRGRAMALTSSMNWGVNLLISLTFLTVTDLIGLSWVCFIYTIMSLASLAFVVLFIPETKGCSLEQISVELAKANYVKNNICFMSHHQEELVPTQLQKRKPQEQLPECNHLCGRGQSQRPSPDT

SEQ ID NO: 19270 - protein, 595 aa, Mus musculus
MSEAEASSGMAHNAGPDEKTLQVLRDMANRLRIRSIKATNSSTTSYLIPCSNAEIMSVLFFYTMRYKQEDPENPDNDRCILSKGLPFVNVATGWPGQGLGAACGMAYTGKYFDQASYRVFCLLGDEESTEGSVWEAFAFASYYNLDNLMAIFDVNRIGHSSSMSVEHCIAIYQKRCEAFGWNTYVVDGRDVKTLCHVFSQAAQVRGKPTAVVAKTFKARGMPNVEDAESWYGRPMPKERADAIVKLIESQIQTNKILVPSPPIEDSPQINIMNICMTSPPVYVADDKVSTQRACGLALAKLGHENDRVIVLGSDTKNCNFSDIFKKEHPERFIQCCIAEQNMVNVALGCSTRDRTIVFAYSFAAFFTRAFDQIRLGAISQININLIGCHCGVSTGDDNPYHMALEDLAMFRAIPNCVVFYPSDAVSTEHAVYLAANTKEMCFIRTSQAETAIIYTTQETFQIGQAKVVRHSDNDKVIVIGAGVTLHEALVAAAELSKEDISIRVIDLFTIKPLDIATIISNAKATGGRIITVEDHYPEGGIGGAVCAAVSMEPNIVVHNLAVMDVPRSGRCNEALDFSGISSRHIIVAVKCILMT

SEQ ID NO: 19271 - protein, 1047 aa, Mus musculus
MRPKTFPATTYSGNSRQRLQEIREGLKQPSKASTQGLLVGPNSDTSLDAKVLGSKDASRQQQMRATPKFGPYQKALREIRYSLLPFANESGTSAAAEVNRQMLQELVNAGCDQEMAGRALKQTGSRSIEAALEYISKMGYLDPRNEQIVRVIKQTSPGKGLAPTPVTRRPSFEGTGEALPSYHQLGGANYEGPAALEEMPRQYLDFLFPGAGAGTHGAQAHQHPPKGYSTAVEPSAHFPGTHYGRGHLLSEQPGYGVQRSSSFQNKTPPDAYSSMAKARGGPPASLTFPAHAGLYTASHHKPAATPPGAHPLHVLGTRGPTFTGESSAQAVLAPSRNSLNADLYELGSTVPWSAAPLARRDSLQKQGLEASRPHVAFRAGPSRTNSFNNPQPEPSLPAPNTVTAVTAAHILHPVKSVRVLRPEPQTAVGPSHPAWVAAPTAPATESLETKEGSAGPHPLDVDYGGSERRCPPPPYPKHLLLPSKSEQYSVDLDSLCTSVQQSLRGGTEQDRSDKSHKGAKGDKAGRDKKQIQTSPVPVRKNSRDEEKRKSRIKSYSPYAFKFFMEQHVENVIKTYQQKVSRRLQLEQEMAKAGLCEAEQEQMRKILYQKESNYNRLKRAKMDKSMFVKIKTLGIGAFGEVCLACKLDTHALYAMKTLRKKDVLNRNQVAHVKAERDILAEADNEWVVKLYYSFQDKDSLYFVMDYIPGGDMMSLLIRMEVFPEHLARFYIAELTLAIESVHKMGFIHRDIKPDNILIDLDGHIKLTDFGLCTGFRWTHNSKYYQKGNHMRQDSMEPGDLWDDVSNCRCGDRLKTLEQRAQKQHQRCLAHSLVGTPNYIAPEVLLRKGYTQLCDWWSVGVILFEMLVGQPPFLAPTPTETQLKVINWESTLHIPTQVRLSAEARDLITKLCCAADCRLGRDGADDLKAHPFFNTIDFSRDIRKQPAPYVPTISHPMDTSNFDPVDEESPWQRGPAERAPRPGTRWPPPAASIQSTPSMSSPSAGSSMTTAIPSGARSPQSPQRVQSPGDADLEGAAEGLPAGVRVSLS

SEQ ID NO: 19272 - protein, 154 aa, Mus musculus
YFKGPELLVDYQMYDYSLDMWSLGCMLASMIFRKEPFFHGQDNYDQLVRIAKVLGTDELYGYLKKYHIDLDPHFNDILGQHSRKRWENFIHSENRHLVSPEALDLLDKLLRYDHQQRLTAKEAMEHPYFYPVVKEQSQPCAENTVLSSGLTAAR

SEQ ID NO: 19273 - protein, 248 aa, Mus musculus
MSGPVPSRARVYTDVNTHRPREYWDYESHVVEWGNQDDYQLVRKLGRSKYSEVFEAINITNNEKVVVKILKPVKKKKIKREIKILENLRGGPNIITLADIVKDPVSRTPALVFEHVNNTDFKQLYQTLTDYDIRFYMYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQVMTCFSH

SEQ ID NO: 19274 - protein, 423 aa, Mus musculus
MSDSKSDGQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVKDQPSDAAVSSKATASQSSSINDISSMSTEHTLASDTDSSLDASTGPLEGCR

SEQ ID NO: 19275 - protein, 323 aa, Mus musculus
RPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMKTPYVVTRYYRAPEVILGMGYKENVDIWSVGCIMAEMVLHKVLFPGRDYIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVKDQPSAQMQQ

SEQ ID NO: 19276 - protein, 449 aa, Mus musculus
MLELIEVNGTPGSQLSTPRSGKSPSPSPTSPGSLRKQRISQHGGSSTSLSSTKVCSSMDENDGPGEGDELGRRHSLQRGWRREESEEGFQIPATITERYKVGRTIGDGNFAVVKECIERSTAREYALKIIKKSKCRGKEHMIQNEVSILRRVKHPNIVLLIEEMDVPTELYLVMELVKGGDLFDAITSTSKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELINMMLLVNVDQRFSAVQVLEHPWVNDDGLPENEHQLSVAGKIKKHFNTGPKPSSTAAGVSVIATTALDKERQVFRRRRNQDVRSRYKAQPAPPELNSESEDYSPSSSETVRSPNSPF

SEQ ID NO: 19277 - protein, 361 aa, Mus musculus
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKATVCRACRCMPQCLSTS

SEQ ID NO: 19278 - protein, 260 aa, Mus musculus
MAAADEPKPKKLKVEAPQALSENVLFGMGNPLLDISAVVDKDFLDKYSLKPNDQILAEDKHKELFDELVKKFKVEYHAGGSTQNSMKVAQWLIQEPHKAATFFGCIGIDKFGEILKRKAADAHVDAHYYEQNEQPTGTCAACITGGNRSLVANLAAANCYKKEKHLDLERNWVLVEKARVYYIAGFFLTVSPESVLKVARYAAENNRVFTLNLSAPFISQFFKEALMDVMPYVDILFGNETVSCFRKTKQTNLRCCSTVL

SEQ ID NO: 19279 - protein, 329 aa, Mus musculus
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDESAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTAAVPAPQPPVTKPLFPSAGQMGTPVTSSSTASSNSESLSASSKALFPSTAQVRRKLQFKIVKMALQLNPLDPL

SEQ ID NO: 19280 - protein, 303 aa, Mus musculus
QCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDSLELRLSDLLKEKQSVERKCTQLNTRVAKLSTELQEEQELNKCLRANQLVLQNQLKEEEKLLKETCAQKDLQITEIQEQLRDVMFYLETQQQISHLPAETRQEIQEGQINIAMASAPNPPSSGAGGKLQSRKGRSKRGK

SEQ ID NO: 19281 - protein, 316 aa, Mus musculus
MIADQVRTEAYRLGILKNWAALRGKTVLDVGAGTGILSIFCAQAGARRVYAVEASAIWQQAREVVRLNGLEDRVHVLPGPVETVELPERVDAIVSEWMGYGLLHDSMLSSVLHARTKWLKEGGLLLPASAELFVAPISDQMLEWRLGFWSQVKQHYGVDMSCMESFATRCLMGHSEIVVQDLSGEDVLARPQRFAQLELARAGLEQELEAGVGGRFRCSCYGSAPLHGFAVWFQVTFPGGDSEKPLVLSTSPFHPATHWKQALLYLNEPVPVEQDTDISGEITLLPSPDNPRRLRILLRYKVGDHEEKTKDFAMED

SEQ ID NO: 19282 - protein, 310 aa, Mus musculus
SGKSTFIKQMRIIHGSGYSDEDRKGFTKLVYQNIFTAMQAMIRAMDTLRIQYMCEQNKENAQIIREVEVDKVTALSRDQVAAIKQLWLDPGIQECYDRRREYQLSDSAKYYLTDIERIAMPSFVPTQQDVLRVRVPTTGIIEYPFDLENIIFRMVDVGGQRSERRKWIHCFESVTSIIFLVALSEYDQVLAECDNENRMEESKALFRTIITYPWFLNSSVILFLNKKDLLEEKIMYSHLISYFPEYTGPKQDVKAARDFILKLYQDHNPDKEKVIYSHFTCATDTENIRFVFAAVKDTILQLNLREFNLV

SEQ ID NO: 19283 - protein, 145 aa, Mus musculus
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAATTSVCKCKKFSALRIKFKESSEMYRFVLFLMNHV

SEQ ID NO: 19284 - protein, 286 aa, Mus musculus
MQRYWRFQDNKIQDICFGVLGESWIQRPVMARYYSEGQSLQQDDSFIEGVSDQVLVAVVVSLALTATLLYALLRNVQQNIHPENQELVRVLREQFQTEQDVPAPARQQFYTEMYCPICLHQASFPVETNCGHLFCGSCIIAYWRYGSWLGAISCPICRQTVTLLLTVFGEDDQSQDVIRLRQDVNDYNRRFSGQPRSIMERIMDLPTLLRHAFREVFSVGGLFWMFRIRIMLCLMGAFFYLISPLDFVPEALFGILGFLDDFFVIFLLLIYISIMYREVITQRLTR

SEQ ID NO: 19285 - protein, 352 aa, Mus musculus
MLLSIGMLMLSATQVYTILTVQLFAFLNLLPVEADILAYNFENASQTFEDLPARFGYRLPAEGLKGFLINSKPENACEPIVPPPLKDNSSGTFIVLIRRLDCNFDIKVLNAQRAGYKAAIVHNVDSDDLISMGSNDIDTLKKIDIPSVFIGESSANSLKDEFTYEKGGHIILVPELSLPLEYYLIPFLIIVGICLILIVIFMITKFVQDRHRNRRNRLRKDQLKKLPVHKFKKGDEYDVCAICLEEYEDGDKLRILPCSHGDSDSDTDSSQEENQVSEHTPLLPPSASARTQSFGSLSESHSHHNMTESSDYEDDDNEETDSSDADNEITDHSVVVQLQPNGEQDYNIANTV

SEQ ID NO: 19286 - protein, 237 aa, Mus musculus
MNIFDRKINFDALLKFSHITPSTQQHLKKVYASFALCMFVAAAGAYVHVVTHFIQAGLLSALGSLALMIWLMATPHSHETEQKRLGLLAGFAYLTGVGLGPALELCIAVNPSILPTAFMGTAMIFTCFSLSALYARRRSYLFLGGILMSAMSLMLLSSLGNLFFGSIWLFQANLYLGLLVMCGFVLFDTQLIIEKAEHGDKDYIWHCVDLFLDFVTLFRKLMLILAFNEKDKKKEKK

SEQ ID NO: 19287 - protein, 282 aa, Mus musculus
MAGNFWQSSHYLQWILDKQDLLKERQKDLKFLSEEEYWKLQIFFTNVIQALGEHLKLRQQVIATATVYFKRFYARYSLKSIDPVLMAPTCVFLASKVEEFGVVSNTRLIAATTSVLKTRFSYAFPKEFPYRMNHILECEFYLLELMDCCLIVYHPYRPLLQYVQDMGQEDVLLPLAWRIVNDTYRTDLCLLYPPFMIALACLHVACVVQQKDARQWFAELSVDMEKILEIIRVILKLYEQWKNFDERKEMATILSKMPKPKPPPNRSSLSDSPLMAGPEAAR

SEQ ID NO: 19288 - protein, 512 aa, Mus musculus
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILEAVLHCHQMGVVHRDLKPENLLLASKSKGAAVKLADFGLAIEVQGDQQAWFGFAGTPGYLSPEVLRKDPYGKPVDMWVCGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKINNKANVVTSPKENIPTPALEPQTTVIHNPDGNKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIN

SEQ ID NO: 19289 - protein, 426 aa, Mus musculus
RPPPYQWDPMLGEDVWVPQERTAQPTVPNPLKLSPLMLGQGQHLDVARVPFVPPKSPSSPTATFPTGYGMGMPYPGSYNNPSLPGVQAPCSPKDALSQAQFAQQESAVVLQPAYPPSLSYCTLPPTYPGSSTCSSVQLPPIALHPWNSYSTCPPMQNTQGTLPPKPHLVVEKPLVSPPPAELQSHMGTEVMVETADNFQEVLSLTESPVPQRTEKFGKKNRKRLDSRAEEGSVQAITEGKVKKDARTLSDFNSLISSPRLGREKKKVKSQKDQLKSKKLNKTNEFQDSSESEPELFISRDELMNQSQGSKKGWKSKRSLRTASELEEFKCRKASEKEDGRLGSQGFVYVMANKQPLWNEATQVYQLDFGGRVTQESAKNFQIELEGRQVMQFGRIDGNAYILDFQYPFSAVQAFAVALANVTQRLK

SEQ ID NO: 19290 - protein, 421 aa, Mus musculus
MAMKLLSRDTRLVCELALCPLALVFWSILGVRALDNGLARTPTMGWLHWERFMCNLDCQEEPDACISEQLFMQMAELMVSDGWRDAGYDYLCIDDCWMAPERDSKGRLQADPQRFPSGIKHLANYVHSKGLKLGIYADVGNKTCAGFPGSFGSYDIDAQTFADWGVDLLKFDGCHCDSVVSLENGYKYMALALNRTGRSIVYSCEWPLYLRPFHKPNYTDIQYYCNHWRNFDDVYDSWESIKNILSWTVVYQKEIVEVAGPGSWNDPDMLVIGNFGLSWDQQVTQMALWAIMAAPLLMSNDLRQISSQAKALLQNKDVIAINQDPLGKQGYCFRKENHIEVWERPLSNLAWAVAVRNLQEIGGPCPYTIQISSLGRGLACNPGCIITQLLPEKVHLGFYEWTLTLKTRVNPSGTVLFRLER

SEQ ID NO: 19291 - protein, 704 aa, Mus musculus
MEDDRKDAVYGTPQKYDPTFKGPIYNRGCTDVICCVLLFLAIVGYVAVGIIAWTHGDPRKVIYPTDSRGEFCGQKGTKNADKPFLFYFNIVKCANPLVLLEFHCPTPQICVKQCPDRYLTLLSARNTRDFDYYKQFCVPGFQNNKGVTEILRDGECPAVITPSKPLAQRCFPAIHASKGVLMVGNETTYEDGHGARKNITDLVEGAKKANKILEARQLAMQIFEDYTVSWYWIIIGLVIAMVLSLLFIVLLRFLAGIMVWVMIVMVILVLGYGIFHCYMEYSRLRGEAGSDVSLVDLGFQTDLRVYLHLRQTWMAFMIILSILEVVIILLLIFLRKRILIAIALIKEASRAVGHVMCSLLYPLVTFFLLCLCIAYWASTSVFLSTSNTAVYKVVDDTACPLLRKTCNPETFPLRNESLQCPTARCQFAFYGGESTYHRALLGLQIFNAFMFFWLANFVLALGQVTLAGAFASYYWAMRKPDDMPAFPLFSAFGRALRYHTGSLAFGSLILAIVQIIRVMLEYLDQRLKAAQNKFAKFLMVCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIIGSYLIAHGFFSVYGMCVDTLFLCFLEDLERNDGSAERPYFMSSTLKKLLNKTNKKVAES

SEQ ID NO: 19292 - protein, 239 aa, Mus musculus
MQRYWRFQDNKIQDICFGVLGESWIQRNVQQNIHPENQELVRVLREQFQTEQDVPAPVRQQFYTEMYCPICLHQASFPVETNCGHLFCGSCIIAYWRYGSWLGAISCPICRQTVTLLLTVFGEDDQSQDVIRLRQDVNDYNRRFSGQPRSIMERIMDLPTLLRHAFREVFSVGGLFWMFRIRIMLCLMGAFFYLISPLDFVPEALFGILGFLDDFFVIFLLLIYISIMYREVITQRLTR

SEQ ID NO: 19293 - protein, 464 aa, Mus musculus
MSLHFLYYCSEPTLDVKIAFCQGFDKHVDVSSIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 19294 - protein, 568 aa, Mus musculus
MPGTDLLKLKDFEPYLEILESYSTKAKNYVNGYCTKYEPWQLIAWSVLCTLLIVWVYELIFQPESLWSRFKKKLFKLIRKMPFIGRKIEQQVSKAKKDLVKNMPFLKVDKDYVKTLPAQGMGTAEVLERLKEYSSMDGSWQEGKASGAVYNGEPKLTELLVQAYGEFTWSNPLHPDIFPGLRKLEAEIVRMTCSLFNGGPDSCGCVTSGGTESILMACKAYRDLALEKGIKTPEIVAPESAHAAFDKAAHYFGMKIVRVALKKNMEVDVQAMKRAISRNTAMLVCSTPQFPHGVMDPVPEVAKLAVRYKIPLHVDACLGGFLIVFMEKAGYPLEKPFDFRVKGVTSISADTHKYGYAPKGSSVVMYSNEKYRTYQFFVGADWQGGVYASPSIAGSRPGGIIAACWAALMHFGENGYVEATKQIIKTARFLKSELENIKNIFIFGDPQLSVIALGSNDFDIYRLSNMMSAKGWKFNYLQFPRSIHFCITLVHTRKRVAIQFLKDIRESVTQIMKNPKAKTTGMGAIYGMAQATIDRKLVAEISSVFLDCLYTTDPVTQGNQMNGSPKPR

SEQ ID NO: 19295 - protein, 530 aa, Mus musculus
GVGTFGKVKIGEHQLTGHKVAVKILNRQKIRSLDVVGKIKREIQNLKLFRHPHIIKLYQVISTPTDFFMVMEYVSGGELFDYICKHGRVEEVEARRLFQQILSAVDYCHRHMVVHRDLKPENVLLDAQMNAKIADFGLSNMMSDGEFLRTSCGSPNYAAPEVISGRLYAGPEVDIWSCGVILYALLCGTLPFDDEHVPTLFKKIRGGVFYIPDYLNRSVATLLMHMLQVDPLKRATIKDIREHEWFKQDLPSYLFPEDPSYDANVIVDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWHLGIRSQSKACDIMAEVYRAMKQLGFEWKVVNAYHLRVRRKNPVTGNYVKMSLQLYLVDSRSYLLDFKSIDDEVVEQRSGSSTPQRSCSAAGLHRARSSFDSSTAENHSLSGSLTGSLTGSTLSSASPRLGSHTMDFFEMCASLITALAR

SEQ ID NO: 19296 - protein, 417 aa, Mus musculus
MEGDQRSGPPAQSLLPDGHLVLWTLCSVLLPVFITLWCSLQRSRRQLHRRDIFRKSKHCWRDTDLFSHPTYCCVCAQHILQGAFCDCCGLRVDEGCLKKVDKRFPCKEIMLKNDKAADAMPHHWIRGNVPLCSYCVFCRQQCGSQPKLCDYRCIWCQKTVHDECMRGSLRSEKCDFGEFRNLIIPPSYLTSINQMRKDKNTNYEGLASKFGKQWTPLIILANSRSGTNMGEGLLGEFKILLNPVQVFDVTKTPPIKALQLCTLLPYYSVRVLVCGGDGTVGWVLDAIDEMKIKGQEKYIPEVAVLPLGTGNDLSNTLGWGTGYAGEIPVAQVLRNVMEADGIKLDRWKVQVTNKGYYNLRKPKEFTMNNYFSVGPDALMALNFHAHREKAPSLFSSRILNKAVYLFYGTKDCLVQEC

SEQ ID NO: 19297 - protein, 422 aa, Mus musculus
MPGTSRHSGRDAGSALLSLHQEDQENVNPEKLAPAQQPRAQAVLKAGNVRGPAPQQKLKTRRVAPLKDLPINDEHVTAGPSWKAVSKQPAFTIHVDEAEETQKRPAELKETECEDALAFNAAVSLPGARKPLTPLDYPMDGSFESPHAMDMSIVLEDKPVNVNEVPDYQEDIHTYLREMEVKCKPKVGYMKRQPDITNSMRAILVDWLVEVGEEYKLQNETLHLAVNYIDRFLSSMSVLRGKLQLVGTAAMLLASKFEEIYPPEVAEFVYITDDTYSKKQVLRMEHLVLKVLAFDLAAPTVNQFLTQYFLHLQPANCKVESLAMFLGELSLIDADPYLKYLPSLIAGAAFHLALYTVTGQSWPESLAQQTGYTLESLKPCLVDLHQTYLKAPQHAQQSIREKYKHSKYHSVSLLNPPETLSV

SEQ ID NO: 19298 - protein, 771 aa, Mus musculus
MPNSRPRPRRGAGGGAGAAGRDRLVARSLQSAEHCLGDQDFGTAYAHYLLVLSLAPELKDDVKETFQYTLFKWAEELHALSRIQDLLGCYEQALELFPDDEVICNSMGEHLFRMGFRDEAAGYFHKAVKLNPDFNDAKENFYRVANWLVERWHFIMLNDTRRNMVYNAAIQKAVCLGSRTVLDIGTGTGILSMFAKKAGAQSVYACELSKTMYELACDVVAANKMENGIKLLHMKSLDIEIPKHIPERVSLVVTETVDAGVFGEGIVESLIHAWEHLLLQPKTKEENGNCGKYGKVIPAGAVIFGMAVECAEIRRHHRVGAKDIAGIHLPTNVKFQSPAYTSVDTEETVEPYTTEKMSGIPGGYLPLTECFQIMKVDFNNLQELKSLATKKPHSLNVPAIKEGVLDAIMVWFVLQLDDEYSLSTSPSEETCWEQAVYPVQALEDYCIQPGDRVTMEASCHDCYLRIQGISILHLEHEMEVMKGFTKSKDLLSLGNEAELCSALANLQTSRPEALEQTCMLEPTEIALLNNIPYHEGFKTAMRKVLSSLAPELLWQPMDTHCQYMEMNSGSGQSDAAPSTADPFYVLDVSEGFSLLPILAGTLGHVKPYSSVEKDQHCIALDLIAEANHFPKETLEFWLRHIEDEAAVLQRPKSDKLWSIIILDVIEPSGLIQQELMGKAAISRCLLQSGGKIFPQYVLMFGMLVESQTLVEESAVQGTEHTLGLNIAPFINQFQVPIRVCLDLSSLPCVPFKPTSGAVEVGSDDSIFEHFQ

SEQ ID NO: 19299 - protein, 888 aa, Mus musculus
MSSARTPLPTLNERDTEQPTLGHLDSKPSSKSNMLRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRSSDQAVPAIPTSNSYSKKTQSNNAENKRPEEETGRKASSTAKVPASPLPGLDRKKTTPAPSTNSVLSTSTNRSRNSPLLDRASLGQASIQNGKDSLTMPGSRASTASASAAVSAARPRQHQKSMSASVHPNKASGLPPTESNCEVPRPSTAPQRVPVASPSAHNISSSSGAPDRTNFPRGVSSRSTFHAGQLRQVRDQQNLPYGVTPASPSGHSQGRRGASGSIFSKFTSKFVRRNLNEPESKDRVETLRPHVVGSGGTDKDKEEFREAKPRSLRFTWSMKTTSSMEPNEMMREIRKVLDANSCQSELHERYMLLCVHGTPGHENFVQWEMEVCKLPRLSLNGVRFKRISGTYMAFKNIASKIANEAEALTGCQEGQAEAHQWTWLLGPSPASPWEKLQDELVCLPCWHLSPSRPFSVFFFHVCGGWEVVLLPPTFTPAQKSLPSPLQEAKEGEGAGGGQGSPSVLRLHRVFRLNQENFYY

SEQ ID NO: 19300 - protein, 736 aa, Mus musculus
MGLTEDEDVQAMLRGSRLLKIRSRTWHKERLYRLQEDGLSVWFQRRIPRAASKHIFFVQHIEAVREGHQSEGLRRFGGAFAPACCLTIAFKGRRKNLDLAAPTAEEAQRWVRGLAKLRARLDAMSQRERLDHWIHSYLHRADSDQDSKMSFKEIKSLLRMVNVDMNDMYAYRLFKECDHSNNERLEGAEIEAFLRRLLKRPELEEIFRRYSGEDRVLSASELLEFLEDQGEDGATLACAQQLIQTYELNETAKQHELMTLDGFMMYLLSPEGAALNVAHTCVFQDMGQPLAHYFISSSHNTYLTDSQIGGTSSTEAYIRAFAQGCRCVELDCWEGPGGEPVIYHGHTLTSKILFRDVIQAVRDHAFTSSPYPVILSLENHCGLEQQAVMARHLRSILGDMLVTQALDSQNPEELPSPEQLKGRILVKGKKLPAARSEDGRILSDREEEEEEEEEAEEALEAAEQRSRAKQISPELSALAVYCCATRLRTLDPSPGPPQSCTVGSLSERKARKFTREAGTSFVRHNTQQLTRVYPLGLRMNSANYNPQEMWNSGCQLVALNFQTPGYEMDLNTGRFLINGQCGYVLKPAYLRQLNTTFDPECPGPPRTTLAIQVLTAQQLPKLNAEKPSSIVDPLVRVEIHGVPEDCAQKETDYVLNNGFNPCWEQTLQFRLRAPELVLVRFVVEDYDTTSPNDFVGQSTLPLSSLKQGYRHIHLLSKDGASLAPATLFVHIRIQNS

SEQ ID NO: 19301 - protein, 523 aa, Mus musculus
MSLICSISNEVPEHPCVSPVSNHVYERRLIEKYIAENGTDPINNQPLSEEQLIDIKVAHPIRPKPPSATSIPAILKALQDEWGWPNSPALPQSSQWPTLSQDAVMLHSFTLRQQLQTTRQELSHALYQHDAACRVIARLTKEVTAAREALATLKPQAGLIVPQAVPSSQPSVVGAGEPMDLGELVGMTPEIIQKLQDKATVLTTERKKRGKTVPEELVKPEELSKYRQVASHVGLHSASIPGILALDLCPSDTNKILTGGADKNVVVFDKSTEQILATLKGHTKKVTSVVFHPSQELVFSASPDATIRIWSVPNTSCVQVVRAHESAVTGLSLHATGDYLLSSSDDQYWAFSDIQTGRVLTKVTDETSGCSLTCAQFHPDGLIFGTGTMDSQIKIWDLKERTNVANFPGHSGPITSIAFSENGYYLATAADDSSVKLWDLRKLKNFKTLQLDNNFEVKSLIFDQSGTYLALGGTDVQIYICKQWTEILHFTEHSGLTTGVAFGHHAKFIASTGMDRSLKFYSL

SEQ ID NO: 19302 - protein, 452 aa, Mus musculus
MLELIEVNGTPGSQLSTPRSGKSPSPSPTSPGSLRKQRISQHGGSSTSLSSTKVCSSMDDNDGPGEEESEEGFQIPATITERYKVGRTIGDGNFAVVKECIERSTAREYALKIIKKSKCRGKEHMIQNEVSILRRVKHPNIVLLIEEMDVPTELYLVMELVKGGDLFDAITSTSKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELINMMLLVNVDQRFSAVQVLEHPWVNDDGLPENEHQLSVAGKIKKHFNTGPKPSSTAAGVSVIALDHGFTIKRSGSLDYYQQPGMYWIRYEMVQLNSQCFHGNVLAVSIYQFLQWINMFLICYPVHMLLYRFHFNLD

SEQ ID NO: 19303 - protein, 203 aa, Mus musculus
MREKHPEKFNSRMKNKFWYFEFGTSETFSATCKKLHESVEIECDGVQIDLINISLEGIAILNIPSMHGGSNLWGESKKKRSHRRIEKKGSDKRPTLTDAKELKFASQDLSDQLLEVVGLEGAMEMGQIYTGLKSAGRRLAQCSSVVIRTSKSLPMQIDGEPWMQTPCTIKITHKNQAPMLMGPPPKTGLFCSLIKRTRNRSKE

SEQ ID NO: 19304 - protein, 640 aa, Mus musculus
MAAALPLQPSTTASATTTATAVALGEVEDEGLLASLFRDRFPEAQWREKPDVGRYLRELSGSGLDRLRREPERLAEERAQRLQQTRDLAFANYKTFIRGAECTERIHRLFGDVEASLGRLLDRLPRFQQSCRNFVKEAEEISSSRRMNTLTLNRHTEILEILEIPQLMDTCVRNSYHEEALELAAYVRRLERKYSSIPVIQGIVNEVRQSMQLMLSQLIQQLRTNIQLPACLRVIGYLRRMDVFTEAELRVKFLQARDAWLRSILTAIPNDDPYFHITKTIEACRVHLFDIITQYRAIFSDEDPLLPPAMGEYTVNEGAIFHGWVLQKISQFLQVLETDLYRGIGGRLDSLLGQCMYFGLSFSRVGADFRGQLAPVFQRVAISTFQKAVEEAVEKFQDEMTSYTLISTAAILGSSNTPATVPATQPGTLQPPMVLLDFPPLACFLNNILVAFNDLRLCCPVALAQDVTGTLENALTKVTKTILAFHRAEEAVFSSGEHEIFVQFCTAFLEDLVPYLNRCLQVLFPPAQIAQTLGISPTQLSKHGNLGHVNISAIQEPLAFILPKRETVFCLDEQELGPDLVAPAPELPAEQRSMEPVTEKREPGEPLPQEPMEGEPLPAEPPSEGGAIGSVPCPQPGEQP

SEQ ID NO: 19305 - protein, 334 aa, Mus musculus
THRDEEELGMAPAETLTVFLKLLAAGFYGVSSFLIVVVNKSVLTNYRFPSSLCVGLGQMVATVAVLWVGKTLRVVKFPDFDRNVPRKTFPLPLLNFGNQITGLFSTKKLNLPMFTVLRRFSILFTMFAEGALLKKTFSWGIKMTVFAMIIGAFVAASSDLAFDLEGYVFILINDVLTAANGAYVKQKLDSKELGKYGLLYYNALFMILPTLAIAYFTGDAQKAMEFEGWADTLFLLQFTLSCVMGFILMYATVLCTQYNSALTTTIVGCIKNILITYIGMVFGGDYIFTWTNFIGLNISIAGSLVYSYITFTEEQLSKQSEASNKLDTKGKGAV

SEQ ID NO: 19306 - protein, 154 aa, Mus musculus
MSSEEGKLFVGGLNFNTDEQALEDHFSSFGPISEVVVVKDRETQRSRGFGFITFTNPEHASDAMRAMNGESLDGRQIRVDHAGKSARGSRGGAFGGRGRSYSRGGGDQGYGSGRYDSRPGGYGYGYGRSRDYSGRSQGGYDRYSGGNYRDNYDN

SEQ ID NO: 19307 - protein, 150 aa, Mus musculus
NLSAPFISQFFKEALMDVMPYVDILFGNETEAATFAREQGFETKDIKEIAKKAQALPKVNSKRQRTVIFTQGRDDTIVAAENDVTAFPVLDQNQEEIIDTNGAGDAFVGGFLSQLVSDKPLTECIRAGHYAASVIIRRTGCTFPEKPDFH

SEQ ID NO: 19308 - protein, 117 aa, Mus musculus
MDKNELVQKAKLAEQAERYDDMAACMKSVTEQGAELSNEERNLLSVAYKNVVGARRSSWRVVSSIEQKTEGAEKKQQMAREYREKIETELRDICNDVLAFKDMLYSAQDQAPSVEAL

SEQ ID NO: 19309 - protein, 254 aa, Mus musculus
MGDQALSFLKDFLAGGIAAAVSKTAVAPIERVKLLLQVQHASKQISAEKQYKGIIDCVVRIPKGQGFLSFWRGNLANVIRYFPTQALNFAFKDKYKQIFLGGVDRHKQFWRYFAGNLASGGAAGATSLCFVYPLDFARTRLAADVGKGSSQREFNGLGDCLTKIFKSDGLKGLYQGFSVSVQGIIIYRAAYFGVYDTAKGMLPDPKNVYIIVSWMIAQSVTAVAGLVSYPFDTVRRRMMMQSGRKGGKHELPQV

SEQ ID NO: 19310 - protein, 289 aa, Mus musculus
MAATAATVNGSTTVSSSGPAATSVGILQAAAGMYEQLKDEWNRKNPNLSKCGEELGRLKLVLLELNFLPTTGTKLTKQQLILARDILEIGAQWSILCKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKACEKILFAEATRILFFSTPKKMTDYAKKRGWVLGPNNYYSFASQQQKPEDSTIPSTELAKQVIEYARQLEMIV

SEQ ID NO: 19311 - protein, 578 aa, Mus musculus
MSAPRAEEQPSRSGERQPLVARGPRGPRRWRRTAAAAVLLVQMLERAAFFGVTSNLVLYLNSLNFNWDGQQASRATLLFLGASYLLAPVGGWLADVYLGRFLTISLSLLLYLAASGLLLTTITNDGRRSFCGEMPELPLEPACPSSSCQGSWSSPYCATTLYLVLLLLALAASSVRSTLTSFGADQVMDLGRDATRRFFNWFYWSINLGAILSLLVVAFIEQNISFLWGYSIIVGLVGLAFFIFLFATPVFITKPPTGSQVSSMLKLAFQNCCPCRRSSSRDSESAHLLPDQRSNQPGPSPQEDMANFQVLVKILPVMVTLVPYWMVYFQMQSTYVLQGLHLHIPNIFRTNPNISLLLRSDSSNYRIPEAWLLLANVAVILILIPVKDHLIDPLLLRCKLLPSSLQKMALGMFFGFTSIIVAGVLEKERLQYIAANQTVPQLIGKDLYYAAPLSIWWQIPQYLLIGVSEIFASIPGLEFAYSEAPRSMQGAIMGIFFCLSGVGSLLGSGLVALLSFPGGWMYCPKDFGNINNCQMDRYFFLLAGIEAVTAVLFLWIAGRYERTRQDPASQRSSSRVRG

SEQ ID NO: 19312 - protein, 367 aa, Mus musculus
IKKIFEFKETLGTGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALSKNIHESVSAQIRKNFAKSKWRQAFNATAVVRHMRRLQLGSSLDSSNASVSSNLSLASQKDCLAPSTLCSFLSSSSGVAGVGAERRPRPTTVTTGHTGSK

SEQ ID NO: 19313 - protein, 408 aa, Mus musculus
MIPPEPPQPQLQPPPPPAPPNHVVTTIENLPAEGSGGVSLSASSRASMRQRIRKVLNREMLISVALGQVLSLLVCGIGLTSKYLAEDFHANTPVFQSFLNYILLFLVYTTTLAVRQGEENLLAILRRRWWKYMILGLIDLEANYLVVKAYQYTTLTSVQLLDCFVIPVVILLSWFFLLIRYKAVHFIGIVVCILGMGCMVGADVLVGRHQGAGENKLVGDLLVLGGATLYGISNVWEESIIRTLSRVEFLGMIGLFGAFFSGIQLAIMEHKELLKVPWDWQIGLLYVGFSACMFGLYSFMPVVIKKTSATSVNLSLLTADLYSLFFGLFLFHYKFSGLYLLSFFTILIGLVLYSSTSTYIAQDPRVYKQFRNPSGPVVDLPSTAQVEPSVTYTSLGQETEEEPHVRVA

SEQ ID NO: 19314 - protein, 324 aa, Mus musculus
EYLWCIEQTLHFKDGPLNMILDDGGDLTNLIHTKYPQLLSGIRGISEETTTGVHNLYKMMSNGILKVPAINVNDSVTKSKFDNLYGCRESLIDGIKRATDVMIAGKVAVVAGYGDVGKGCAQALRGFGARVIITEIDPINALQAAMEGYEVTTMDEACKEGNIFVTTTGCVDIILGRHFEQMKDDAIVCNIGHFDVEIDVKWLNENAVEKVNIKPQVDRYWLKNGRRIILLAEGRLVNLGCAMGHPSFVMSNSFTNQVMAQIELWTHPDKYPVGVHFLPKKLDEAVAEAHLGKLNVKLTKLTEKQAQYLGMPINGPFKPDHYRY

SEQ ID NO: 19315 - protein, 350 aa, Mus musculus
MPGPAAGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRKEPFFHGQDNYDQLVRIAKVLGTDELYGYLKKYHIDLDPHFNDILGQHSRKRWENFIHSENRHLVSPEALDLLDKLLRYDHQQRLAAKEAMEHPYFYPVVKEQSQPCAENTVVSSGLTAAR

SEQ ID NO: 19316 - protein, 419 aa, Mus musculus
MLHSFTLRQQLQTTRQELSHALYQHDAACRVIARLTKEVTAAREALATLKPQAGLIVPQAVPSSQPSVVGAGEPMDLGELVGMTPEIIQKLQDKATVLTTERKKRGKTVPEELVKPEELSKYRQVASHVGLHSASIPGILALDLCPSDTNKILTGGADKNVVVFDKSTEQILATLKGHTKKVTSVVFHPSQELVFSASPDATIRIWSVPNTSCVQVVRAHESAVTGLSLHATGDYLLSSSDDQYWAFSDIQTGRVLTKVTDETSGCSLTCAQFHPDGLIFGTGTMDSQIKIWDLKERTNVANFPGHSGPITSIAFSENGYYLATAADDSSVKLWDLRKLKNFKTLQLDNNFEVKSLIFDQSGTYLALGGTDVQIYICKQWTEILHFTEHSGLTTGVAFGHHAKFIASTGMDRSLKFYSL

SEQ ID NO: 19317 - protein, 421 aa, Mus musculus
MHRQSSKSGVALPPVGQGPDACQMLSRAQLGQDPPQRTVLGVLTENEQYRRTCGQEITAIRCFSGSENVFPAAGKKVLSDHGVNEPAKRGFDIYMDDPEQGDRDTCSGKEGIIFEDVYEVDTSMLKSDLHFLLDFNTVSPMLVDPTTHAQSEEATDFGSDVINVTEYAEEIHRYLREAEVRHRPKAHYMRKQPDITEGMRAILVDWLVEVGEEYKLRTETLYLAVNFLDRFLSCMSVLRGKLQLVGTAAILLASKYEEIYPPDVDEFVYITDDTYTKRQLLRMEHLLLKVLAFDLTVPTTNQFLLQYLRRQGVCIRTENLAKYVAELSLLEADPFLKYLPSLVAAAAYCLANYIVNRHFWPETLAAFTGYSLNEIVPCLSELHKACLSIPHRPQQAIREKYKASKYLHVSLMEPPVVLPLQ

SEQ ID NO: 19318 - protein, 562 aa, Mus musculus
MDREGPRGPRSGASQENEQWKKETLEDEFSGVRLQKLEQQRQLFEKKQRRKRQEPLMVQANPDATLRHRRPRRGEERFQSDSSWGLGVGSPFLQENVPQAHLPSGAHSALVTMSYVADGSGERAPLLSPRGAVYTRGNGPAVRHHLCWLPDSSDSDVEEVTMEDIPVISRPPQTNLANLRRGWLASPGPGISQEEKEEEVGSTDARVEDKTPSPDPDPDPTVNSDGDHGDLAPCKVEENTAQKNTETASGIGDEDREKGEVTESTETNYAPVASKVLQGDDGDASNHNAWNMTCPQPRIPGPRLGEDMEAYVLLPAPRDHMVQCRIVRNKHGMDKGMFPSYYLYLEAEDGVAHFLLAGRKRKRSKTSNYLISLDPKDMSRNGSNFVGKVRSNVLGTKFTIFDNGVNPERSYWVPDSARIREELGVVCYETNVLGFRGPRKMTVILPGMDSRKQRMKVQPQNDQDSILSRVQKGAGHGLLLLQNKAPSWSDESGAYVLNFHGRVTRASVKNFQIVHPDEPDHLVLQFGRVAPNIFTMDFRYPLCPLQAFAICLSSFDGKLAFF

SEQ ID NO: 19319 - protein, 269 aa, Mus musculus
MTCPQPRIPGPRLGEDMEAYVLLPAPRDHMVQCRIVRNKHGMDKGMFPSYYLYLEAEDGVAHFLLAGRKRKRSKTSNYLISLDPKDMSRNGSNFVGKVRSNVLGTKFTIFDNGVNPERSYWVPDSARIREELGVVCYETNVLGFRGPRKMTVILPGMDSRKQRMKVQPQNDQDSILSRVQKGAGHGLLLLQNKAPSWSDESGAYVLNFHGRVTRASVKNFQIVHPDEPDHLVLQFGRVAPNIFTMDFRYPLCPLQAFAICLSSFDGKLA

SEQ ID NO: 19320 - protein, 108 aa, Mus musculus
SRFEKPRIDDGLLEVVGVTGVVHMGQVQGGLRSGIRIAQGSYFRVTLLKATPVQVDGEPWVQAPGHMIISATAPKVHMLRKAKQKPRKAGANRDTRVDTLPAPEGNPL

SEQ ID NO: 19321 - protein, 298 aa, Mus musculus
MGDKALSFLKDFLAGGIAAAVSKTAVAPIERVKLLLQVQHASKQISAEKQYKGIIDCVVRIPKEQGFLSFWRGNLANVIRYFPTQALNFAFKDKYKQIFLGGVDRHKQFWRYFAGNLASGGAAGATSLCFVYPLDFARTRLAADVGKGSSQREFNGLGDCLTKIFKSDGLKGLYQGFSVSVQGIIIYRAAYFGVYDTAKGMLPDPKNVHIIVSWMIAQSVTAVAGLVSYPFDTVRRRMMMQSGRKGADIMYTGTLDCWRKIAKDEGANAFFKGAWSNVLRGMGGAFVLVLYDEIKKYV

SEQ ID NO: 19322 - protein, 355 aa, Mus musculus
MIPPEPPQPQLQPPPPPAPPNHVVTTIENLPAEGSGGVSLSASSRASMRQRIRKVLNREMLISVALGQVLSLLVCGIGLTSKYLAEDFHANTPVFQSFLNYILLFLVYTTTLAVRQGEENLLAILRRRWWKYMILGLIDLEANYLVVKAYQYTTLTSVQLLDCFVIPVVILLSWFFLLIRYKAVHFIGIVVCILGMGCMVGADVLVGRHQGAGENKLVGDLLVLGGATLYGISNVWEESIIRTLSRVEFLGMIGLFGAFFSGIQLAIMEHKELLKVPWDWQIGLLYVGFSACMFGLYSFMPVVIKKTSATSVNLSLLTADLYSLFCGLFLFHYKKSKSLQTALTDDHLLVGWRPM

SEQ ID NO: 19323 - protein, 224 aa, Mus musculus
MTMDGDSSTTDASQLGISADYIGGSHYVIQPHDDTEDSMNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVSATDGLSEELTEEAFTNQLPAGLITADGQQQNVMVHNVLPTDFWCPANSVFMIGRTDGTGLVWRESDGV

SEQ ID NO: 19324 - protein, 244 aa, Mus musculus
MLLSIGMLMLSATQVYTILTVQLFAFLNLLPVEADILAYNFENASQTFEDLPARFGYRLPAEGLKGFLINSKPENACEPIVPPPLKDNSSGTFIVLIRRLDCNFDIKVLNAQRAGYKAAIVHNVDSDDLISMGSNDIDTLKKIDIPSVFIGESSANSLKDEFTYEKGGHIILVPELSLPLEYYLIPFLIIVGICLILIVIFMITKFVQDRHRNRRNRLRKDQLKKLPVHKFKKATHASTVINCI

SEQ ID NO: 19325 - protein, 205 aa, Mus musculus
MASSKKVTLSVLSREQSEGVGARVRRSIGRPELKNLDPFLLFDEFKGGKPGGFPDHPHRGFETVSYLLEGGSMAHEDFCGHVGKMNPGDLQWMTAGRGILHAEMPCSEEPAHGLQLWVNLRRSEKMVAPQYQELKSEEIPKPTKDGVTVAVISGEALGIKSKVYTRTPTLYLDFKLDQGAKHSQPIPKGWTSFIYTISGDVYIGE

SEQ ID NO: 19326 - protein, 749 aa, Mus musculus
MSEEQWVSLSSEEFDQLQKYSEYSSKKIKDVLAEFNEGGSLRQYDPHKPISYDVFKLFMRAYLEVDLPQPLSTHLFLAFSQKPRQETPDHPKEGASSSEPNVSDYNSDNAAKADEACAPDTESKTTKTQAPSKELEAAAPWEDPGALASSSDAPVVYLKDVVCYLSLMETGRPQDKLEFMFRLYDSDENGLLDQAEMDQIVSQMLHVAQYLEWDPTELRPILKEMLQGMDYDKDGFVSLQEWINGGMTTIPLLVLLGMDDSGSKGDGRHAWTLKHFKKPTYCNFCRAMLMGVGKQGLCCIYCKYTVHQRCVSKTIHGCVKTNSKAKRSGEFHRKCELSTVCDGGELKDHILLPTSICPVSGDRQGGKSDGSVAAKGELVTQYKIIPSPGTHPLLVLVNPKSGGRQGERILRKFHYLLNPEQVFNLDNGGPTPGLNFFHDTPDFRVLACGGDGTVGWILDCIDKANFTKHPPVAVLPLGTGNDLARCLRWGGGYEGGSLTKILKEIEQSPLVMLDRWYLEVMPREEVENGDQVPYNIMNNYFSIGVDASIAHRFHMMREKHPEKFNSRMKNKLWYFEFGTSETFAATCKKLHDHIELECDGVEVDLSNIFLEGIAILNIPSMYGGTNLWGETKKNRAVIRESRKSVTDPKELKCCVQDLSDQLLEVVGLEGAMEMGQIYTGLKSAGRRLAQCSSVTIRTNKLLPMQVDGEPWMQPQCTIKITHKNQAPMMMGPPQKSSFFSLRRKSRSKD

SEQ ID NO: 19327 - protein, 797 aa, Mus musculus
MGPAMFMAFRLWNWLLLLAVLTRSEATSYVNESSNPTAQQAPDARFAASSSDPDEGISVFELDYDYVQIPYEVTLWILLASLAKIGFHLYHRLPHLMPESCLLIIVGALVGGIIFGTHHKSPPVMDSSIYFLYLLPPIVLESGYFMPTRPFFENIGSILWWAGLGALINAFGIGLSLYFICQIKAFGLGDINLLHNLLFGSLISAVDPVAVLAVFEEARVNEQLYMMIFGEALLNDGISVVLYNILIAFTKMHKFEDIEAVDILAGCARFVIVGCGGVFFGIIFGFISAFITRFTQNISAIEPLIVFMFSYLSYLAAETLYLSGILAITACAVTMKKYVEENVSQTSYTTIKYFMKMLSSVSETLIFIFMGVSTIGKNHEWNWAFICFTLLFCQIWRAISVFTLFYVSNQFRTFPFSIKDQFIIFYSGVRGAGSFSLAFLLPLSLFPRKKLFVTATLVVTYFTVFFQGITIGPLVRYLDVRKTNKKESINEELHSRLMDHLKAGIEDVCGQWSHYQVRDKFKKFDHRYLRKILIRRNLPKSSIVSLYKKLEMKQAIEMVETGILSSVASPTPYQSERIQGIKRLSPEDVESMRDILTRSMYQVRQRTLSYNKYNLKPQTSEKQAKEILIRRQNTLRESMRKGQSLPWGKPAGTKNFRYLSFPYSNPQAARREARAAEPTDDDGTDSGFQPLMFSIHSRAGSLQERRQTQAVIPMKRLQRGEKALSFSYRSNTSWEDQAGWRRMDVLRPKPLFYAVAEEYDSGEQTEEETSAILSRWTAEHRHSTEHHKSHSPLLHRK

SEQ ID NO: 19328 - protein, 271 aa, Mus musculus
MAVPHHLQETSYLLPPDPEDWEKQGIPDFVYGQEDLVGKEVQWPRDSPSAVDTVPLSRFDSALRSAWRQRLELGLFRYRLEDLQTQILPGSVGFVAQLNIERGIQRRRPQNIRSVRQEFDPEQFNFNKIRPGEVLFRMQREPKGPATPKQEDDVLVVINVSPLEWGHVLLVPAPAQGLPPTAAAWSAAGGARSCPTELAPRLQGRLQQPGRPGLCEPSSPALLLPGPPTACGGSAKHTPRPQRLYTSAAGPAGSWLSLLHQWARAGFGSVN

SEQ ID NO: 19329 - protein, 448 aa, Mus musculus
MKGFIDDANYSVGLLDEGTNLGNVIDNYVYEHTLTGKNAFFVGDLGKIVKKHSQWQTVVAQIKPFYTVKCNSTPAVLEILAALGTGFACSSKNEMALVQELGVSPENIIFTSPCKQVSQIKYAAKVGVNIMTCDNEIELKKIARNHPNAKVLLHIATEDNIGGEDGNMKFGTTLKNCRHLLECAKELDVQIIGVKFHVSSACKEYQVYVHALSDARCVFDMAGEFGFTMNMLDIGGGFTGTEIQLEEVNHVISPLLDIYFPEGSGIQIISEPGSYYVSSAFTLAVNIIAKKVVENDKFSSGVEKNGSDEPAFVYYMNDGVYGSFASKLSEDLNTIPEVHKKYKEDEPLFTSSLWGPSCDELDQIVEGCLLPELNVGDWLIFDNMGADSFHEPSAFNDFQRPAIYFMMSFSDWYEMQDAGITSDAMMKNFFFAPSCIQLSQEDSFSTEA

SEQ ID NO: 19330 - protein, 343 aa, Mus musculus
MEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLHARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHNRTGFSTSPESPYTHWKQTVFYMEDYLTVKTGEEIFGTIGMRPNAKNNRDLDFTIDLDFKGQLCELSCSTDYRMR

SEQ ID NO: 19331 - protein, 360 aa, Mus musculus
MSQERPTFYRQELNKTIWEVPERYQNLSPVGSGAYGSVCAAFDTKTGHRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHINQLQQIMRLTGTPPAYLINRMPSHEARNYIQSLAQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 19332 - protein, 396 aa, Mus musculus
MDPSSKKVTGRLMLAVGGAVLGSLQFGYNTGVINAPQKVIEEFYNQTWNHRYGEPIPSTTLTTLWSLSVAIFSVGGMIGSFSVGLFVNRFGRRNSMLVMNLLAFVAAVLMGFSKLGKSFEMLILGRFIIGVYRGLTTGFVPMYVGEVSPTALRGALGTLHQLGIVVGILIAQVFGLDSIMGNADLWPLLLSVIFIPALLQCILLPFCPESPRFLLINRNEENRAKSVLKKLRGTADVTRDLQEMKEEGRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAVLMTIALALLERLPWMSYLSIVAIFGFVAFFDVGPGPIPWFIVAELFS

SEQ ID NO: 19333 - protein, 299 aa, Mus musculus
MPGAVEGPRWKQAEDIRDIYDFRDVLGTGAFSEVILAEDKRTQKLVAIKCIAKKALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFA

SEQ ID NO: 19334 - protein, 530 aa, Mus musculus
MSGSNGPTDTHTYQSLAEDCLFGSVEQPKRSTGRLVMHSMAMFGREFCYAVEAAYVTPGLLSVGLPKSLYSMVWLLSPILGFLLQPVVGSASDHCRARWGRRRPYILTLAIMMLLGMALYLNGDAVVSALVANPRQKLIWAISITMVGVVLFDFSADFIDGPIKAYLFDVCSHQDKEKGLHYHALFTGFGGALGYILGAIDWVHLDLGRLLGTEFQVMFFFSALVLILCFITHLCSIPEAPLRDAATDPPSQQDPQGSSLSASGMHEYGSIEKVKNGGADTEQPVQEWKNQKPSGQSQRTMSMKSLLRALVNMPSHYRCLCVSHLIGWTAFLSNMLFFTDFMGQIVYHGDPYGAHNSTEFLIYERGVEVGCWGLCINSVFSSVYSYFQKAMVSYIGLKGLYFMGYLLFGLGTGFIGLFPNVYSTLVLCSMFGVMSSTLYTVPFNLIAEYHREEEKEKGQEAPGGPDNQGRGQGVDCAALTCMVQLAQILVGGGLGFLVNMAGSVVVVVITASAVSLIGCCFVALFVRYVD

SEQ ID NO: 19335 - protein, 168 aa, Mus musculus
MASSKKVTLSVLSREQSEGVGARVRRSIGRPELKNLDPFLLFDEFKGGKPGGFPDHPHRGFETVSYLLEGGSMAHEDFCGHVGKMNPGDLQWMTAGRGILHAEMPCSEEPAHGLQLWVNLRRSEKMVAPQYQELKSEEIPKPTKDGVTVAVISGEALGIKGLGGKVGF

SEQ ID NO: 19336 - protein, 832 aa, Mus musculus
MLPFLLATLGTAALNSSNPKDYCYSARIRSTVLQGLPFGGVPTVLALDFMCFLALLFLFSILRKVAWDYGRLALVTDADRLRRQERERVEQEYVASAMHGDSHDRYERLTSVSSSVDFDQRDNGFCSWLTAIFRIKDDEIRDKCGGDAVHYLSFQRHIIGLLVVVGVLSVGIVLPVNFSGDLLENNAYSFGRTTIANLKSGNNLLWLHTSFAFLYLLLTVYSMRRHTSKMRYKEDDLVKRTLFINGISKYAESEKIKKHFEEAYPNCTVLEARPCYNVARLMFLDAERKKAERGKLYFTNLQSKENVPAMINPKPCGHLCCCVVRGCEQVEAIEYYTKLEQRLKEDYRREKEKVNEKPLGMAFVTFHNETITAIILKDFNVCKCQGCTCRGEPRASSCSEALHISNWTVTYAPDPQNIYWEHLSIRGFIWWLRCLVINVVLFILLFFLTTPAIIITTMDKFNVTKPVEYLNNPIITQFFPTLLLWCFSALLPTIVYYSAFFEAHWTRSGENRTTMHKCYTFLIFMVLLLPSLGLSSLDLFFRWLFDKKFLAEAAIRFECVFLPDNGAFFVNYVIASAFIGNAMDLLRIPGLLMYMIRLCLARSAAERRNVKRHQAYEFRFGAAYAWMMCVFTVVMTYSITCPIIVPFGLMYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDAVSSRSNGRPPTAGAVPKSAKYIAQVLQDSEGDGDGDGAPGSSGDEPPSSSSQDEELLMPPDGLTDTDFQSCEDSLIENEIHQ

SEQ ID NO: 19337 - protein, 254 aa, Mus musculus
MASTFAYANSTLREQVSLKEKRSVLVILWILAFLAGNTMYVLYTFSSQQLYSSLIFLKPNLETLDFFDLLWIVGIADFVLKYITIALKCLIVALPKIILAVKSKGKFYLVIEELSQLFRSLVPIQLWYKYIMGDDSSNSYFLGGVLIVLYSLCKSFDICGRVGGLRKALKLLCTSQNYGVRATGQQCTEAGAVCAICQAEFRDPMILLCQHVFCEECLCLWLDRERTCPLCRSVAVDTLRCWKDGATSAHLQVY

SEQ ID NO: 19338 - protein, 363 aa, Mus musculus
MAPAGSTRAKKGILERLDSGEVVVGDSGFLFTLEKRGFVKAGLWTPEAVVEHPSAVRQLHTEFLRAGADVLQTFTFSATEDNMASKWEAVNAAACDLAQEVAGGGGALVAGGICQTSLYKYHKDETRIKNIFRLQLEVFARKNVDFLIAEYFEHVEEAVWAVEVLREVGAPVAVTMCIGPEGDMHDVTPGECAVKLARAGADIIGVNCRFGPWTSLQTMKLMKEGLRDASLQAHLMVQCLGFHTPDCGKGGFVDLPEYPFGLEPRVATRWDIQKYAREAYNLGIRYIGGCCGFEPYHIRAIAEELAPERGFLPPASEKHGSWGSGLNMHTKPWIRARARREYWENLLPASGRPFCPSLSKPDA

SEQ ID NO: 19339 - protein, 343 aa, Mus musculus
FARRSKELEKKLQEDADKEAKTVKLLLLGAGESGKSTIVKQMKIIHQDGYSPEECLEFKSVIYGNLLQSILAIIRAMSTLGIDYAEPSCADAGRQLNNLADSTEEGTMPPELVDVIRKLWKDGGVQACFDRAAEFQLNDSASYYLNQLDRITDPNYLPNEQDVLRSRVKTTGIIETKFSVKDLNFRMFDVGGQRSERKKWIHCFEGVTCIIFCAALSAYDMVLVEDDEVNRMHESLHLFNSICNHKFFAATSIVLFLNKKDLFEEKIKKVHLSICFPEYDGNNSYEDAGNYIKSQFLDLNMRKDVKEIYSHMTCATDTQNVKFVFDAVTDIIIKENLKDCGLF

SEQ ID NO: 19340 - protein, 418 aa, Mus musculus
MCSLAAGNGRGAELGPEPLELSDSGNHAGWEDEDADTEPAHGRQHTPCLFCDRLFASAEETFSHCKLEHQFNIDSMVHKHGLEFYGYIKLINFIRLKNPTVEYMNSIYNPVPWEKDEYLKPVLEDDLLLQFDVEDLYEPVSTPFSYPNGLSESASVVEKLKHMEARALSAEAALARAREDLQKMKQFAQDFVMNVDVRTCSSTTTIADLQEDEDGVYFSSYGHYGIHEEMLKDKVRTESYRDFIYQNPHIFKDKVVLDVGCGTGILSMFAAKVGAKKVIAVDQSEILYQAMDIIRLNKLEDTIVLIKGKIEEVSLPVEKVDVIISEWMGYFLLFESMLDSVLYAKSKYLAKGGSVYPDICTISLVAVSDVSKHADRIAFWDDVYGFNMSCMKKAVIPEAVVEVVDHKTLISDPCISST

SEQ ID NO: 19341 - protein, 289 aa, Mus musculus
MAATAATVNGSTTVSSSGPAATSVGILQAAAGMYEQLKDEWNRKNPNLSKCGEELGRLKLVLLELNFLPTTGTKLTKQQLILARDILEIGAQWSILCKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFAEATRILFFSTPKKMTDYAKKRGWVLGPNNYYSFASQQQKPEDSTIPSTELAKQVIEYARQLEMIV

SEQ ID NO: 19342 - protein, 361 aa, Cyprinus carpio
MSHKERPTFYRQELNKTIWEVPERYQNLSPVGSGAYGSVCSALDTKSGLRVAVKKLSRPFQSMIHAKRTYRELRLLKHMKHENVIGLLDAFSPATCLAGFNDVYLVTHLMGADLNNIVKCQKLTDDHVQFLIYQILRGLKYIHSADIIHRDLKPSNLAVNEDCELKILDFGLARLTDDEMTGYVATRWYRAPEIMLNWMHYNMTVDIWSVGCIMAELLTGRTLFPGTDHINQLQQIMRLTGTPPASLISRMPSHEARNYINSLSYMPKRNFADVFVGANPMAVDLLEKMLVLDTDKRITASQALAHPYFAQYHDPDDEPEADPYDQSFESRDLDIEEWKRLTYEEVISFEPPVFDGDEMES

SEQ ID NO: 19343 - protein, 2337 aa, Schizosaccharomyces pombe
MKEFPGLKSRNEEIRNKAANDLYEYVIAYSRELSGEALVQFNNDVNKYVYTLIHSTDPLDRLAGVTAINRLIDYEGEDTTRITRFANYLRIILPGTDQKATVLAAKALGRLAVPGGALTSEFVNFEVKRALEWLQGERNENRRYAAVLILKELAKNTSTLIYAHIDSIFELLWHGLRDPKVTIRIASADALSEFLKIVRQRDSSIRLQWYTSILNEAQRGVAQGSSDYIHGSLLVYRQLFLKAGMFMHERYREVSDIILQFRDHKDLLIRKTVTELIATLAAYNPDEFVSNYLHVCMLHLLNLLKKENVKMLAFATIGKVAVAITNSIIPYLDPICDSIKESLKIHIRNKSASDAAIFQCISLLSIALGQAFSNYAYDLFDLIFASGLSEASYRALSDLAHNIPPLLPVIQERLLDMLSKILSGRPFIPPGCPPQYVARSLKSSKSASLKTGFFPNDVYILALKVLGNFDFSGYILNEFVKDCVVVYLENNDPEVRKTASITCSQLFARDPILSQTSDHAIQVVAEVLEKLLTVGICDTVPDIRLTVLNSLDSRFNKHLAQADKIRLLFIAINDENFAVRESALRIIGRLNVYNPAYVMPYLRKIMLKTLTILDYSTIIRTKEENAKLLCLLIAAAPRLIESHVEPILQILLPKAKDSSSIVAASIVNSLGEICQISGEVIVPFIKDLMPLIIEALQDQSSPIRRAAALKALGNLSSSTGYVIDPYIEFPSLLDILIGITKTEQDITIRRETIKLIGTLGALDPNRHRVLEKGTEKVVPEQKNIPPDISLLMSGIGPSSDEYYPTVVITALMSILKDPSLTIHHTAVIQAVMYIFKTMGLRCAPFLSQIIPEFIAVMRTCPTNILEFYFQQLSILVLIVRQHIRSFLPDLFKLIKDFWNPHSNLQFTILSLIESLARAMQGEFKPYLPSLLVMMLQIFDSDVSVDSVSTKKVLHAFIVFGDTLADYFHMLLDPILRLYERNDVSIGIKESIMITIGRLSMVINLSEYASRIIHPVMRMLSCNNASLIRVSMDTVCALIYQLNVDFAIFIPMIDKCLKMNGVTHETYSILVEQFLQEQPLPIKLNPYEKYDKPKLDVVASAADITSKKLPVNQEILRNAWEASQRSTKDDWQEWIRRLGVALLRESPSHALRACAALAAAYQPLARDLFNASFVSCWSELYDHFQEELVKSIEIALTSPHISPEIIQILLNLAEFMEHDDKPLPIDIRTLGAYAAKCHAFAKALHYKELEFIEEELVTKPSVDTIEALISINNQLQQPDAAIGILKHAQQHDKMNLKETWYEKLQRWEDALSAYEKREAAGAGNFEITMGKLRCLHALGEWDRLSQLAQENWIHAGHDARRYIAPLSVAAAWGLGQWEQMDEYISVMKSESPDKAFFNAIVALHRSQFEEAASYITRARDLLDTELTALVGESYNRAYSVAVRVQMLSELEEIITYKKAEDKPEVREMIKKTWVRRLKGCQRNVDVWQRMLRIRSLVISPRDNMEMWIKFANLCRKSGRISLAKKSLNLLLEDDENLDNSLVLKKTHPSIVYANLKFLWAVDDKRKALNSMQEFTSQLISDINVDPALFVQSTSVNTQKSQEEIQYYFHLLARCYHKQGQWQQEIENNWSEGSFDGVLQSYMYATQFDSKWYKAWHSWALANFEAVKFLEQSEEQIPSAAYEQYIIPAVKGFFKSIALSKGNLQDTLRLLNLWFKFGNNSNVINTLNVGISTVNIDIWLDVIPQLIARIHASSLSVRKSVHQLLSDVGRAHPQALVYPLTVAAKSQSSARQNAALAIMDSLKTHSPRLVEQARLVSHELIRAAILWHEQWHEGLEEASRLYFGDHNIEGMFAVLRPLHEMLERGPETLREISFQQAFGRDLVEARDCCIRFEQTGDISDLNQAWDLYYQVFKKIRKQLPQLTTLDLQYVSPKLLHVHDLELAVPGTYVSGKPVIRIVKFYPTFNVITSKQRPRRLSIKGSDGKDYQYVLKGHEDIRQDERVMQLFGLCNNLLLADPETFKRLLSIQRYPVIPLSPDSGLLGWVLDSDTLHVLIRDYRESRKILLNIEHRLIIQMAPDYDRLTLLQKVEVFEYALLSTTGQDLYRVLWLKSRSSEAWLNRRTNYSRTLAVMSMVGYILGLGDRHPSNLMLDRYTGNIIHIDFGDCFEVAMHREKFPEKIPFRLTRMLVNAMEVSGIEGTFRITCEHVMRVLRTNKESVMAVLEAFVYDPLINWRLAPAYSPSIDEKQSNEPNTLLGETIDGLHRKRLNEEGITLEERQKPEILNQRAITVLNRVSNKLTGRDFKPQQQLDVPSQVEKLILQATSIENLCLCYIGWCSFW

SEQ ID NO: 19344 - protein, 330 aa, Pyrus communis
DVDFWDAKGQTPLFPRIFGHEASGIVESVGEGVEGLEVGDHVLPVFTGECGDCAHCKFEESNMCDLLRINTDRGVMLSDGKTRFSINGTPINHFLGTSTFSEYTVIHSGCLAKTNPLAPLDIVCILSCGISTGLGATLNVAKPKKGSSVAIFGLGAVGLAAAEGARICGASRIIGVDRNPKRFEEAKKFGVNEFVNPKDHDKPVQEVIAEMTNGGADRSIECTGYINAMISAFECVHDGWGVAVLVGVPNKDAVFMTKPINVLNERTLKGTFFGNYKPRTDLPLVVEMYMSKKLEVEKFITHRVPFSEINKAFDYMTKGEGLRCIVSMEE

SEQ ID NO: 19345 - protein, 330 aa, Pyrus communis
DVYFWEAKGQNPLFPRIYGHEAGGIVESIGEGVTDLKAGDHVLPVFTGECKDCAHCKSEESNMCDLLRINTDRGVMLSDGKSRFSIKDKPIYHFVGTSTFSEYTVVHVGCLAKINPLAPLDKVCLLSCGISTGLGATLNVAKPKKGSTVAVFGLGAVGLAAAEGARFSGASRIIGVDLHSGRFEEAKKFGVTEFVNPKEHKKPVQEVIAELTNGGVDRSIECTGSVEFMISAFECVHDGWGVAVLVGVPHKEAVFKTHPLNFLNERTLKGTFFGNYKPRTDIPSVVEKYMNKELQLEKFITHKVPFSEINKAFEYMLKGEGLRCIIHMED

SEQ ID NO: 19346 - protein, 245 aa, Antirrhinum majus
WVLVQFGAFIVLCGATHFISLWTFQLHTRTVAVVMTTAKICTAVVSCATALMLVHIIPDLLSVKTRELFLKNKAAELDREMGLIRTQEETGRHVRMLTHEIRSTLDRHTILKTTLVELGRTLGLEECALWMPTRTGLELQLSYTLRHQNPVGFTVPIQLPVINQVFNTNNAVKISPNSPVARLRPAGKYMPGEVVAVRVPLLHLSNFQIHDWPELSTRRYALMVLMLPSDSARQWHMHELELVEV

SEQ ID NO: 19347 - protein, 234 aa, Antirrhinum majus
VLVQFGAFIILCGATHLISLWTFSLHSKTVAIVMTVAKIATALVSCVTALVLVHIIPDLLSVKTRESFLRKKAEELDREMGNIIKQEETSRHVRMLTHEIRSTLDRHTILRTTLVELGRTLELEECALWMPGQRGPNLQLSHTLNNLIPVGSTVPINLPIVNGVFNSEEAIKIPHTCPLAKIRPLGGGYVPPEVVAVRVPLLHLSNFHINNWPEQSSKSYAVMVLILEWHKNMA

SEQ ID NO: 19348 - protein, 742 aa, Hydra oligactis
MGNSASLRKSTDTMTVDGEKLDFARLKHLYPKLRQDLKKKDELIEEKNKKLSGYEIDILNLKKEIRQLQSVIEATRNTNVANDVIVEEEEDNGILLSRHSLSQINHPKSRFIEVVKTVRNKRFAVSAESGKELQNLDFPKIPKSTEVKEFISQAVLKNNFLKHLEECQVKEIVLFMSQKSFKRGEYIIKEGDMGNALFVSYVGLLEISQGDKILGKPLRPGELFGELAILYNCTRTASVKAIDDVEVWYLERNVFQAVMQKTGIMRREEHYNFLHSVPVFKNLPNDTLLKIVEVIEEEFYEDGEFIVREGERGDSFYILKQGLVKVLQMIEGKDEPVEIRHLSQGEYFGEKALLGEDVRTASVVASIGGVHCLVIERDVFMSFIGDLSYLKNKDYGDKLRKAVNVSRANSLSYKTIPDAVSPEFLNAKLTDFKPVATLGVGGFGRVELVQDKRNKDRTFALKSLSKHYVVETKQQEHVFNEKKILMSLDSPFIIKLYKSFKDDRYVYLLLEVCLGGELWTILRDRDYFEEAACRFYIACVVEAFEYIHKRGIIYRDLKPENLLMDSQGYIKIVDFGFAKKISSGTKTWTFCGTPEYVPPEIILNKGHDSSADYWSLGILIYELMVGNPPFSSSDPMSTYNIILRGIEVLEFSNLVTKNAQNLIKRLCKENPMERLGNQKDGVEDIRKHKWYQGFHWSGLRNRTLQAPIIPKIRNITDNSNFDYFSPLKEKPQKEFSGWDEDF

SEQ ID NO: 19349 - protein, 112 aa, Rhodobacter sphaeroides
MKKIEAIIKPFKLDEVKEALQAAGVQGLSVTEVKGFGRQKGHTELYRGAEYVVDFLPKVKIEVVLADDMVEAAVEAIVSAARTDKIGDGKIFISPVEQAIRIRTGETGEDAV

SEQ ID NO: 19350 - protein, 951 aa, Macaca fascicularis
MGNSPLAHDNLDPSMFPMQKGSLNLLRQKWESCGYQRSECYPRDSRCTILQPQESKLLEPEEEVVSAPEPLDPTSLPCSGELTLSSKPEGKDSVDKSNTTREYGRPEVLKEDSLSSRRRIERFSIALDELRSVFEAPKSGNKSAEHGGKEVEIERSLCSPAFKSHPGSQLEDSVKDSDEKGEETSCDKMSPESGHSHIFEAIAGPNKPESGFAEDSAALGEVVSDLHEVVSLKERMARYQAAVSRGDCRSFSANMMEESEMCTVPGGLAKVKKQFEDEITSSRNTFAQYQYQHQNRSEQEAIHSSQVGTSKSSQELARNEQEGSKVQKIDVHGTEMVSHLEKHTKEINQASQFHQYVQETVIDTPEDEEIPKVSTKLLKEQFEKSAQEKILYSDKEMTTPAKQIKKLLLQDKEICILCQKTVYPMECLVADKQNFHKACFRCHHCNSKLSLGNYASLHGQIYCKPHFKQLFKSKGNYDEGFGHKQHKDRWNCKNQSRSVDFIPNEEPNVCKNTAENTLVPGDRNEHLDAGDSEGQRNDLRKLGERGKLKVIWPPSKEIPKKTFPFEEELRMSKPKWPPEMTTPLSPEFKSESLLEDVRTPENKGQGEDHLPFLQPYLQSTHVCQKEDVIGIKEMKMHEVRKDEKKEGRKNVQDRLSEAEDTKSNRKSEMDLNDNHNVVVQSAEKEKNEKTNQTNGAEVLQVTNTDDEVMPENHKENLNKNNNNNYVAASYLNNCRQKTSILEFPDLLPLSSEANDTTNECQIKKLENTSRISELLDIFESEKTYSRNVLGMALKKQTDRAAAGSPVQPAPKPSLSRGLMVKGGNSIIFPDTNLLNIKGSRSKNKNLHFIFSNTVKITAFTKKNENIFDCDLIDSVDQIKNMPCLDLREFGKDVKHWHGETKEAAHNNGNTGFDALSHECPAKPLFPRVEVQSEQLPVEEQIKRNRCYSDTE

SEQ ID NO: 19351 - protein, 310 aa, Arabidopsis thaliana
MPQRHSKNNNDLAYFTYDEKKKLGYGTQRERLGRDSIKPFDACSLCLKPFIDPMCCHKGHVFCRECMLECFLAQKKDIQRRLAAHSSQKKQDKDEEEERLMLQKARELDEFDQQNHSAMPRNSDKNHDEDKNGFHGANSVKTTSFEEEALRTMKAFWLPSATPAASVRVDAPETHTVCPEGKEKLKLKNLFAIRFTEDNSEEEETKTKSASSSSYDKSYICPSCKVTLTNTMSLVALSSCGHVFCKKCAEKFMPVDKVCLVCDKPCKDRNLVGLKKVGTGFAEHDDHLEAKEYKHLGSGSGLGLVRPVKT

SEQ ID NO: 19352 - protein, 1296 aa, Arabidopsis thaliana
MVFKNKLFFSSKKSGSSSPDSSNSPRSVGSNSPIRSDKKKSKSASKDEPPIPIPGFVGVGCKQTQIKDGLKKKDGSSKGKQLSSEVQAHSIGKSNLSPSSEVKKPPPPEVKEGPAFVSPIMASSLGLNRIKTRSGPLPQERVFNYRNDPATSNLSKMGADGGDLGSGSATSGSGSGNRRKEAGSSKLGLEENMDRTRPSDNKSDRDSLSPDTGPPRSLSPTLPPSGSRLQNVASSSGTGRSEMSSGRSGPLRNSDFCTPENSYEWENPKESESPRYQALLRMTSAPRKRFPGDIKSFSHELNSKGVRPFPLWKPRRSNNVEEVLNLIRAKFEKAKEEVNSDLAVFAADLVGVLEKNAESHPEWEETFEDLLILARSCAMTTPGDFWLQCEGIVQDLDDRRQELPPGVLKQLHTRMLFILTRCTRLLQFHKESWGEEEQVVQLRQSRVLHSIEKIPPSGAGRSYSAAKVPSTKKAYSQEQHGLDWKEDAVVRSVPPLAPPENYAIKESESPANIDRMSSWKKLPSPALKTVKEAPASEEQNDSKVEPPNIVGSRQGRDDAAVAILNFPPAKDSHEHSSKHRHNISWGYWGEQPLISEESSIMCRICEEEVPTTHVEDHSRVCTLADKYDQKGLSVDERLMAVAGTLDKIAETFRHKDSLAAAESPDGMKVSNSHLTEESDVLSPRLSDWSRKGSEDMLDCFPEADNSIFMDDLRGLPLMSCRTRFGPKSDQGMTTSSASSMTPRSPIPTPRPDPIEQILGGKGTFHDQDDIPQMSELADIAKCAADAIPGDDQSIPFLLSCLEDLRVVIDRRKFDALTVETFGTRIEKLIREKYVHMCELMDDEKVDLLSTVIDEDAPLEDDVVRSLRTSPVHPRDRTSIDDFEIIKPISRGAFGRVFLAKKRTTGDLFAIKVLKKADMIRKNAVESILAERDILINVRNPFVVRFFYSFTCRDNLYLVMEYLNGGDLYSLLRNLGCLEEDIVRVYIAEVVLALEYLHSEGVVHRDLKPDNLLIAHDGHIKLTDFGLSKVGLINSTDDLAGPAVSGTSLLDEEESRLAASEEQLERRKKRSAVGTPDYLAPEILLGTGHGATADWWSVGIILFELIVGIPPFNAEHPQQIFDNILNRKIPWHHVPEEMSAEAHDIIDRFLTEDPHQRLGARGAAEVKQHIFFKDINWDTLARQKAAFVPASESAIDTSYFRSRYSWNTSDEQFFPSGEVPDYSDADSMTNSSGCSSNHHEEGEAEECEGHAEFESGIPVDYSFSNFSFKNLSQLASINYDLLSKGWKDEPQQIPHHK

SEQ ID NO: 19353 - protein, 234 aa, Arabidopsis thaliana
MPRLHHYLSNQAFLVLLLFSSIASAAVVEHVLHIQDVVVKPLCKEQIIPAANGSLPGPTINVREGDTLVVNVINNSTYNVTIHWHGVFQLKSVWMDGANMITQCPIQPGYNFTYQFDITGQEGTLLWHAHVVNLRATLHGALVIRPRSGRPYPFPKPYKEVPIVFQQWWDTDVRLLQLRPAPVSDAYLINGLAGDSYPCSENSNTHSLLESKVTFYCKLFTKNRINFYFYFWLW

SEQ ID NO: 19354 - protein, 411 aa, Arabidopsis thaliana
MMGPDSLDLLVDCTDSFDSTASQEINGWRSTLEAISRRDLRADLVSCAKAMSENDLMMAHSMMEKLRQMVSVSGEPIQRLGAYLLEGLVAQLASSGSSIYKALNRCPEPASTELLSYMHILYEVCPYFKFGYMSANGAIAEAMKEENRVHIIDFQIGQGSQWVTLIQAFAARPGGPPRIRITGIDDMTSAYARGGGLSIVGNRLAKLAKQFNVPFEFNSVSVSVSEVKPKNLGVRPGEALAVNFAFVLHHMPDESVSTENHRDRLLRMVKSLSPKVVTLVEQESNTNTAAFFPRFMETMNYYAAMFESIDVTLPRDHKQRINVEQHCLARDVVNIIACEGADRVERHELLGKWRSRFGMAGFTPYPLSPLVNSTIKSLLRNYSDKYRLEERDGALYLGWMHRDLVASCAWK

SEQ ID NO: 19355 - protein, 312 aa, Arabidopsis thaliana
MSSSGLGFSFATTLTGFHFALTALVGMVSNATGLSASKHVPLWELLWFSLVANISIAAMNFSLMLNSVGFYQISKLSMIPVVCVMEWVLHSKHYSREVKASVMVVVVGVGICTVTDVKVNAKGFICACTAVFSTSLQQISIGSLQKKYSIGSFELLSKTAPIQAISLLIFGPFVDYFLSGRFISTYKMTYSAMLCILLSCALAVFCNISQYLCIGRFSATSFQVLGHMKTVCVLTLGWLIFDSEMTFKNIAGMVLAVVGMVIYSWAVELEKQRKSKVIPHGKHSMTEDEIKLLKEGIEHMDLKDMELGNNKA

SEQ ID NO: 19356 - protein, 356 aa, Arabidopsis thaliana
MLCIIIIENMERVCEFCKAYRAVVYCIADTANLCLTCDAKVHSANSLSGRHLRTVLCDSCKNQPCVVRCFDHKMFLCHGCNDKFHGGGSSEHRRRDLRCYTGCPPAKDFAVMWGFRVMDDDDDVSLEQSFRMVKPKVQREGGFILEQILELEKVQLREENGSSSLTERGDPSPLELPKKPEEQLIDLPQTGKELVVDFSHLSSSSTLGDSFWECKSPYNKNNQLWHQNIQDIGVCEDTICSDDDFQIPDFDLTFRNFEEQFGADPEPIADSNNVFFVSSLDKSHEMKTFSSSFNNPIFAPKPASSTISFSSSETDNPYSHSEEVISFCPSLSNNTRQKVITRLKEKKRARVEEKKA

SEQ ID NO: 19357 - protein, 1307 aa, Arabidopsis thaliana
MFNTYTNSLQWPIRSRNQQDYCSLLPERSESYKLSKAYTSSRCYCVSSRSSCCCCCSTPSSSSFVKPKVLINPGFVLYGVRQSTLIQWPSFQRRLLVGGGRLMGCEVYSSCDGIRRKNRSFKLRCLEESDECCGGRSCSDDVEAMISFLSEELIDEERKWNLVSRVKEKKKVGNVRKVSVEGSNSYGNGRVSQRVKKPEGFGRRKEIKEDVKLNERYDCEHCGRRKKSSELESESRRGSKLVTGEYIGKSYRGDEEREVRPRRRKSSSCSSYYSLASSGEFESDTEDQEEDVEIYRENVRSSEKKVVDQSAKRLKSRKEASQMHSRKKRDESSTGVDSRYQKQIFEEGENSNQAVTLNQRRRKKFSQTENRVSESTGNYEEDMEIHEVHVNDAETSSQNQKLFNEREDYRVHSIRNDSGNENIESSQHQLKERLETRYSSEDRVSEMRRRTKYSSSQEEGINVLQNFPEVTNNQQPLVEERISKQAGTRRTTEHISESSEIHDIDIRNTYVSQREDQIRNQEVHAGLVSGLQSERKQQDYHIEHNPLQTTQSDRTSVSVSHTSDAVRYTEIQRKSEKRLIGQGSTTAVQSDSKVEKNGAQKEDSRLDHANSKKDGQTTLGLQSYQSKLSEEASSSQSSLMASRTKLQLVDLVSEEMQGSETTLIPPSSQLVSRRSGQSYRTGGVSIQEISHGTSESGYTTAFEHPRAGASVNSQSAGELMGFTSHEDAMGSAHRLEQASEKYVGEFVKKAKHGVINPETEEQRAESNQLKRRDSRRSSGGSGAKGPSDEMWVTDSAQGTPHPGATEGNAAVGNAIFKRNGRSLWNVIADIARLRWGSRAGSPDSSAKPAGRSSPNESVSSATWFSGREHDGSSDDNTKGDKVSPQEAPSLHQVEVGQTSPRSQSEYPGTTKLKQRSERHEGVVSSPSSTILEGGSVSNRMSSTSGNQIVGVDEEEGGNFEFRLPETALTEVPMKLPSRNLIRSPPIKESSESSLTEASSDQNFTVGEGRRYPRMDAGQNPLLFPGRNLRSPAVMEPPVPRPRMVSGSSSLREQVEQQQPLSAKSQEETGSVSADSALIQRKLQRNKQVVRDSFEEWEEAYKVEAERRTVDEIFMREALVEAKKAADTWEVPVGAVLVHDGKIIARGYNLVEELRDSTAHAEMICIREGSKALRSWRLADTTLYVTLEPCPMCAGAILQARVNTLVWGAPNKLLGADGSWIRLFPGGEGNGSEASEKPPPPVHPFHPKMTIRRGVLESECAQTMQQFFQLRRKKKDKNSDPPTPTDHHHHHLPKLLNKMHQVLPFFCL

SEQ ID NO: 19358 - protein, 371 aa, Arabidopsis thaliana
MSNFTYTSAFNLSDNSPFNPAIGSSSSSSSALVVASDDDNNTDDACSICLEPFTLQDPSTVTSCKHEYHLQCIIEWSQRSRECPICWQLFVLRDPASQELLAAVEKERLLKTRNISSSSPISIHHSHDDFHSEEEESQFSSFDEQFLRHLTEAAHRRCLLRRRDGQISSSLVSSSDPTTIHPTDLVNLYRLSAISHVEHQNSNPCPSPGSMTPSPVSGHSSIPADSNNGSRISPGPSPSRSSQSPKSPEASSLPEAIKSKLAAASAKYKESISKSKQGLKEKLLARNNSVKELSKGVQREMNAGIAGVARMIERMDFSSKRFGGSAHVSTSTATASGFNFSFKGKRVEANSKSNNNGDKTEPQKLQGGETC

SEQ ID NO: 19359 - protein, 236 aa, Arabidopsis thaliana
MASSRFQSGFCPISSCPSLENFIERIKDACRFTLSAVLGTILSAVLTFFFALVGTLLGALTGALIGQETESGFIRGAAVGAISGAVFSIEVFESSLVLWKSNESRFGCLLYLIDVIVSLISGRLVRERIGPAMLSAVQSQMGAVDSTFEELSSIFDTGGSKGLTGDLVDKIPKIKITGKNNLDASGNKDSCSVCLQDFQLGETVRSLPHCHHMFHLPCIDNWLFRHGSCPMCRRDL

SEQ ID NO: 19360 - protein, 350 aa, Arabidopsis thaliana
MKDDQKEVKIYDYMKSCENKDYYVPWDIDLDKIEAVLEDKQKGFVVLEKEGETVNVVTKDDVERVKGYPKLGSGTVGADKKWMVGAAIGTRESDKERLEHLVKAGANVVVLDSSQGNSIYQLEMIKYVKNTYPELDVVGGNVVTMYQAENLIKAGVDGLRVGMGSGSICTTQEVCAVGRGQATAVYKVSTLAAQHGVPVIADGGISNSGHIVKALVLGASTVMMGSFLAGSTEAPGAYEYRNGRRVKKYRGMGSLEAMTKGSDQRYLGDTAKLKIAQGVVGAVADKGSVLKFIPYTMHAVKQGFQDLGASSLQSAHELLRDNTLRLEARTGAAQIEGGIHGLVSYEKKSF

SEQ ID NO: 19361 - protein, 353 aa, Arabidopsis thaliana
MEGAGETTTSEGHLTSAAAFVEGGIQDACDDACSICLESFCESDPSTLTSCKHEYHLQCILEWCQKSSQCPMCWQSISLKDPTSQELLEAVEQERNFRFNPTRNATIFRHPTLGDFELQHLPVGVDNAEIEERIIQHLAAAAAMGRARHGVRREGHRSRSSSQGHQQFMVFSSQPNASSPPPHPPMPSSPSQRDESDTVSNLPHNALGEGSHQSNTQPPTSSHPRQVSPSASDSNSRPLNQSSPSEQDRAGPSELQSFSESLKSRLNAVSTRYKESISKNTRNWKDRLFSRNTSMADLGSEVKREVSAGIATVSRMMERLETRENSRPSTASVSDVSENHTPETNNEHNSSSG

SEQ ID NO: 19362 - protein, 241 aa, Arabidopsis thaliana
MASSSSSSYRFQSGSYPLSSSPSLGNFVERIKDACHFLVSAVLATIISAILTFFFALVGTLLGALTGALIGQETESGFIRGAAIGAISGAVFSIEVFESSLDLWKSDESGFGCFLYLIDVIVSLLSGRLVRERIGPAMLSAVQSQMGAVDTAFDDHTSLFDTGGSKGLTGDLVEKIPKMTITGNNNTDASENTDSCSVCLQDFQLGETVRSLPHCHHMFHLPCIDNWLLRHGSCPMCRRDI

SEQ ID NO: 19363 - protein, 384 aa, Arabidopsis thaliana
MEGVSATMHKLRPYLLMIFLQFGAAGTYIVIMATLNQGQNRYVVIVYRNLVAALVLAHFALIFERKVRPKMTLSVLWKIMALGFLEPVLDQGFGYLGMNMTSATYTSAIMNILPSVTFIIAWILRMEKVNIAEVRSKAKIIGTLVGLGGALVMTLYKGPLIPLPWSNPNMDQQNGHTNNSQDHNNWVVGTLLILLGCVAWSGFYVLQSITIKTYPADLSLSALICLAGAVQSFAVALVVERHPSGWAVGWDARLFAPLYTGIVSSGITYYVQGMVMKTRGPVFVTAFNPLCMILVALIASFILHEQIHFGCVIGGAVIAAGLYMVVWGKGKDYEVSGLDILEKNSLQELPITTKSEDDNKLVSSISDNSNVTIPGGAHSNTSGI

SEQ ID NO: 19364 - protein, 402 aa, Arabidopsis thaliana
MNNNPVPCQVFPLVSGGSSGGNLFSSSSGFCNGVYVSSSSQARPSVSTVPRDRITVAHVSGEGQRQECPVETHSLQLINQPQEQKIMTWSSDQIRGFFDFPVPDPQAASSRTMVSSKEVLSKCEWPDWADQLISDDSLEPNWSELLGDPNVLNLYSKIETQSSDIARQEIVFRNQHQVDPSMEPFNAKSPPASSMTSKQRMRWTPELHEAFVEAINQLGGSERATPKAVLKLINSPGLTVYHVKSHLQKYRTARYKPELSKDTEEPLVKNLKTIEDIKSLDLKTSIEITEALRLQMKVQKQLHEQLEIQRSLQLQIEEQGRYLQMMIEKQQKMQENKKDSTSSSSMPEADPSAPSPNLSQPFLHKATNSEPSITQKLQNGSSTMDQSESTSGTSNRKRVRED

SEQ ID NO: 19365 - protein, 419 aa, Arabidopsis thaliana
MDYLPVEVIGNILSRLGGARDVVIASATCRKWREACRKHLQTLSFNSADWPFYRDLTTNRLEILITQTIFQTMGLQGLSIMMDDANKFSAATVIAWLMCTRDTLRRLSYNVRTTPNVNILEICGRQKLEALVLAHNSITGVEPSFQRFPCLKSLSLSYVSISALDLNLLLSACPMIESLELVSLEIAMSDAQVTIELSSPTLKSVYFDGISLDKFILEADSIEFLHMKDCVLELFELIGNGTLKHFKLDDVSVIHLDIMETSESLEVVDVNHFTMVWPKFYQMISRSQKLKKLRLWDVVFDDDDEIIDVESIAAGFSHLTHLSLSYDLKDGAAHYSLQGTTQLENVTVLELGWTVINDVFSIWVEELLRRCPNLKKLIIYGVVSETKTQGDCQILATFTWSIVQLMRKYIHVEVQFEYE

SEQ ID NO: 19366 - protein, 572 aa, Arabidopsis thaliana
MSSCLLPQFKCPPDSFSIHFRTSFCAPKHNKGSVFFQPQCAVSTSPALLTSMLDVAKLRLPSFDTDSDSLISDRQWTYTRPDGPSTEAKYLEALASETLLTSDEAVVVAAAAEAVALARAAVKVAKDATLFKNSNYTNLLTSSTADKRSKWDQFTEKERAGILGHLAVSDNGIVSDKITASASNKESIGDLESEKQEEVELLEEQPSVGLAVRSTRQTERKARRAKGLEKTASGIPSVKTGSSPKKKRLVAQEVDHNDPLRYLRMTTSSSKLLTVREEHELSAGIQDLLKLERLQTELTERSGRQPTFAQWASAAGVDQKSLRQRIHHGTLCKDKMIKSNIRLVISIAKNYQGAGMNLQDLVQEGCRGLVRGAEKFDATKGFKFSTYAHWWIKQAVRKSLSDQSRMIRLPFHMVEATYRVKEARKQLYSETGKHPKNEEIAEATGLSMKRLMAVLLSPKPPRSLDQKIGMNQNLKPSEVIADPEAVTPEDILIKEFMRQDLDKVLDSLGTREKQVIRWRFGMEDGRMKTLQEIGEMMGVSRERVRQIESSAFRKLKNKKRNNHLQQYLVAQS

SEQ ID NO: 19367 - protein, 249 aa, Arabidopsis thaliana
MSTPAAAVNATVTVTDAGRGSITHVIFDMDGLLLDTEKFYTEVQEKILARYNKTFDWSLKAKMMGRKAIEAARLFVDESGISDSLSAEDFIVERESMLQDLFPTSDLMPGASRLLRHLHGKGIPICIATGTHTRHFDLKTQRHRELFSLMHHVVRGDDPEVKEGKPAPDGFLAASRRFEDGPVDPRKVLVFEDAPSGVQAAKNAGMNVIMVPDSRLDKSYCNVADQVLASLLDFKPEEWGLPSFQDSHN

SEQ ID NO: 19368 - protein, 358 aa, Arabidopsis thaliana
MACIVEDPQRAGQSNETQIALISGVPDDISKSCLARVPREYHMAMKCVSRRWRDFVCSDEMCDYRNEFNLAESWIYALCRDISGGVFLHMLNPFSSRRSWKRINDYPYIPMREGMGFAVLGKRLFVLGGCGWLEDATDEIYCYDAAMNTWFDVVPPLSTKRCYFACETLDGKIIAIGGLGLNPNAKRTWDIYDPLTRTCKSCSDVNIVPEMEDSFVMDGRIYIRGGVGGSSTAVYSASSGIWERMDDDMASGWRGPAVVVAGDLYVLDQTFGAKLTMWCKDTRMWIHIGKLSQLVMKQPCRLVSIGNSIFVIGKDCSTVVIDVENVRKSKMNGVMVCSSIPKTWDDDIDVISCKSVAI

SEQ ID NO: 19369 - protein, 252 aa, Arabidopsis thaliana
MDEMEVTTADVFPEVNAAAVTENLDRNELVLADGVVSAEERNIEPDNRGERKIESESPPEDDVCPICFGSFTVPCRGNCGHWYCGNCILQYWNYAAISRPCKCPMCVRHITKLSPEPSLQERQEQEVKEVLDKVRRYNRLFVGGLTGFVQKVHELPFLVKRMVWHMMDTDVNNLYFHEVRIFAMFMSTLYTAAEFNFIPTGGFRIVTVFDYAAIAMILILRLVGIYRRRRLAQQVRHLAAAAIEPELEQREL

SEQ ID NO: 19370 - protein, 249 aa, Lycopersicon esculentum
MALPENLTREQCLYLAKLAEQAERYEEMVKFMDKLVIGSGSSELTVEERNLLSVAYKNVIGSLRAAWRIVSSIEQKEEGRKNDEHVVLVKDYRSKVESELSDVCAGILKILDQYLIPSASAGESKVFYLKMKGDYYRYLAEFKVGNERKEAAEDTMLAYKAAQDIAVAELAPTHPIRLGLALNFSVFYYEILNASEKACSMAKQAFEEAIAELDTMGEESYKDSTLIMQLLRDNLTLWTSDMQEQMDEA

SEQ ID NO: 19371 - protein, 252 aa, Lycopersicon esculentum
MAALIPENLSREQCLYLAKLAEQAERYEEMVQFMDKLVLNSTPAGELTVEERNLLSVAYKNVIGSLRAAWRIVSSIEQKEESRKNEEHVHLVKEYRGKVENELSQVCAGILKLLESNLVPSATTSESKVFYLKMKGDYYRYLAEFKIGDERKQAAEDTMNSYKAAQEIALTDLPPTHPIRLGLALNFSVFYFEILNSSDKACSMAKQAFEEAIAELDTLGEESYKDSTLIMQLLRDNLTLWTSDAQDQLDES

SEQ ID NO: 19372 - protein, 254 aa, Lycopersicon esculentum
MAREENVYMAKLAEQAERYEEMVQFMEKVSTSLGSEELTVEERNLLSVAYKNVIGARRASWRIISSIEQKEESRGNEEHVKCIKEYRSKIESELSDICDGILKLLDSNLIPSASNGDSKVFYLKMKGDYHRYLAEFKTGAERKEAAESTLSAYKAAQDIANTELAPTHPIRLGLALNFSVFYYEILNSPDRACNLAKQAFDEAIAELDTLGEESYKDSTLIMQLLRDNLTLWTSDMQDDGADEIKETKNDNEQQ

SEQ ID NO: 19373 - protein, 258 aa, Lycopersicon esculentum
MASPREENVYMAKLAEQAERYEEMVEFMEKVVAAADGAEELTVEERNLLSVAYKNVIGARRASWRIISSIEQKEESRGNEDHVASIKEYRSKIESELTSICNGILKLLDSKLIGSAATGDSKVFYLKMKGDYHRYLAEFKTGAERKEAAENTLSAYKAAQDIANAELAPTHPIRLGLALNFSVFYYEILNSPDRACNLAKQAFDEAIAELDTLGEESYKDSTLIMQLLRDNLTLWTSDMQDDGTDEIKEATPKPDDNE

SEQ ID NO: 19374 - protein, 252 aa, Lycopersicon esculentum
MEKEREKQVYLARLAEQAERYDEMVEAMKAIAKMDVELTVEERNLVSVGYKNVIGARRASWRILSSIEQKEESKGHEQNVKRIKTYRQRVEDELTKICSDILSVIDEHLVPSSTTGESTVFYYKMKGDYYRYLAEFKAGDDRKEASEQSLKAYEAATATASSDLAPTHPIRLGLALNFSVFYYEILNSPERACHLAKQAFDEAIAELDSLSEESYKDSTLIMQLLRDNLTLWTSDLEEGGEHSKGDERQGEN

SEQ ID NO: 19375 - protein, 261 aa, Lycopersicon esculentum
MASSKERESLVYIARLAEQAERYDEMVDAMKNVANLDVELTVEERNLLSVGYKNVVGSRRASWRILSSIEQKEDARGNEQNVKRIQGYRQKVESELTDICNNIMTVIDEHLIPSCTAGESTVFYYKMKGDYYRYLAEFKTGDDKKEVSDLSLKAYQTATTTAEAELPITHPIRLGLALNFSVFYYEIMNSPERACQLAKQVFDEAISELDSLNEDNYKDGTLILQLLRDNLTLWTSDIPEDGEEAPKGDAANKVGAGEDAE

SEQ ID NO: 19376 - protein, 261 aa, Lycopersicon esculentum
MASSKERENFVYVAKLAEQAERYDEMVEAMKNVANMDVELTVEERNLLSVGYKNVVGSRRASWRILSSIEQKEESRGNEQNVKRIKEYLQKVESELTNICNDIMVVIDQHLIPSCSAGESTVFYHKMKGDYYRYLAEFKAGNDKKEVAELSLKAYQAATTAAEAELAPTHPIRLGLALNFSVFYYEIMNSPERACHLAKQAFDEAISELDSLNEDSYKDSTLIMQLLRDNLTLWTSDLPEDAEDAQKGDATNKAGGGEDAE

SEQ ID NO: 19377 - protein, 806 aa, Arabidopsis thaliana
MANAERMITRVHSQRERLNETLVSERNEVLALLSRVEAKGKGILQQNQIIAEFEALPEQTRKKLEGGPFFDLLKSTQEAIVLPPWVALAVRPRPGVWEYLRVNLHALVVEELQPAEFLHFKEELVDGVKNGNFTLELDFEPFNASIPRPTLHKYIGNGVDFLNRHLSAKLFHDKESLLPLLKFLRLHSHQGKNLMLSEKIQNLNTLQHTLRKAEEYLAELKSETLYEEFEAKFEEIGLERGWGDNAERVLDMIRLLLDLLEAPDPCTLETFLGRVPMVFNVVILSPHGYFAQDNVLGYPDTGGQVVYILDQVRALEIEMLQRIKQQGLNIKPRILILTRLLPDAVGTTCGERLERVYDSEYCDILRVPFRTEKGIVRKWISRFEVWPYLETYTEDAAVELSKELNGKPDLIIGNYSDGNLVASLLAHKLGVTQCTIAHALEKTKYPDSDIYWKKLDDKYHFSCQFTADIFAMNHTDFIITSTFQEIAGSKETVGQYESHTAFTLPGLYRVVHGIDVFDPKFNIVSPGADMSIYFPYTEEKRRLTKFHSEIEELLYSDVENKEHLCVLKDKKKPILFTMARLDRVKNLSGLVEWYGKNTRLRELANLVVVGGDRRKESKDNEEKAEMKKMYDLIEEYKLNGQFRWISSQMDRVRNGELYRYICDTKGAFVQPALYEAFGLTVVEAMTCGLPTFATCKGGPAEIIVHGKSGFHIDPYHGDQAADTLADFFTKCKEDPSHWDEISKGGLQRIEEKYTWQIYSQRLLTLTGVYGFWKHVSNLDRLEARRYLEMFYALKYRPLAVPLAQDD

SEQ ID NO: 19378 - protein, 165 aa, Euphorbia esula
MSADIEYRCFVGGLAWATTDQSLQEAFSPYGEILDSKIINDRETGRSRGFGFVTFNNEKSMRDAIQGMNSQELDGRNTTVNEAQSRGNGRSGGGGGYSRGGGGGGYGSGGGRRERGYGGGGGGYNSISTGGSGGYGGGRDQGYGSGGGGSRYSTGGGESDGNWRN

SEQ ID NO: 19379 - protein, 142 aa, Brassica rapa subsp. pekinensis
RQVTFCNRRNGLLKKAYELSVLCDAEVTLIVFSSRGRLYEYSNNSVKGTIERYKKAISDNTNTGTVAEINGQYYQQESAKLRQQIISIQNSNRQLMGETIGSMSPKELRNLEGRLDRSINRIRSKKNELLFAEIDYMQKREL

SEQ ID NO: 19380 - protein, 506 aa, Lithospermum erythrorhizon
MALPAIPLAIIIFLIISYKLYQKLRLKLPPGPRPLPIIGNIYQVKPVKFRCFYNWSKTYGPIFSIYYGSQMNVIVSTTELAKEVLKENDQHLADRFRTRSSASMSRGGKDLIWADYGPHYVKVRKLCNVELFSPKRLEAIRPMREDEYTALVESIYKDCTKPELKGKSLLVREYLSSVAFNNITRLAFGKRFMDSNGVVNEQGQEFKKITHDGIKITAKLSIAEYIPWIRWMFKVEQDALDKFAADRDHLTRVIMEEHIKSGNTKQHFVDALLTLQKQYDISEDTIIGLLWDMIAAGMDTATISTEWAMAELVRNPRVQRKAQEELDRVVGPDRIMTEADVPKLPYLQCIVKESLRLHPPTPLMLPHRASANVKIGGYDIPKGSIVHVNVWAIARDPAYWKNPEEFRPERFMEEDIDMKGTDYRLLPFGAGRRICPGAQLAINLITSSLGHLLHQFTWSPQPGVKPEEIDLSENPGTVTYMRNPVKAVVSPRLSAVHLYKRVESDM

SEQ ID NO: 19381 - protein, 307 aa, Bos taurus
GAKMPILGLGTWKSPPGKVTEAVKVAIDLGYRHIDCAHVYQNENEVGLALQAKLQEKVVKREDLFIVSKLWCTYHDKDLVKGACQKTLSDLKLDYLDLYLIHWPTGFKPGKDFFPLDEDGNVIPSEKDFVDTWTAMEELVDEGLVKAIGVSNFNHLQVEKILNKPGLKYKPAVNQIECHPYLTQEKLIQYCNSKGIVVTAYSPLGSPDRPWAKPEDPSILEDPRIKAIADKYNKTTAQVLIRFPIQRNLIVIPKSVTPERIAENFQVFDFELDKEDMNTLLSYNRDWRACALVSCASHRDYPFHEEF

SEQ ID NO: 19382 - protein, 666 aa, Neurospora crassa
MDGSLMAALPQGQDVIRVISTGGVTKVVKIAECNTCEEVMRVTLRKFGLREDHERNYCFWVLAGVDPDPNQCRRLGDTELWRVIKDHTRPERNRLILRRVPSGEPGKAELERAAAIAMEEAQQTHRPPIEPSDKRSQLKLQKVLGVGWEDLQQQPPLSPMSYQDRERNVSNAARDLERPAPLETPRAMPRRTQALRQFGGLRPPSELIASDLTSYFPDHSREAIDRTARLSMRRSARLSRVNHRLSVASTLSFASSIQDAPPIPTIADSWLTASNQIAKVRPRDVLPRAPHGYRDSVASSVLDTLQEEGSPTEPNRRSFVPFSDSGSDTAAVSVIDPDGNIVRHSYYDSGTNNSADSAVIQEALAEDGEDAADKELQTFLAGDAWDDSMWMKGSLIGQGSFGSVYLALHAITGELLAVKQVETPAPGADSKNDARKKSMIEALKREITLLRDLQHPNIVQYLGCSSSAEYLNIFLEYVPGGSVQTMLDQYGALPESLVRSFVRQILQGLSYVHNRDIIHRDIKGANILVDNKGTIKISDFGISKKLEATNILNGANNNKHRPSLQGSVFWMAPEVVKQTSYTRKADIWSLGCLVVEMMTGTHPFPDCTQLQAIFKIGGSKASPTIPDNASEEAKQFLAQTFEIDHNKRPSADELMLSPFLTPVPGT

SEQ ID NO: 19383 - protein, 433 aa, Streptomyces atroolivaceus
MRPDMSEVAVEQLKFLATDDVRTVAEEFGTPVFVYDEATVRASSKTMSTLPNAFGLTVRYSLKACPGQAIIRLFDREGFSFDASSVWEARRAVLAGVEPGRISMTAQEAVFDENLRDLIDQGLQFDAGSLHQLEEYGRAYPGGAVAIRINPGFGSGLVGRLNSGGPQSSFGIWHEQLPEVKQIVEQYGLRLVRLQSHIGSGHHWDILVDAVRTMLSFARDFQDVHTLDLGGGYRVSALQSDPVYDHTEWARVVADELKQFAEETGRRLHTEVEPGTYLTALAGSLVTKVIDKADTGAEGNSFLKINSGLTEIARPSYYGVQHPIVSVPATGGAERAADDREEFNVVGHCCIAGDVLTAKQEELAPVPLGRTEIGDYVVIERAGSYCSSMSMKNFNSYPEAAEVLRRTDGSFDLIRSRQSIEQVIVNERIPEGL

SEQ ID NO: 19384 - protein, 276 aa, Streptomyces atroolivaceus
MSGRLTGRTAIVTGAGRGVGRACATAFAAQGADLVLVDIAADLPHVPYPAATPSQLDHTARLCREQGAAVLTARADVRDAAACERVVADAVDRFGSLDVLVNNAGIAGPSGRIVHEVTEDEWAVMIDVNLNGAWRMLKAAGASMVAARSGSIVNIASTAGLVGYRNFAGYVASKHGLVGLTKAAALDYAPYRVRVNAVCPGSVRDGEAWEGRMLVEIGRSIGIEPADHEAEFITQMPMNTLVEADDVAGAALWLASEESRHSTGGVITVDAGYSAR

SEQ ID NO: 19385 - protein, 276 aa, Leishmania donovani
MNYEGHLKGHRGWVTSLACPQQAGSYIKVVSTSRDGTAISWKANPDRHSVDSDYGLPSHRLEGHTGFVSCVSLAHATDYALTASWDRSIRMWDLRNGQCQRKFLKHTKDVLAVAFSPDDRLIVSAGRDNVIRVWNVAGECMHEFLRDGHEDWVSSICFSPSLEHPIVVSGSWDNTIKVWNVNGGKCERTLKGHSNYVSTVTVSPDGSLCASGGKDGAALLWDLSTGEQLFKINVESPINQIAFSPNRFWMCVATERSLSVYDLESKAEFQHTGGRY

SEQ ID NO: 19386 - protein, 420 aa, Glomerella cingulata
MTTNGSDKPQVQPCRYKVGKTLGAGSYSVVKECVHIDTGRYYAAKVINKRLMAGREHMVRNEIAVLKKVSMGHQNILTLVDYFETMNNLYLVTDLALGGELFDRICRKGSYYESDAADLIRATLSAVAYLHDHGIVHRDLKPENLLFRTPEDNADLLIADFGLSRIMDEEQFHVLTTTCGTPGYMAPEIFKKIGHGKPVDVWALGVITYFLLCGYTPFDRDSDFEEMQAILNADYSFTPFDYWRGVSEHAKDFIRKCLTIDPKKRMTAHEALQHPFVAGYLNGEGEGQNLLPTVKKNFNARRTLHAAIDTVRAINKLREGQQNLMDGAKSREPDRGLKSPPNAKKDDSAISMGNTNHKDSGYGTQPEADNQNDVCHDRCGTTPTSVPASLRVRAVSRTRSLRQAKDCGAVPQCDDSLEAV

SEQ ID NO: 19387 - protein, 469 aa, Thermococcus sp. Rt3
MSAKKLLALLFVLAVLVGVAVIPARVGIAPVSAGATSRPSLEEGGVIMQAFYWDVPAGGIWWDTIRSKIPDWASAGISAIWIPPASKGMSGAYSMGYDPYDFFDLGEYYQKGTVETRFGSKQELINMINTAHSYGIKVIADIVINHRAGGDLEWNPFTNSYTWTDFSKVASGKYTANYLDFHPNEVKCCDEGTFGGFPDIAHEKSWDQYWLWASQKSYAAYLRSIGIDAWRFDYVKGYGAWVVKDWLKWWALAVGEYWDTNVDALLNWAYSSGAKVFDFPLYYKMDEAFDNKNIPALVSALQNGQTVVSRDPFKAVTFVANHDTDIIWNKYPAYAFILTYEGQPVIFYRDYEEWLNKDRLKNLIWIHNNLAGGSTSIVYYDNDELIFVRNGYGNKPGLITYINLGSSKVGRWVYVPKFAGSCIHEYTGNLGGWVDKYVGSNGWVYLEAPAHDPAKGQYGYSVWSYCGVG

SEQ ID NO: 19388 - protein, 288 aa, Drosophila pseudoobscura
MGKDFDAIGFVKDFAAGGISAAVSKTAVAPIERVKLLLQVQHISKQISPDKQYKGMVDCFIRIPKEQGFSSFWRGNLANVIRYFPTQALNFAFKDKYKQVFLGGVDKNTQFWRYFMGNLASGGAAGATSLCFVYPLDFARTRLAADTGKGGQREFTGLGNCLTKIFKSDGLVGLYRGFGVSVQGIIIYRAAYFGFYDTARMLPDPKNTPIYISWAIAQAVTTVAGIVSYPFDTVRRRMMMQSGRKATEIIYKNTLHCWATIAKQEGSAFFKGAFSNVLRGTGGAFVLV

SEQ ID NO: 19389 - protein, 288 aa, Drosophila subobscura
MGKDFDAMGFVKDFAAGGISAAVSKTAVAPIERVKLLLQVQHISKQISPDKQYKGMVDCFIRIPKEQGFSSFWRGNLANVIRYFPTQALNFAFKDKYKQVFLGGVDKNTQFWRYFMGNLASGGAAGATSLCFVYPLDFARTRLAADTGKGGQREFTGLGNCLTKIFKSDGLVGLYRGFGVSVQGIIIYRAAYFGFYDTARMLPDPKNTPIYISWAIAQCVTTVAGIVSYPFDTVRRRMMMQSGRKATEIIYKNTIHCWGTIAKQEGTAFFKGAFSNVLRGTGGAFVLV

SEQ ID NO: 19390 - protein, 413 aa, Drosophila pseudoobscura
  unsure (1)..(413): unsure at all Xaa locations
EVDLTTENGLFRAAVPSGASTGVHEALELRDNDKANYHGKSVLKAVAHVNDTLGPEVIKANLDVVDQAAVDNFMIKLDGTENKSKFGANAILGISLAVAKAGAAKKNVPLYKHIADLAGNKEIILPVPAFNVINGGSHAGNKLAMQEFMILPTGATTFTEAMKMGSEVYHHLKNVIKAKFGLDATAVGDEGGFAPNIQSNKEALVLITDAIAKAGYTGKIEIGMDVAASEFFKDGLYDLDFKNPASDKAQWLSPDKXANLYQEFIKEFPITSIEDPFDQDHWDAWTNLTCNTKIQIVGDDLTVTNPKRIATAVEKGACNCLLLKVNQIGTVTESIAAHLLAKKNGWGTMVSHRSGETEDSFXGDLVVGLSTGQIKTGAPCRSERLAKYNQILRIEEEIGSGVKFAGKNFRKPQ

SEQ ID NO: 19391 - protein, 413 aa, Drosophila subobscura
EVDLTTEHGLFRAAVPSGASTGVHEALELRDNDKANYHGKSVLKAVAHVNDTLGPEVIKANLDVVDQAAVDNFMIKLDGTENKSKFGANAILGISLAVAKAGAAKKNVPLYKHIADLAGNKEIILPVPAFNVINGGSHAGNKLAMQEFMILPTGATTFTEAMKMGSEVYHHLKNVIKAKFGLDATAVGDEGGFAPNIQSNKEALVLITDAIAKAGYTGKIEIGMDVAASEFFKDGLYDLDFKNPASDKAQWLTPDKLANLYQEFIKEFPITSIEDPFDQDHWDAWTNLTSNTKIQIVGDDLTVTNPKRIATAVEKGACNCLLLKVNQIGTVTESIAAHLLAKKNGWGTMVSHRSGETEDSFIGDLVVGLSTGQIKTGAPCRSERLAKYNQILRIEEEIGSGVKFAGKSFRKPQ

SEQ ID NO: 19392 - protein, 496 aa, Pseudomonas sp. VLB120
MNSSLSAIDGLRLPHQMLIGGQWVSAQSGKTLNVYNPATGDILTEVPDGDVEDVNAAVESAAATLRSDTWRPCLPVLASVFCCAWRISSEVHGDELARLETLNNGKLLIYSKLMEVGASAQWLRYMAGWATKLTGSTLDLSLPLPPEVRSRASTQRVPVGVVAAIIPWNFPLLMAVWKIAPALACGNTVVLKPAEETPLTALRLAELAMEAGLPAGALNVVTGRGETAGDALVRHPKVAKVAFTGSTEVGRIIGSACGRSLKAVSLELGGKSPVIVLADCDPQEAAEGAAAAIFFNHGQVCTAGSRLYVHESIYEDVIQRLAVIGESIVVGSGLEQGVHMGPMVSKKHHENVLRHIRNGIEDGADLICGGTEAPCAQGFFVKPTIFANREKKDIRLLSQEVFGPVLVATPFSDIAEVVNEANRSVYGLGASIWTNDLSAALRINDELEAGTVWVNTHNMVDPNLPFGGFKDSGVGREHGAAAIEHYTTTRSLVIAY

SEQ ID NO: 19393 - protein, 612 aa, Mycoplasma penetrans
MKKNKVKIDKIPNYEDFKKMKLHELLDLAVLLRKKIIDISENKSAHLSSNLGIVELSMALLYVFDSPQDLIAYDTGHQCYVHKMITDRADKISTIRESNGLSGFQEPNESIHDFISTGHSGNILSICQGFIEKNNSKSKSVIPVIGDAAISNGLAFEALNNIAYNKTPMLIIINDNGMSISKNVGALHKIMSKFQMSKSVFLTEKILRKILFKKEWSKKIYWSIYKSFSKLSKFFKGKNFFESLGFHYFGVIDGNNLKKTINVLKRIKNIVPFGPTILHVKTIKGLGYKEAELDDKGLYHSLKLSDPNLNSNNQTYGSVAANFLEKLIEYDNNIQIINPAMTLSSNFLNLSKKFPNNYEDVGIAEEHAVTKAAGMAIANKKVFVSIYSTFLQRSYDNLLHDVARLELPITFLVDRCDLSYSDGDTHHGIYDIGFLKSIPNTIITCASNKFELERLIILAYQNKSNPFFIRYTKEKCEDIEVKKEFSFGSWVYALQTKESKTCIISYGDIINDLKKEIKTKSIDLINAVFITNYQKENVLRILSTYKNIYVVEKVFDSNCLGDDLIILANENKLSCNIKKINIRNNKIGFGNKEDIDKKLNIDMNSIFAEIKS

SEQ ID NO: 19394 - protein, 377 aa, Mycoplasma penetrans
MLEGEKMENKKKKVLVFGATGNIGFSSLEIIEKENYELVGFSFNNNYEKALEIINRFPNALVFSPSVKTKNTVNSFEELLEKTNPDIILNALVGFSGLHITLLALKNNVDLALANKESLVVAGWLIEDLKRSSSSRIYPVDSEHSSLYDSLKNNNKEIKELIITCSGGPFYKKEFNELLNINFADAVKHPNWNMGKKISIDSATMMNKCFEIIEAYYLFNTKKIKVYQHGQSIIHSMIKFTDNSYIANMSVPDMKLSIQQGLSGYESKTNLINDLSFNNLNLTFSEIDLDKWKPIHWAYDFLENQNRAIPIIMNAANEEAIVLFEENKIKFLDIFEIIEKAIIALENTEVNDLKDILNLNKNTRKYVYDFSKNKFRY

SEQ ID NO: 19395 - protein, 483 aa, Mycoplasma penetrans
MLFMKEIKRTLTFDDVLLRPQYSEVLPKETDVRTTLSSRFQMKIPIMSASMDTVTEIEMAYNMSLNGGIGVIHKNLSHSQQSNMIKQIKHIKNGLYYNIMAFESSNKISMIKEKVFDEYLDDCIFVTVNGSIVNIVSKEDLENKKIDSNSTLESIGRKKIIFAKDSSSLEEILKIMDENKLDFMPIVSETTNGIIAVAKRKWLVPYLNSDDPLIDSKERPKVCGAIGVTEDSIERAKLLIAAGVDAIIIDCAHGHSKKVIELTREIKKLFPKLFLIVGNVVTANGVNDLYKAGADAVKIGVGPGAICTTRTVSGVGIPQFSAILECYEEAKKLNIPIIADGGIKNSGDMVKALAAGADAVMLGSLLAGCDESPSVKVMHNNKMYKQYRGMGSIAAMKAGSSDRYGQDGIKKLVAEGVEGLMPYIGPVKESLYQLVGGLKSGMGYVGAKTLTDLKNKAEFVEQTGIGLKESSTHSIVLLSEQSK

SEQ ID NO: 19396 - protein, 450 aa, Mycoplasma penetrans [sequence omitted]

SEQ ID NO: 19397 - protein, 299 aa, Mycoplasma penetrans
MITTVWNFRRINMNKNNNTNISKFNLSSGTNHNPPLLTLNDGYQIPIIGLGTTSLHNQTCKNAIKAALEIGIRLFDTASLYGNEKEVGETIRESNINRNEIFVITKLYPGAQFANPEKAIEEALNKLNTDYIDMMLLHHPGENDVKAYKAIEKYIEKGKIKSVGLSNWYIKEINSFLPQINIKPSLIQNEIHIYYQEKEVVPYMHNLNIAMQAWYPFGGRGHTFSVLNNPTIVSIAKDHNKTSAQIISRWLLQRGIITIVGSSNPIHIKENISVFDFELSNQEMELIASLDKNEKHDWY

SEQ ID NO: 19398 - protein, 289 aa, Mycoplasma penetrans
MKTSNVKLITLNNGNKIPSIGFGVFQIPKEETADCVKKAISIGYRLIDTAQAYHNEKETGLGIKLSGVKREEIFLTTKVWVSNYERCYESVIESLKRLDTSYLDLILLHQPFGNYYKAYQDLERLYKENKVRNIGVSNFWDNRIIDLCFFNQIKPMVNQIEINPFHQRIEDRFYNDKYKVVSQAWAPFAEGKNGLFTNPTLVEIGKKYNKTPAQVILRWLVQSNVVALCKTVNESRMKENFDIFDFELSKQDLDKIVALNKQHSEFRYHHSAEGAEFYGEISNQIKIGD

SEQ ID NO: 19399 - protein, 579 aa, Mycoplasma penetrans
MMKDKKYKGIGASDGIATAKAFLLDKPIFKIDDSKISNVDQEISKVNAAIEASIKNIEHVKTIAIDKIGAEKAMVFDAHAQIANDPELKNEIISIIKDQKVNGAYAIDVVFKKTHDLFANMEDDYFKQRASDVEDVRTKILSFFLNIELPDLLAIKSEVIIVADDLTPSETALLDKKYVKGFATNIGGRTSHAAIMARTMEIPAVLGLKDITNAVDKNSMIALDGSTGDLVIEPSDLSVWNKKKEIFLKEKEELKKYINVKAKTLDGVEVDVVANIGKPEDADNLDSYGAEGIGLVRSEFLYMENSKWPTEEEQFNAYKYILEKQKNKLVIIRTLDIGGDKKLNYYQFPHEMNPFLGYRAIRFCLNNPEIFKTQIRALLRASAFGRMGIMFPMIATVDEFLKAKNIVEETKKELTKEKIAFDSKVLVGMMVEIPSSAFLTDKFAKYADFFSIGTNDLVQYTFAVDRMSENVSYLYQPNNPALLRAIKATIEGAAVHKKFVGMCGEMAGDIRSIPILLGLGGKGLDEFSMSASSILRSKKVIASLKHSECVELANKAIDCDTAEEVNNLVENFLQKKNLI

SEQ ID NO: 19400 - protein, 266 aa, Mycoplasma penetrans
MKKRIGYGSFEVNDVPTLKKCIKQAVLSGYDFVDTAYYYQNEEAIGKAIKELREEGFDKPILVQTKIWPEHYGNVRDAVLLSCQKLQTNKLDMCLLHRRHFNLNMDLSAWEQLIECQKEGLVGEIGVSNFDRDALEIMRQRTGVYPLSNQIELSVNNLREDRVVYNHSKGIEVQAWSPLGDLENNLKNPVLIEMAKKYNTDVAGVLIAYVGSLNCSIIVKTSNPDRVVSNYKAFQIILEESDVEKLKKLNTYKIKYSESFIYDIDN

SEQ ID NO: 19401 - protein, 427 aa, Mycoplasma penetrans
MKLKLGRKDKTEKKEVKGTLNQDFISSGILEGNLQKNINRDDLVTAKKKFIKELSSKKRKKNKVVAEEILIYFDRFDLTNDDYLEIFDWLKQEGIEIDRNPFTSNNSDDIKELKSNVASKIDYIVHDVTTPMSSTRDKVDDGIKSFLNVLGSSKMLTSQEEQEIGKMLDSEDKTIREYAINQLMTSNLRLVTSIAKKYLNRGLDLEDLLQEGSLGLMKAITKFDYKLGNKFSTYATWWIRQAITRAIADQARTIRIPVHMVETINKLSKAERQLMQEYGRDPTPEELADAMDGTAAGFTAKKILNIKKLNIDPVSLDKPVGKDEESKFVDFVKDDDNLNPEQFTEKELMGEHIDDILKKFLQEKEEDIIRMRYGLPPYSHPMTLEEVGEKYGITRERVRQIEAKALRKIKHPSKSGILKGFNENNDF

SEQ ID NO: 19402 - protein, 285 aa, Mycoplasma penetrans
MKYIKLANGLHMPIIGLGVYKAEGENCENTIIKAIDDYGYRMIDTAQVYFNEEFVGNAIKQTKIKREDIFITTKVWISNYGYNNTMYSISKSLKKLQTNYIDLVLLHQPFGDYYSAWKALEVLYKKGIVKAIGVSNFEADRLVDFCLHVDVKPVINQIELHPLRQRIEDLHWNNKYGVAVESWASFGRATSEIMENPILVSLAEKYNKTVPQIILRWLIQQNIVVIPKTVTESRLKENMDIFDFEISDDDMDLIKTINQNKTVSKHHHDPSTAEEIFSKFPEIRR

SEQ ID NO: 19403 - protein, 378 aa, Mycoplasma penetrans
MKMSINRDLLFGIQEVCIYPKAITNIRSRSQCSPLINGKLPLFTAPMTSVIDNKTYKIYEENNINVIIPRTVPIHERARFFDKCFVAMGLDEMEEYVKLNYKEMAKLESINILIDISNGHMRRLANSIRDLKRIFRNKISIMCGNIANPLTFQYLSEAGADYIRVGIGAGCGCITASNTGIFYPMGSLIYECRKIQEKMEESYRLNGTSKPAKIVADGGMKNYDYIIKSLYLGADYVMCGRLFSQCWESPGEIWYKEKSSQNIHENWKLLGNHSTSEEHLEYQPDIYDYKKIFYGMATKKAQTEMEAAADQKEKKPLKTSEGIIKELPILHRIEGWVENFRSYLTSAMSYTDCLTLKDVKNFKEFRLMTYAAQESYNK

SEQ ID NO: 19404 - protein, 505 aa, Xanthobacter autotrophicus
MNKPEIAITKQSPFKARYGNFIGGKFVEPVGGRYFDNTSPVTGGKICEIARSDADDIEKALDAAHAAKDAWGKTSAAVRALILNRIADRMEENLDLLALAETWDNGKPIRETTAADMPLAIDHFRYFAGAVRAQEGGISEIDHDTVAYHFHEPLGVVGQIIPWNFPILMAVWKLAPALAAGNCVVLKPAEQTPASILVLAELIADLLPPGVLNIVNGFGLEAGKPLASSSRIAKIAFTGETTTGRLIMQYASQNLIPVTLELGGKSPNIFFADVVAEDDDFFDKAVEGFVMFALNQGEVCTCPSRALIQESIYDRFMEKALKRVAAIVQGSPLDPATMIGAQASSEQLEKILSYIDIGKQEGAEVLIGGERNTFGGDLAGGYYVKPTVFKGHNKMRIFQEEIFGPVVSVTTFTDDAEALHIANDTLYGLGAGVWTRDGNRAYRFGRAIQAGRVWTNCYHAYPAHAAFGGYKQSGIGRENHKMMLDHYQQTKNMLVSYSPKKLGFF

SEQ ID NO: 19405 - protein, 506 aa, Xanthobacter autotrophicus
MNSPAFLSSAHTSPFKPRYGNFIGGTFVEPVSGRYFENTSPITGKVICEVPRSDEHDIERALDAAHAAKKAWGRTSAADRALVLLKIADRLEANLELLAGAETWDNGKPIRETTLADIPLAIDHFRYFAACVRAQEGTLGEIDHDTIAYHYHVPLGVVGQIIPWNFPILMAAWKLAPALGAGNCVVLKPAEQTPASILVLAELIADLLPPGVLNIVNGFGLEAGKPLASSPRISKIAFTGETGTGRLIMGYAAQNLIPVTLELGGKSPNIFFADVAAEDDDFLDKAVEGFVMFALNQGEVCTCPSRALVQESIFDKFMEKALARVAAIKQGSPLDPSTMIGAQASSEQMHKILSYIDIGRAEGAQVLAGGERNVLTGELADGFYVKPTVFLGKNNMRIFQEEIFGPVVSVTTFKDEEEALHIANDTLFGLGAGLWTRDGSRAYRVGREIEAGRVWTNCYHAYPAHAAFGGYKQSGIGRETHKMMLDHYQQTKNLLVSYSPKKLGFF

SEQ ID NO: 19406 - protein, 265 aa, Bacillus licheniformis
MMMAQPSKTTKLTKTEVDTLIKKYQDSQDEDAQLTLVQTYKNLVETLAKKYSKGKSFHEDLCQVGMLGLLGAIKRYDPDVGKSFEAFAIPTIIGEIKRFLRDKTWSVHVPRRIKELGPRIKMAVDHLTNETQRSPKVDEIAEFLDVTEEEVLETMEMGKSYQALSVDHSIEADADGSTVTILDIVGSQEEGYEKVNQKLMLESVLHVLSDREKQIIELTYIQNKSQKETGDMLGISQMHVSRLQRKAVKKLREALAEDPFMELKP

SEQ ID NO: 19407 - protein, 218 aa, Homo sapiens
PRAMCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 19408 - protein, 897 aa, Homo sapiens [sequence omitted]

SEQ ID NO: 19409 - protein, 312 aa, Leishmania major
MNYEGHLKGHRGWVTSLACPQQAGSYIKVVLTSRDGTAISWKANPDRHSVDSDYGLPSHRLEGHTGFVSCVSLAHATDYALTASWDRSIRMWDLRNGQCQRKFLKHTKDVLAVAFSPDDRLIVSAGRDNVIRVWNVAGECMHEFLRDSHEDWVSSICFSPSLEHPIVVSGSWDNTIKVWNVNGGKCERTLKGHSNYVSTVTVSPDGSLCASGGKDGAALLWDLSTGEQLFKINVESPINQIAFSPNRFWMCVATERSLSVYDLESKAVIAELTPDGAKPSECISIAWSADGNTLYSGHKDNLIRVWSISDAE

SEQ ID NO: 19410 - protein, 312 aa, Leishmania braziliensis
MNYEGHLKGHRGWVTSLACPQQAGSYIKVVSTSRDGTAISWKANPDRHSVDSDYGLPSHRLEGHTGFVSCVSLAHATDYALTASWDRSIRMWDLRNGQCQRKFLKHTKDVLAVASSPDDRLIVSAGRDNVIRVWNVAGECMHEFLRDSHEDWVSSICFSPSLEHPIVVSGSWDNTIKVWNVNGGKCERTLKGHSNYVSTVTVSPDGSLCASGGKDGAALLWDLSTGEQLFKINVESPINQIAFSPNRFWMCVATERSLSVYDLESKAVIAELTPDGAKPSECISIAWSADGNTLYSGHKDNLIRVWSISDAE

SEQ ID NO: 19411 - protein, 474 aa, Rattus norvegicus
MLKVTVPSCPSSPCSSVTSSTENLVPDYWIDGSKRDPLSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAADAVKQILEAVAYLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVKKLIVLDPKKRLTTFQALQHPWVTGKAANFVHMDTAQKKLQEFNARRKLKAAVKAVVASSRLGSASSSHTNIQESNKASSEAQPAQDGKDKTDPLENKIQAGDHEAAKAAADETMKLQSEEVEEEEGVKEEEEEEEEEEETSRMVPQEPEDRLETDDQEMKRNSEETLKSVEEEMDPKAEEEAAAVGLGVPPQQDAILPEY

SEQ ID NO: 19412 - protein, 424 aa, Arabidopsis thaliana; identical to SEQ ID NO: 1129

SEQ ID NO: 19413 - protein, 237 aa, Homo sapiens
HAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDNLEHKLNDLLKEKQSVERKCTQLNTKVAKLTNELKEEQEMNKCLRANQVLLQNKLKEEERVLKETCDQKDLQITEIQEQLRDVMFYLETQQKINHLPAETRQEIQEGQINIAMASASSPASSGGSGKLPSRKGRSKRGK

SEQ ID NO: 19414 - protein, 198 aa, Chlorogloeopsis fritschii PCC 6912
MVVSIAKKYMNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIESDGETPEDQVSKNLLREDLEKVLDSLSPRERDVLRLRYGLDDGRMKTLEEIGQIFNVTR

SEQ ID NO: 19415 - protein, 203 aa, Anabaena planctonica NIES 810
VQSNLRLVVSIAKKYMNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIAKSAQSPISLETPIGKEEDSRLGDFIESEGETPEDQVSKNLLREDLEKVLDSLGPRERDVLRLRYGLDDGRMKTLEEIGQIFNVT

SEQ ID NO: 19416 - protein, 203 aa, Gloeobacter violaceus PCC 8105
VQSNLRLVVSIALKYMNRGLSFQDLIQEGSLGLIRAAEKFDHEKGYKFSTYATWWIRQAITRAIADQSRTIRLPVHLYETISRIKKTTKLLSQELGRKPTEEEIATRMEMTIEKLRFIAKSAQLPISLETPIGKEEDSRLGDFSEADGETPEDKVAKNLLREDLEAVLNTLSPRERDVLRLRYGLDDGRMKTLEEIGQLFNVT

SEQ ID NO: 19417 - protein, 203 aa, Fischerella major NIES 592
VQSNLRLVVSIAKKYMNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIVKSAQLPISLETPIGKEEDSRLGDFIESDGETPEDQVSKNLLREDLEKVLDSLSPRERDVLRLRYGLDDGRMKTLEEIGQIFNVT

SEQ ID NO: 19418 - protein, 188 aa, Scytonema sp. IAM M-262
MNRGLSFQDLIQEGSLGLIRAAEKFDHEKGYKFSTYATWWIRQAITRAIADQSRTIRLPVHLYETISRIKKTTKLLSQEMGRKPTEEEIATRMEMTIEKLRFIAKSAQLPISLETPIGKEEDSRLGDFIESDSETPEDQVSKNLLREDLEKVLDSLSPRERDVLRLRYGLDDGRMKTLEEIGQIFNVT

SEQ ID NO: 19419 - protein, 499 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 19420 - protein, 478 aa, Homo sapiens
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIK

SEQ ID NO: 19421 - protein, 495 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 19422 - protein, 556 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPAPLQTAMEPQTTVVHNATDGIKGSTESCNTTTEDEDLKAAPLRTGNGSSVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 19423 - protein, 411 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLEPQTTVVHNATDGIKGSTESCNTTTEDEDLKARCLKDGAPGTEQPPLQACSPSLLSAPQPCENRRSLRLQNS

SEQ ID NO: 19424 - protein, 504 aa, Homo sapiens
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLEPQTTVVHNATDGIKGSTESCNTTTEDEDLKVRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 19425 - protein, 298 aa, Oryctolagus cuniculus
MSDQALSFLKDFLAGGVAAAVSKTAVAPIERVKLLLQVQHASKQISAEKQYKGIIDCVVRIPKEQGFLSFWRGNLANVIRYFPTQALNFAFKDKYKQIFLGGVDRHKQFWRYFAGNLASGGAAGATSLCFVYPLDFARTRLAADVGKGAAQREFSGLGNCLTKIFKSDGLRGLYQGFNVSVQGIIIYRAAYFGVYDTAKGMLPDPKNVHIIVSWMIAQTVTAVAGLVSYPFDTVRRRMMMQSGRKGADIMYTGTVDCWKKIAKDEGAKAFFKGAWSNVLRGMGGAFVLVLYDEIKKYV

SEQ ID NO: 19426 - protein, 577 aa, Streptococcus salivarius
MTEMLKGIAASDGVAVAKAYLLVQPDLSFETVTVEDTSAEEARLDAALAASQDELSVIREKAVESLGEEAAAVFDAHLMVLADPEMTGQIKETIRAKQVNAEAALTEVTDMFIAIFEGMEDNPYMQERAADIRDVTKRVLANLLGKKLPNPATINEESIVVAHDLTPSDTAQLNKKYVKAFVTNIGGRTSHSAIMARTLEIAAVLGTNNITELVKDGDILAVSGITGEVVINPTEEQIAEFKAAGEAYAKQKAEWALLKDAQTVTADGKHFELAANIGTPKDVEGVNDNGAEAVGLYRTEFLYMDSQDFPTEDDQYEAYKAVLEGMNGKPVVVRTMDIGGDKELPYFDLPKEMNPFLGYRALRISISETGNQMFRTQLRALLRASVHGKLRIMFPMVALLTEFRTAKGILEEEKAKLVAEGVAVADDIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSVLRTRSLMKKLDTAKMEEYANRALTECSTMEEVLELSKEYVNVD

SEQ ID NO: 19427 - protein, 321 aa, Chenopodium rubrum
MAVKPTKAEKKIAYDQKLCQLLDEYSQVLIASADNVGSNQLQAIRIGLRGDSIVLMGKNTMMKRSIRLHAENTGNENLRNVEQLFLPNVGLIFTKGDLNQVREEISKYKVGAPARFGLVAPIDVVVPPGNTGLDPSQTSFFQVLNIPTKINKGTVEIITAVELIKKGEKVGSSEAALLAKLGIRPFSYGLNVESVYDDGSVFSPEVLDLTEDDLLARFATGVSMVTSLSLAISYPTLAAAPHSSSMGATMFLLLLLQPTMTSLRPRKLRSISRILAVASCSCSSAGTAPTGGGAAAAAVEEKKEEPEEESDDDIGFSLFDD

SEQ ID NO: 19428 - protein, 808 aa, Oryza sativa
MAAKLARLHSLRERLGATFSSHPNELIALFSRYVNQGKGMLQRHQLLAEFDALIEADKEKYAPFEDILRAAQEAIVLPPWVALAIRPRPGVWDYIRVNVSELAVEELSVSEYLAFKEQLVDGHTNSNFVLELDFEPFNASFPRPSMSKSIGNGVQFLNRHLSSKLFQDKESLYPLLNFLKAHNHKGTTMMPNDRIQSLRGLQSSLRKAEEYLMGIPQDTPYSEFNHRFQELGLEKGWGDCAKRVLDTIHLLLDLLEAPDPANLEKFLGTIPMMFNVVILSPHGYFAQSNVLGYPDTGGQVVYILDQVRALENEMLLRIKQQGLDITPKILIVTRLLPDAVGTTCGQRVEKVIGTEHTDILRVPFRSENGILRKWISRFDVWPFLETYTEDVANEIMREMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYFPYTEADKRLTAFHPEIEELLYSEVENDEHKFVLKDKNKPIIFSMARLDRVKNMTGLVEMYGKNAHLRDLANLVIVCGDHGNQSKDREEQAEFKKMYGLIDQYKLKGHIRWISAQMNRVRNGELYRYICDTKGVFVQPAFYEAFGLTVIEAMTCGLPTIATCHGGPAEIIVDGVSGLHIDPYHSDKAADILVNFFEKCKQDSTYWDNISQGGLQRIYEKYTWKLYSERLMTLTGVYGFWKYVSNLERRETRRYIEMFYALKYRSLASAVPLAVDGESTSK

SEQ ID NO: 19429 - protein, 805 aa, Vigna radiata var. radiata
MATDRLTRVHSLRERLDETLSANRNEILALLSRIEGKGKGILQHHQVIAEFEEIPEESRQKLTDGAFGEVLRSTQEAIVLPPWVALAVRPRPGVWEYLRVNVHALVVEVLQPAEYLRFKEELVDGSSNGNFVLELDFEPFTASFPRPTLNKSIGNGVQFLNRHLSAKLFHDKESLHPLLEFLRLHSVKGKTLMLNDRIQNPDALQHVLRKAEEYLGTVPPETPYSAFEHKFQEIGLERGWGDNAERVLESIQLLLDLLEAPDPCTLETFLGRIPMVFNVVILSPHGYFAQDNVLGYPDTGGQVVYILDQVRALENEMLHRIKQQGLDIVPRILIITRLLPDAVGTTCGQRLEKVFGTEHSHILRVPFRTENGIVRKWISRFEVWPYLETYTEDVAHELAKELQGKPDLIVGNYSDGNIVASLLAHKLGVTQCTIAHALEKTKYPESDIYWKKLEERYHFSCQFTADLFAMNHTDFIITSTFQEIAGSKDTVGQYESHTAFTLPGLYRVVHGIDVFDPKFNIVSPGADQTIYFPHTETSRRLTSFHTEIEELLYSSVENEEHICVLKDRSKPIIFTMARLDRVKNITGLVEWYGKNAKLRELVNLVVVAGDRRKESKDLEEKAEMKKMYSLIETYKLNGQFRWISSQMNRVRNGELYRVIADTKGAFVQPAVYEAFGLTVVEAMTCGLPTFATCNGGPAEIIVHGKSGFHIDPYHGDRAADLLVEFFEKVKVDPSHWDKISQAGLQRIEEKYTWQIYSQRLLTLTGVYGFWKHVSNLDRRESRRYLEMFYALKYRKLAESVPLAVE

SEQ ID NO: 19430 - protein, 324 aa, Homo sapiens
MSRPSSTGPSANKPCSKQPPPQPQHTPSPAAPPAAATISAAGPGSSAVPAAAAVISGPGGGGGAGPVSPQHHELTSLFECPVCFDYVLPPILQCQAGHLVCNQCRQKLSCCPTCRGALTPSIRNLAMEKVASAVLFPCKYATTGCSLTLHHTEKPEHEDICEYRPYSCPCPGASCKWQGSLEAVMSHLMHAHKSITTLQEEDIVFLATDINLPGAVDWVMMQSCFGHHFMLVLEKQEKYEGHQQFFAIVLLIGTRKQAENFAYRLELNGNRRRLTWEATPRSIHDGVAAAIMNSDCLVFDTAIAHLFADNGNLGINVTISTCCP

SEQ ID NO: 19431 - protein, 164 aa, Euphorbia esula
MSADIEYRCFVGGLAWATTDQSLQEAFSPYGEILDSKIINDRETGRSRGFGFVTFNNEKSMRDAIQGMNSQELDGRNITVNEAQSRGSGGGGGGGGYSRGGGGGGYGGGGRREGGYGGGGGGYNSRSSGGGGGYGGGRDQGYGGGGGGSRYSRGGGESDGNWKN

SEQ ID NO: 19432 - protein, 123 aa, Oikopleura dioica
MSGKGKGAKAKAKAKSRSVRAGLQFPVGRVHRMLRKGNYAERVGAGAPVYLAAVLEYLSAEVLELAGNAARDNKKTRIIPRHLQLAIRNDEELNKLLGGVTIAQGGVLPNIQAILLPKKTGDK

SEQ ID NO: 19433 - protein, 126 aa, Oikopleura dioica
MSGKGKKKTATKTKQTRSSRAGLQFPVGRVHRMLRRGNWADRVGAGAPVYMAAVLEYLTAEVVELAGNAARDNKKSRIIPRHLQLQLAIRNDEELSKLLGGVTIAQGGVLPNIQAILLPKKTAKKE

SEQ ID NO: 19434 - protein, 124 aa, Oikopleura dioica
MSGKGKKNAKATTKKSRSSRAGLQFPVGRVHRMLRRGNWADRVGAGAPVYLAAVLEYLTAEVVELAGNAARDNKKSRINPRHLQLAIRNDEELTKLVGKVTIAQGGVLPNINPALLPKKAPKKE

SEQ ID NO: 19435 - protein, 116 aa, Oikopleura dioica
AKAKAKAKSRSVRAGLQFPVGRVHRMLRKGNYAERVGAGAPVYLAAVLEYLSAEVLELAGNAARDNKKTRIIPRHLQLAIRNDEELNKLLGGVTIAQGGVLPNIQAILLPKKTGDK

SEQ ID NO: 19436 - protein, 102 aa, Oikopleura dioica
AGRGKGGKGLGKGGAKRHRKVLRDNIQGITKPAIRRLARRGGVKRISGLIYEETRGVLKVFLENVIRDAVTYTEHAKRKTVTALDVVYALKRQGRTLYGFGG

SEQ ID NO: 19437 - protein, 266 aa, Gossypium robinsonii
LSVEEIEVAPPQKNEVRVKIHFTSLCHTDVYFWEAKGQNPLFPRILGHEAGGVVESVGEGVMDVQPGDHVLPIFTGECKECPHCLSEASNMCDLLRINTERGGMLHDGQTRFSKDGKPIYHFLGTSTFSEYTVVHVGQIAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 19438 - protein, 266 aa, Gossypium raimondii
LSVEEIEVAPPQKNEVRVKIHFTSLCHTDVYFWEAKGQNPLFPRILGHEAGGVVESVGEGVMDVQPGDHVLPIFTGECKECPHCLSEASNMCDILRINTEWGGMLHDGHTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 19439 - protein, 266 aa, Gossypium tomentosum
LSVEEIEVAPPQKNEVRVKIHFTSLCHTDVYFWEAKGQNPLFPRILGHEAGGVVESVGKGVIDVQPGDHVLPIFIGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPVQEVIAEMTGGGVDCSIECTGSTQAMVSAFECVHD

SEQ ID NO: 19440 - protein, 266 aa, Gossypium mustelinum
LSVEEIEVAPPQKNEVRVKIHFTSLCHTDVYFWEAKGQNPLFPRILGHEAGGVVESVGEGVMDVQPGDHVLPIFTGECKERPHCLSEASNMCDLLRINTERGGMLHDGHTRFSKDGKPIYHFLGTSTFSEYTVVHVGQVAKINPEAPLDKVCVLSCEMSTGIGATVNVAKPKKGGSVAVFGLGAVGLAAAEGARVCEASRIIGIDLNPNRFEEAKKFGCTEFVNPKDHNKHVQEVIAEMTGGGVDCSIKCTGSTQAMVSAFECVHD

SEQ ID NO: 19441 - protein, 266 aa, Gossypium darwinii
LSVEEIEVAPPQKNEVRVKIHFTSLCHTDVYFWEAKGQNPLFPRILGHEAGGVVESVGEGVIDVQPGDHVLPIFTGECKECPHCLSEASNMCDLLRINTERGGMLHDGHTRFSKDGKPIYHFLGTSTFSEYTVVHVGQVAKINPEAPLDKVYVLSCGMSTGFGATVNVAKPKKGGSVAIFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 19442 - protein, 266 aa, Gossypium tomentosum
LSVEEIEVAPPQKNEVRVKIHFTSLCHTDVYFWEAKGQNPLFPRILGHEAGGVVESVGEGVMDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 19443 - protein, 266 aa, Gossypium mustelinum
LSVEEIEVAPPQKNEVRVKIHFTSLCHTDVYFWEAKGQNPLFPRILGHEAGGVVESVGEGVTDVQPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 19444 - protein, 272 aa, Gossypium darwinii
LSVEEIEVAPPQKNEVRVKIHFTSLCHTDVYFWEAKGQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMTYSSSLLAGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAVVSAFECVHD

SEQ ID NO: 19445 - protein, 505 aa, Alteromonas sp.
MIYAKPGSEGSVVSFKESYGNFINGEWVAPVKGEYFTATSPVDGSDIAQVPRSTSEDVELALDAAHAAKKGWAEKSVAERSNVLLKIADRIEENLELLAVAETWDNGKAVRETLNADIPLCADHFRYYAGCIRSQEGTIGEIDKNTVAYHFHEPYGVVGQIIPWNFPLLMAAWKLAPALVTGNVVVLKPAEQTPVSILLFAELIQDLLPPGVLNIVNGFGAEAGQALATSTRIAKIAFTGSTPVGGHILRCAAENLIPSTVELGGKSPNLFFADIMDHEPEFIDKCAEGLVLGYFNQGEVCTCPSRAIIQEDIYDAFMEKVLEKIQKIKRGNPLDTETMVGAQASNEQFEKILKYIDIGKSEGAQVVTGGEKEQLPGFDDGYYIQPTILKGENHMRVFQEEIFGPVIAVQTFKTEEEAIEIANNTSFGLGAGVWSRDANVAFRVGRAIEAGRVWTNCYHLYPAHAAFGGYKKSGIGRETHKMMLDHYQQTKNLLVSYDINPLGFF

SEQ ID NO: 19446 - protein, 743 aa, Hordeum vulgare subsp. vulgare
  unsure (1)..(743): unsure at all Xaa locations
MSSGAVLVAIAASIGNLLQGWDNATIAGAVLYIKKEFSLETQPLIEGLIVAMSLIGATVITTFSGAVADAVGRRPLLIASSVLYFVSGLVMLWAPNVYVLLLARLIDGFGIGLAVTLVPLYISETAPTDIRGLLNTLPQFSGSGGMFLSYCMVFTMSLMPQPDWRIMLGVLSIPSLMYFALTVFYLPESPRWLVSKGRMAEAKRVLQRLRGREDVSGEMALLVEGLGVGKDTHFEEYIIGPDDELADDGLAPDQEKLKLYGAEEGVSWIARPVRXGGQSALGSALGLMSRHGSMVSQGKSLVDPLVTLFGSVHEKMPEVMGSMRSTLFPNFGSMFSVAEQQQAKADWDAESHRDDEDYASDHGADDIEDNLNSPLISRQATSVEGKEIAAPHGSIMGGVESSSMQGGDAVSSMGIGGGWQLAWKWTEREGADGQKEGGFQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGILLSNIGLSSSSASILISALTTLLMLPSIGIAMRLMDMSGRRFLLLSTIPVLIVALAILVLVNVLDVGTMVHAALSTISVIVYFCFFVMGFGPIPNILCAEIFPTSVRGICIAICALTFWIGDIIVTYTLPVMLNAIGLAGVFGIYAVVCMIAFVFVYMKVPETKGMPLEVITEFFSVGAKQGKEATD

SEQ ID NO: 19447 - protein, 753 aa, Hordeum vulgare subsp. vulgare
MRRGGWRSWRGCRGWRARRSSRLRRGWRRRRAGAGAGARKDLAALQAEWKSLEEEELVMAAAAKLVFLASNVMLWAPNVYVLLLARLIDGFGIGLAVTLVPLYISETAPTDIRGLLNTLPQFSGSGGMFLSYCMVFTMSLMPQPDWRIMLGVLSIPSLMYFALTVFYLPESPRWLVSKGRMAEAKRVLQRLRGREDVSGEMALLVEGLGVGKTHIEEYIIGPDDELADDGLAPDQEKLKLYGAEEGVSWIARPVRGGGQSALGSALGLMSRHGSMVSQGKSLVDPLVTLFGSVHEKMPEVMGSMRSTLFPNFGSMFSVAEQQQAKADWDAESHRDDEDYASDHGADDIEDNLNSPLISRQATSVEGKEIAAPHGSIMGGVESSSMQGGDAVSSMGIGGGWQLAWKWTEREGADGRKEGGAQRIYLHEEGVSGDRRGSILSMPGGDIPPGGEYIQAAALVSQPALYSKDLIEQQLAGPAMVHPSEAVAKGTKWAELFEPGVKHALFVGIGLQILQQFAGINGVLYYTPQILEQAGVGILLSNIGLSSSSASILISALTTLLMLGYISDRIGARAITAASFMYCSIPALFFYRRAILVLVNVLDVGTMVHAALSTISVIVYFCFFVMGPIPEGSTSSVKIDTDRANAASLAKALLTFWIGDIIVTYTLPVMLNAIGLAGVFGIYAVVCMIAFVFVYMKVPETKGMPLEVITEFFSVGAKQGKEATDEVAEKIAESRPSEECRSPVDYVQDHVMEV

SEQ ID NO: 19448 - protein, 752 aa, Mus musculus
MSSRTALAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKEALTNQKYNEVTATYLLLGRKTEEGGDRGAPGLALARVRAPSDTTNGTSSSKGSSHNKGQRASSSTYHRQRRHSDFCGPSPAPLHPKRSPTSTGDTELKEERMPGRKASCSAVGSGSRGLPPSSPMVSSAHNPNKAEIPERRKDSTSTPNNLPPSMMTRRNTYVCTERPGSERPSLLPNGKENSSGTSRVPPASPSSHSLAPPSGERSRLARGSTIRSTFHGGQVRDRRAGSGSGGGVQNGPPASPTLAHEAAPLPSGRPRPTTNLFTKLTSKLTRRVTDEPERIGGPEVTSCHLPWDKTETAPRLLRFPWSVKLTSSRPPEALMAALRQATAAARCRCRQPQPFLLACLHGGAGGPEPLSHFEVEVCQLPRPGLRGVLFRRVAGTALAFRTLVTRISNDLEL

SEQ ID NO: 19449 - protein, 174 aa, Pseudomonas putida KT2440
MLAAYHGDPAARSVDEVLLCYPGILAIIHHRLAHHLYKAGLPLLARISSELAHSATGIDIHPGAQIGPSFFIDHGTGVVIGETAIIGERVRIYQAVTLGAKRFPSDESGTLHKGLPRHPIVEDDVVIYAGATVLGRITIGKGSTIGGNVWLTRSVPAESNITQANLQLDCQDKN

SEQ ID NO: 19450 - protein, 653 aa, Pseudomonas putida KT2440
MNPPVFYFAASFILIFGLVVISNPQAAGDWLLAAQNWAANTVGWYYMLAMTLYLVFVVVTALSGYGKIKLGADHDEPEFSYLSWAGMLFAAGISITLFFFCVSEPLTHMLQPPQGEAGTVEAGRQAMQILFLHWGLHGWGVFAFVGMALAYFAYRHNLPLALRSALYPLIGKRINGPIGYAVDGFGIIATVFGLGADMGFGVLHLNAGLDYLFGISHSQWVQVILITLMMGAAVAVAVAGVEKGVRVMSDINLFLACALLLFVLFAGPTQHLFNTLIQNLGDYLGALPRKSFDVYAYGENRGWLGGWTVFYWAWWIAWAPFVGLFIARISRGRTIREFVFGVLLIPLGFTLAWMSIFGNSALDQVINHGMTALGQSALDNPSMSLYLLLETYPWSKAVIATTVFISFVFFVTSADSGTVVLSTLSAKGGDADEDGPNWLRIFWGAMTALITSALLFAGSIDSLKSAVVLTSLPFSLILLCMMWGLHKAFYLESQRQIAQMHSLAPFAQSRRGRGGWRQRLSQAVHFPSRDEVYRFMDDVVRPAIADVREVFEQKGLVLITQDDPSHDNVSLKIGHGEEQPFIYQVQMRGYFTPSFALGGLGTQELKNRRYYRAEVHLSEGSQNYDLVGYSKEQIINDILDQYERHMQYLHLVR

SEQ ID NO: 19451 - protein, 616 aa, Pseudomonas putida KT2440
MSGKAQQQSRIKELITRGREQGYLTYAEVNDHLPEDISDPEQVEDIIRMINDMGINVFESAPDADALLLAEADTDEAAAEEAAAALAAVETDIGRTTDPVRMYMREMGTVELLTREGEIEIAKRIEEGIREVMGAIAHFPGTVDYILGEYDRVTTEGGRLSDVLSGYIDPDDNIAAPTEEVPIPGAKAAAAKEESDDDEEESESGDDEEEAESGPDPVVAAQRFGAVSDQLQATSKVLKKNGRNHKESIEALQALADLFMPIKLVPKQFEVLVERVRDALNRLRQQERAIMQLCVRDARMPRADFLRMFPSNETDQTWSGDLAKRNTKWAAALGEKNAAIVACQQKLIDLETETGLTVAEIKEINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELGERMEMPEDKIRKVLKIAKEPISMETPIGDDEDSHLGDFIEDSTMQSPIDVATVESLKEATRDVLSGLTAREAKVLRMRFGIDMNTDHTLEEVGKQFDVTRERIRQIEAKALRKLRHPTRSEHLRSFLDE

SEQ ID NO: 19452 - protein, 655 aa, Pseudomonas putida KT2440
MVEWALFPQWGKLPRLHTPITTRLMPTTFQEIPRERPVTPLLDRADTPAGLRRLAEADLETLADELRQELLYTVGQTGGHFGAGLGVIELTIALHYVFDTPDDRLVWDVGHQAYPHKILTGRRNRMLSLRQKDGIAAFPRRSESEYDTFGVGHSSTSISAALGMAIAARLQNSARKSIAVIGDGALTAGMAFEALNHAQEVNADMLVILNDNDMSISRNVGGLSNYLAKILSSRTYASMREGSKKVLSRLPGAWEIARRTEEYAKGMLVPGTLFEELGWNYIGPIDGHDLPTMIATLRNMRDLKGPQFLHVVTKKGKGFAPAEIDPIGYHAITKLEPADKPAAPKKASGPKYSAVFGQWLCDMAAADNRLVGITPAMKEGSDLVDFSERYPERYFDVAIAEQHAVTLAAGMACEGSKPVVAIYSTFLQRAYDQLIHDVAVQNLDVLFAIDRAGLVGEDGPTHAGSYDLSYLRCIPGMLVMTPSDENELRKMLSTGHLYNGPAAVRYPRGTGPNAPISGDLQPLEIGKGVVRRQGEKVALLVFGVQLAEAMQVAEQINATVVDMRFVKPLDEALVLELAGSHELLVTIEENAIMGGAGAAVGEFLASQAVLKPLLHLGLPDIYVEHAKPAQMLAECGLDAAGIEASVKARMARLGL

SEQ ID NO: 19453 - protein, 311 aa, Pseudomonas putida KT2440
MNFTHKNLQRSYMAERTMVILDGGMGRELQRSGAPFRQPEWSALALSEAPEAVVGVHAAFIDAGAQVITSNSYAVVPFHIGEERFAAEGRQLAHIAGQLARHAADSGAHPVRVAGSLPPLFGSYRPDLFQPERVAEVLTPLLQGLAPHVDLWLAETQSSVAEVRAIHSHLPADGRPFWVSFTLQDEEVDEVPRLRSGEPVAEAIEAAVGLGVAAVLFNCSQPEVIGAAIDVARSVIERHNAEIAIGAYANAFPPQPKEATANDGLDELREDLDPPGYLAWAKDWRARGASMVGGCCGIGPEHIAELKRNLA

SEQ ID NO: 19454 - protein, 476 aa, Pseudomonas putida KT2440
MTTSHYIAGHWVEGQGSDCISVNDPALGQPFAELMAASVSQVDQAVAAARSALPAWKSTCASERAAFLRGFAEQLGQRREALVTVQMRNNGKPRHEAEIDLDDAIATFGYYAELAEQLPSKNRTVPLAAPGFTARTRLEPVGVVGLIVPWNFPLVTSAWKLAPALAAGCTVVLKPSEVTPLIEQAYGQIADALGLPAGVLNIVNGKAETGAALSNHNGLDKLSFTGSNSVGSQVMRSASAQCRPVTLELGGKSAIVVFDDCDVDQAVEWIVAGISWNAGQMCSATSRLLVQDGIADALLPRLQAALENLRVGNPLTEEVDMGPLTSQAQWLKVASYFATAREEGLQCLAGGHALDREGWFVSPTLYTDVPKDSRLWTEEIFGPVLCARRFATEEQAIAEANDSRFGLVATVCSADLERAERVADALEVGHVWINSVQAVFVETSWGGTKGSGIGRELGPWGLSAYQSIKHVTRCLG

SEQ ID NO: 19455 - protein, 950 aa, Pseudomonas putida KT2440
MLELANEQIAMGQKAADKAEALRLLADRLVADGLVAEGYLQGLQAREAQGSTFLGQGIAIPHGTPQTRDLVYATGVRLLQFPEGVDWGDGQMVYLAIGIAARSDEHLRLLQLLTRALGETDLAEALRRASSAEALLKLLQGAPQALALDAQLVGLNVPAEDFDELAWRGARLLQRADCVDSGFAAVLQQAEPLPLGEGLWWLHSERQVRQPGLAFITPQQPLRYRDQPLNGLFCLASLGAAHEALLERLCEVLIEGRGQVLYQATSSRAVLEVLGGEVPADWPSARVVLANPHGLHARPAKVLAQLAKGFEGEIRVRLVDSAQPAVSVKSLSKLLSLGARRGQALELVAEPSIAADALPVLLAAIEQGLGEEVEPLPQSVAPIADDVPEVLQAPAAGSRIQGVGAAPGIASGPAHVCVEREFDYPLRGESCALERQKLREALATVNGELQALVLRSDKAIGEIFVTHQEMLADPALTDDVEQRLAQGESAAAAWMAVIEAAARQQEALHDALLAERAADLRDIGRRVLAQLCGVQAQVEPEQPYVLVMTEVGPSDVARLDPNRVAGIVTAQGGATAHSAIVARALGIPAVVGAGASILLLESGTPLLLDGQRGVVSVAPPADELQRALAERDLREQRLQAAWANRFEPAITRDGHAVEVFANIGDSNGIAKVVEQGAEGVGLLRTELIFMAHPQAPDVATQEAEYRRVLDGLDGRPLVVRTLDVGGDKPLPYWPIAAEENPFLGVRGVRLTLQRPQVMEDQLRALLRAADQRPLRIMFPMVGQVHEWREARAMVERLRAEIPVADLQLGIMVEVPSAALLAAQLAREVDFFSIGTNDLTQYTLAIDRGHPSLSAQADGLHPAVLSLIDMTVRAAHAHGKWVGVCGELAADPQAVAVLLGLDVDELSVSARSIAEVKALVRQADHQTARALAREALQQDSAAAVRALVERY

SEQ ID NO: 19456 - protein, 392 aa, Pseudomonas putida KT2440
MLNAEQRAIIKATVPLLESGGEALTTHFYKMMLSEYPEVRPLFNQAHQASGDQPRALANGVLMYARHIDQLEQLGGLVGQIINKHVALQILPEHYPIVGSCLLRAIEEVLGKDIATPAVIDAWGAAYGQLADILIGAEENLYKEKEEAEGGWRGTREFRLVRREQESSEIVSFYFAPVDGMPVLKAEPGQYIGLKLDIDGAEQRRNYSLSALCDGKEYRISVKREAGGKVSNYLHDELKVGDTLQLFPPAGDFTLAASDKPLVLISGGVGITPTLAMLQAALQTRREVHFIHCARNGAVHAFRDWIDGLAARHPQLKRFYCYAEPEGGAAADAVGLLSEDLLAEWLPQERDVDAYFLGPKGFMAAVKRQLKGLGVPEQQSRYEFFGPAAALE

SEQ ID NO: 19457 - protein, 261 aa, Pseudomonas putida KT2440
MFERLREDIQSVFHRDPAARNAFEVLTCYPGMHAIWLHRLGNALWRRDFKWLARLVSNFGRWLTGIEIHPGATIGRRFFIDHGMGIVIGETAEIGDDVTLYQGVTLGGTSWNKGKRHPTLENGVVVGAGAKVLGPFTVGAGAKIGSNAVVTKAVPAGATAVGIPGRIIVKSEDTEVEAKRKAMAEKIGFDAYGVSGDMPDPVARAIGQMLDHLQAVDERLEGMCGALTKMGSDYCAKELPALPEDDFSEAAQVAQRDTQPH

SEQ ID NO: 19458 - protein, 371 aa, Pseudomonas putida KT2440
MKAFADKQETPFVLIDTQMISQAYDDLRAGFEFAKVYYAVKANPAVEIIDLLKEKGSSFDIASIYELDKVMGRGVSADRISYGNTIKKSKDIRYFYEKGVRLYATDSEADLRNIAKAAPGSKVYVRILTEGSTTADWPLSRKFGCQTDMAMDLLILARDLGLVPYGISFHVGSQQRDISVWDAAIAKVKVIFERLKEEDGIELKLINMGGGFPANYITRTNSLETYAEEIIRFLKEDFGDELPEIILEPGRSLIANAGILVSEVVLVARKSRTAVERWIYTDVGKFSGLIETMDEAIKFPIWTEKKGEAEEVVIAGPTCDSADIMYENYKYGLPLNLAIGDRLYWLSTGAYTTSYSAVEFNGFPPLKAYYL

SEQ ID NO: 19459 - protein, 489 aa, Pseudomonas putida KT2440
MLRISQEALTFDDILLVPGYSEVLPNEVSLKTRLTRGIELNIPLVSAAMDTVTEARLAIAMAQEGGIGIIHKNMTIEQQAGEVRKVKKFEAGVVKDPITIDADATVRDLFELTRLNNISGVPVLANGDLVGIVTSRDVRFENRLDAKVRDVMTPKERLVTVREGADKNEVRELLHKHRLEKVLIVDDKFNLKGMMTVKDIEKAKAYPLASKDDQGRLRVGAAVGTGKDTGERVAALVAAGVDVVVVDTAHGHSKGVIDRVRWVKETYPQVQVIGGNIATGAAAKALAEAGADAVKVGIGPGSICTTRIVAGVGVPQISAIANVAAALEGTGVPLIADGGIRFSGDLSKAIVAGASCVMMGSMFAGTEEAPGEVELFQGRSYKAYRGMGSLGAMAQAQGSSDRYFQDSSAGAEKLVPEGIEGRVPYKGALAAIIHQLMGGLRSSMGYTGSATIEEMRTKPEFVRITGAGMAESHVHDVQITKEAPNYRVG

SEQ ID NO: 19460 - protein, 468 aa, Pseudomonas putida KT2440
MRRNEVPAPMSFTRRQMLKGLTGLVVVGLGAGGAARYWLGKVEDENAGHDYELIAAPLEVELVPGFKTEAWAFGPSAPGTELRVRQGTWLRVRFINHLPVETTIHWHGIRLPLEMDGVPYVSQLPVKPGEYFDYKFRVPDAGSYWYHPHVSSSEELGRGLVGPLIVEEREPTGFQHERTLSLKNWHVDEQGAWLPFSIPREAARNGTAGRLITINGQADSITELPAGQVVRVRLLNLDNTWTYRLNLKGNCEARIYALDGNPVTPRALDEYWLGPGMRICLAIRIPEAGEEISLRDGFVRLGTLRSVASNDAPSDWPPALPPNPIAEPDLENAEKLNFNFEWAASVSVTPDPAKPSSMWQINGQAWDITDKTCADRPIATLQKGKSYIFELKNMTQYQHPIHLHGMSFKVIASNRHDIKEPWFTDTYLLGKNERAQVALVADNPGTWMFHCHVIDHMETGLMAAIAVV

SEQ ID NO: 19461 - protein, 364 aa, Pseudomonas putida KT2440
MSAVTRAAVEGVLRQYTDPYLNQDPVSAGCVRAIDIQGGQVSVQLQLGYAAGLFKNGWAQVLQAAIGSLEGVTGAQVSIDCVVAAHKAQAQVPSMANVKNIIAVASGKGGVGKSTTAANLALALAREGARVGILDADIYGPSQGVMFGIAEGTRPQIREQKWFVPIKAHGVEVMSMAFLTDDNTPMVWRGPMVSGALLQLVTQTAWDDLDYLVIDMPPGTGDIQLTLAQKVPVVGSVIVTTPQDLALLDAKKGVEMFRKVNIPVLGVVENMAVHICSNCGHAEHLFGEGGGEKLASQYGVDLLASLPLSMLIREQADSGKPTAIAEPESQIAMVYQELARQVGARIVLQEAAAPAMPSITISED

SEQ ID NO: 19462 - protein, 183 aa, Pseudomonas putida KT2440
MTEQAHADLQAFAMKDPAAGRDLVFIAKTYTSYSAVLHYRLAHWIYNNSAATYGAGGQCLAAMISRRGKMLSGAEIHFRSRIGARFIIDHGMGTVIGETSTIGDDCYVLGGVTLGARGISDNPSSPRHPTLGNRVQIGAFASVLGAIHVGDGAFIGPGCIVTKDVPAAARVQVKTSLQVVLES

SEQ ID NO: 19463 - protein, 209 aa, Pseudomonas putida KT2440
MSNPIKLYNFPKSGHAHRIELMLSLLNLPTELVFVDLAKGAHKQPDFLALNPFGQVPVIDDNGTVIADSNAILVYLAKKYDNGTWLPEEPAAAARVQRWLSVAAGPLAFGPAAARLVTVFGASFNTDEVISRAHTLLKVIDAELANTPFLTGSTPTIADIANYSYIAHAPEGNVSLEPYANVRNWLARIEALPRFVPMPRTVIGLQTHA

SEQ ID NO: 19464 - protein, 566 aa, Pseudomonas putida KT2440
MAMFRLAIVSGSQRKLSRMQSAYTVLILLTLVSLSKLVGRVIPLPLPLVQIAAGALLAWPTLGLHVALDPELFLFLFLPPLLFADGWRIPKRELWRIRGPVVALAVGLVLFTVVGAGYFIHWLLPSIPLPVAFALAAVLSPTDAVAVSAIAQDRLPTPLMHMLQGEALMNDASGLVTFKFALAAAITGVFSLADASFSFVLVALGGLAVGVVLSWLIGRLRMWMITRGWDDPATHVVFMLLLPFAAYVLAERLGVSGILSAVAAGMMQSWLDLLPRQTSTRLLNRSVWSLLEFAFNGLIFLLLGLQLPDIIKAVVSHEATLWPTLAYRCLDVVAIFAALIMLRFIWVQSIWRSIGVVRRWRGKPALVLMPTARSCWLLTLGGVRGAVTLAGVMSIPLLIGAGTAFPERDLLIFIAAGVILLSLISACIALPILLRGVTKSPDERLHQEVQEAWRRTAEAAIHALEAEEVIDSNAPQDAAQATLATELKARLMAEYRDELESYDDSAEAKALAAQMDLLERRLRLRALRAQRLELYNLHRQHLVGDEVVRQVLGELDMSEANLGSVK

SEQ ID NO: 19465 - protein, 404 aa, Pseudomonas putida KT2440
MGCRMGCDVSRPQRITVLGATGSIGLSTLDVIARHPDRYQAFALTGYSRIDELLALCVRHRPAFAVVPSTEAAVRLRASLAAAGCTTEVLEGEAGLCQVASAAEVDAVMAAIVGAAGLRPTLAAVEAGKKVLLANKEALVMSGALFMEAVRQKGAVLLPIDSEHNAIFQCMPGDYARGLSAVGVRRILLTASGGPFRETPVEALLDVTPEQACAHPNWSMGRKISVDSASMMNKGLELIEACWLFDAVPSKVEVVVHPQSVIHSLVDYVDGSVLAQLGNPDMRTPIANALAWPERIDSGVAPLDLFAIARLDFQAPDEQRFPCLRLARQAAEAGNSAPAVLNAANEVAVQAFLERRIRFPEIAGMIEQVLDQEPVVPLPSLDAVFAADQRARELSREWLRRHGR

SEQ ID NO: 19466 - protein, 429 aa, Pseudomonas putida KT2440
MAKIVDIKGREVLDSRGNPTVEADVLLDNGIIGSACAPSGASTGSREALELRDGDKSRYLGKGVLKAVANINGPIRDLLLGKDPSDQKALDRAMIELDGTENKAKLGANAILAVSLAAAKAAAQDQDLPLYAHIANLNGTPGQYSMPVPMMNIINGGEHADNNVDIQEFMVQPVGAKTFSDGLRMGTEIFHHLKAVLKARGLNTAVGDEGGFAPNLASNEDALGAIAEAVEKAGYKLGTDVTLALDCAASEFYEDGKYNLSGEGKSFDAEGFADYLKGLTERFPIISIEDGLDESDWAGWKILTDKIGEKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAVYRGRAEFRG

SEQ ID NO: 19467 - protein, 371 aa, Pseudomonas putida KT2440
MMIKSRAAVAFEAKKPLEIVEVDVAMPKAGEVLLRVVASGVCHTDAYTLSGADPEGIFPSILGHEGGAIVEAVGEGVTSLAVGDHVIPLYTPECGKCKFCLSGKTNLCQAIRATQGKGLMPDGTTRFSYKGQQLFHYMGTSTFSEYTVLPEISVAKIQKEAPLEKVCLLGCGVTTGIGAVLNTAKVKPGDTVAIFGLGGIGLSAVIGAVKAKASRIIAIDINPAKFEIARQLGATDCVNPKDYDRPIQEVIVDLTDGGVDFSFECIGNVQLMRAALECCHKGWGESVIIGVAGAGQEISTRPFQLVTGRVWRGSAFGGVRGRSELPSYVEMSEKGEIPLDTFITHTMGLEDINKAFDLMHEGKSIRSVIHF

SEQ ID NO: 19468 - protein, 335 aa, Pseudomonas putida KT2440
MALSKEVPEFDIDDDVLLMETGIVLETDVVSDEPAVSSVRTRAKSGSSLKQHKYIDYSRALDATQLYLNEIGFSPLLSPEEEVHFARLSQKGDPAGRKRMIESNLRLVVKIARRYVNRGLSLLDLIEEGNLGLIRAVEKFDPERGFRFSTYATWWIRQTIERAIMNQTRTIRLPIHVVKELNVYLRAARELTQKLDHEPSPEEIATLLEKPVAEVKRMLGLNERVSSVDVSLGPDSDKTLLDTLTDDRPTDPCELLQDDDLSQSIDQWLGELTDKQREVVVRRFGLRGHESSTLEDVGLEIGLTRERVRQIQVEGLKRLREILEKNGLSSESLFQ

SEQ ID NO: 19469 - protein, 917 aa, Pseudomonas putida KT2440
MLDRLGIRSRVLLLALLPAGLMALVLGSYFTWLQQNDLRTQLLQRGKMIAEQLAPLAAPAMARLAPAQLERIAAQTLEQADVRAVAFLAPDRTRLAHAGPSMLNLPPSGGTGTQLLQRSGNDATRYLMPVFGHHRDLATDAVPAEAERLLGWVEIELSHDGTLLRGYRNLFTSLLLILACLALSGLLALRMSRTINDPIERIKHAVNQLKDGHLEERLPTMGSHELDELAHGINRMAETLQNAHEELQHSIDQATEDVRQNLETIEIQNIELDMARKEALEASRIKSEFLANMSHEIRTPLNGILGFTHLLQKSEMTPRQLDYLNTIEKSADNLLGIINEILDFSKIEAGKLVLDSIPFNLRDLIQDTLTILAPAAHAKQLELLSLIYRDTPASLVGDPLRLKQILTNLVSNAIKFTREGTIVVRAMLEDEHEDCAQLRISVQDTGIGLSPQDVRTLFQAFSQADNSLARQPGGTGLGLVISKRLIEQMGGEIGVDSTPGEGSQFWISLNLPKAHDDAEALPPQPLLGRRAAIVDGHELARQALEHQLEDCGLSVSLFASYDQLLQGVQAASQAGLPFEFAVLGANLGNLSPEQLGHYHQQLERYHCQCVVLCPTTEQALYHPYLPNGHGQLLSKPTCTRKLRRLLLELVQPRRPLAEGSNPNGQRRPKILCVDDNAANLLLVKTLLEDLGAEVLAVNNGYAAVQAVQEELFDLVLMDVQMPGMDGRACTEQIRLWENTQSGNPLPIVALTAHAMANEKRALLHSGMDDYLTKPISERQLAQVVMKWTGLSLGTPQQAQAELLTNGDELKVLDPEEGLRLAAGKADLAADMLSMLLASLDTDREAIRAARAADDRNGLIEQVHRLNGASRYCGVPQLRAACQRSETLLKQDNPQAQQALDELDSAISRLAAQARLSA

SEQ ID NO: 19470 - protein, 404 aa, Pseudomonas putida KT2440
MAVCCCAAGAAACRWLFLGALRSGYSRGLQVGQGTMIKVLHFFKTYYPDSMGGIEQVIFQIAEGTREHGVQSEVLYLSPRGAARNEPVGSHLTHRSKLDLHVASTGFSLSVIKDFAELAAQADIVHYHFPWPYMDLVHFLGRLNKPTVVSYHSDIIKQKWLLKLYQPLMSRFLSNVDRIVVSSPNYAAHSQVLTRFKDKLAIIPFGLDRATYPSATVEKLAYWRARMSERFFLFVGALRYYKGLDYLLQAASINRLPVVIIGGGFLEAQLKQQAAELRLDNVQFLGSLADDDRAALLELCYAFVFPSHLRSESFGISLLEAAMYGKPLICCEMGSGTTFINLADQTGLVVPPRDAAALAQAMQRLWDDPAMAQAMGAKALQRYEEVFTASAMAGAYADLYRSLL

SEQ ID NO: 19471 - protein, 253 aa, Pseudomonas putida KT2440
MSMTFSGQVALVTGAGAGIGRATALAFAHEGMKVVVADLDPVGGEATVAQIHAAGGEALFIACDVTRDAEVRQLHERLMAAYGRLDYAFNNAGIEIEQHRLAEGSEAEFDAIMGVNVKGVWLCMKYQLPLLLAQGGGAIVNTASVAGLGAAPKMSIYSASKHAVIGLTKSAAIEYAKKGIRVNAVCPAVIDTDMFRRAYQADPRKAEFAAAMHPVGRIGKVEEIASAVLYLCSDGAAFTTGHCLTVDGGATAI

SEQ ID NO: 19472 - protein, 249 aa, Pseudomonas putida KT2440
MSKQLTLEGKVALVQGGSRGIGAAIVRRLAREGAQVAFTYVSSAGPAEELAREITENGGKALALRADSADAAAVQLAVDDTEKALGRLDILVNNAGVLAVAPVTEFDLADFDHMLAVNVRSVFVASQAAARYMGQGGRIINIGSTNAERMPFAGGAPYAMSKSALVGLTRGMARDLGPQGITVNNVQPGPVDTDMNPASGEFAESLIPLMAIGRYGEPEEIASFVAYLAGPEAGYITGASLTVDGGFAA

SEQ ID NO: 19473 - protein, 785 aa, Pseudomonas putida KT2440
MLAQRKERETGSGLMDIKFTNRLSYKQARLTVLVGFILGTLLSLIQIGIDYASEDASINREVNALLQISHNPASRIAYNIDSELALELTRGLLQSPAVIRARLIDNNETVLADVERPKLQDRYRPLSDFLFGEQRQFKERLYLTHMPEQYLGTLYLDIDTFAFGSRFLDRAGITLLNGFARSLVLTGLLLALFYMMLTKPLVTVIGALSGSDPRKPRQTRLECPHGHEHDEIGVLVKVANQQFVSMATEIEQRRTAENRLTQYLNELEDIVSARTNELKASNSSLSLSNQELEQARSRALDMAQARAAFLANMSHEIRTPLNGMLGMIALALDNPLPSEQRQQLAIAHDSGKVLVELLNDILDLSKFDAGQLELERIAFDMGSMVEDTANLLSQNTAQSVELTCLIASDFPSSVLGDPTRVRQIVSNLLSNALKFTRFGRVDVRLAAIVGGVRLEVRDTGIGIPEDAQARIFQPFTQAGAGITRQYGGTGLGLALTRNLCKAMQGHLHIRSEPGFGSCFTAELPLTVHTEAIPPAPLHGRVAALSAAGSGLNELLQHLLPAWGLTYQRHDSCATLVAAVIDLLITDDVEHLFELRPALKTPILLVTAYGNFLPNEQSLALAPLHQLARPLARNALYQTLRRTLQGHEPEHPLAIPAITQEQGRARILLVEDNPVNQLVAKGMLAKLGCQVQLATQGAEALELLAREEFDLVLMDCNMPVMDGYEASRRIRQSGRWPELPIVALTANAMPEERERCRAAGMNDYLAKPFRREELLALVDHWVPFSG

SEQ ID NO: 19474 - protein, 207 aa, Pseudomonas putida KT2440
MLKIWGRKNSSNVRKALWIAHELGLDFESIDAGGAFGVVNEPHYRARNPNGLVPMLEDGDLTLWESNTIVRYLCAEYGTEQGWYLADPRQRALADKWMDWTTSSFATPFRPLFWGLLRTPEDQRDWVAINAAHKQCAQLLAIADETLASQPYLSGDQIGMGDIPLGSFIYAWFELPIERPDMYHLQAWYERLKQRPAYQAAVMTALT

SEQ ID NO: 19475 - protein, 224 aa, Pseudomonas putida KT2440
MKKGYELLIFDWDGTLADSIGRIVEAMNVAAERAGEAQSSDAAVKGIIGLALDEAIHTLYPHLAPAEVASFRQHYADVYVALDQQPSPLFDGVVESLDAFRAEGYRLAVATGKARRGLDRVLKANGWERFFDITRAADETRGKPHPLMLEEILGHCGVEPSRALMVGDSAFDLQMASNAGMHSVAVGYGAMSLQALAEFGPQVCIDHFSQLREWLGGSAIPLPR

SEQ ID NO: 19476 - protein, 246 aa, Pseudomonas putida KT2440
MSLQGKVALVTGASRGIGQAIALELGRQGATVIGTATSASGAERIAATLKEHGITGTGMELNVTSAESVEAVLAAIGEQFGAPAILVNNAGITRDNLMLRMKDDEWFDVIDTNLNSLYRLSKGVLRGMTKARWGRIISIGSVVGAMGNAGQANYAAAKAGLEGFSRALAREVGSRGITVNSVTPGFIDTDMTRELPEAQREALQTQIPLGRLGQADEIAKVVSFLASDGAAYVTGATVPVNGGMYM

SEQ ID NO: 19477 - protein, 275 aa, Pseudomonas putida KT2440
MKLDTVFSVEGARVIVTGAASGLGLAFTEAMAESGAQVAMLDLNREALDAQFRRLRSLGYSVRSHVLDVTDRDAVDDTFNAVAAGFGGLDIVFANAGIDPGPGFAALNAAGEREPANMLEEYSDHRWRKVISVSLDAVFYSIRAAARHMRANRSGSIIVTTSVSALRPAVTLGAAYAAAKAGAAQLVRATALELASDGVRVNAIAPGPFETDIGGGFMHNSEVRAKMAAGVPMGRIAEVEEIKPLALYLASKASSFVTGQQFVIDGGLSLSAARA

SEQ ID NO: 19478 - protein, 269 aa, Pseudomonas putida KT2440
MSFQNKIVVLTGAASGIGKATAQLLVEQGAHVVAMDLKSDLLQQAFGSEEHVLCIPTDVSDSEAVRAAFQAVDAKFGRVDVIINAAGINAPTREANQKMVDANVAALDAMKSGRAPTFDFLADTSDQDFRRVMEVNLFSQFYCIREGVPLMRRAGGGSIVNISSVAALLGVAMPLYYPASKAAVLGLTRAAAAELAPYNIRVNAIAPGSVDTPLMHEQPPEVVQFLVSMQPIKRLAQPEELAQSILFLAGEHSSFITGQTLSPNGGMHM

SEQ ID NO: 19479 - protein, 707 aa, Pseudomonas putida KT2440
MLFFHGKQIFSAIFDMDGTLFDTERLRFRTLKQASLEIFGKALSEQTLIGSLGLSAKKAEALAKAHNGEDFPYAQIRQRADELELEYVRNHGVPIKAGLLEVLERLRKSGLTMAVATSSRRAIAEEYLINANVLKYFDITVCGDEVGQGKPHPEIFLKAARALNCEPGQCFMVEDSENGMLSAMRAEGQAILIEDIKPPAPEIKAGALKAYRSMHEFLADLSECVPDLGMPALSEPFPASMNQFSVGIHGFGAIGGGYLTQVFSHWDGYTRPREIIAATRSRMLRESVSAFGRYSVRYGATSFDQTIDNVRMIDMDDDDAVISMYTTAEIIGLSLPEQAIRSQARVIAQGLLQRFERRGRELTLLIVLNKVGGAAFVRRHVQAELSLLCPPAISEQVLQKTHFAETVVSRIVSKLGNDALVRQLRIKSQMFQNSLEDEPASTRKSSTPLPEYERLIGHFRPFAQPSSAMSQLHLVLFNSEADMPLYAERGSDLLERLRQVKTVPDIAQIQIIKNRLWNGPHAIVAWYASLLGHAWVGQGMGDARVSELAERLIRQEVAPALVAEYPQMAEVVSRFAEAFLERCKTSFKDPCARVGRDPLRKLQRNERILSSIDLARKHGIATPALAFGAGLAIHHALNCSNSKDLESQAIRQVYLDNQESVEAVLTHANKPFPGLCPVKDAELIAAIREGFRQLPQPAPRHAVAVGS

SEQ ID NO: 19480 - protein, 410 aa, Pseudomonas putida KT2440
MTAPFTLLAEAVRQHGSPLWAYDTRTIADRVEQLNVFDTVRFAQKANPNLHVLRLMRAHGLVLDAVSLGEMERAFAAGASVDGDPAGVVLTCDALDRPTLERVVASKIEVNAGSIDMLHQLGERSPGHRVWIRINPGFGHGHSRKTNTGGENSKHGIWHEELDEALACIKAHGLHLVGVHMHIGSGVDYQHLEQVARSMIELIGRLGVDIEAFSIGGGLSTPYRSTDKPVDLQRYAQTWAVARKEIEAMLGHPVRMEIEPGRFLVAESGYLVAEVRAVKQVGRNTFVIIDAGFNDLMRPAMYGAYHGMTLLDADGQAVDRPRQPTVVAGPLCESGDVFTQDDQALTPQDLPQAQVGDLLVIHDAGAYGASMSSNYNSRPLLPEFLIENGALRMIRRRQTVQDLLSLEADF

SEQ ID NO: 19481 - protein, 791 aa, Pseudomonas putida KT2440
MVEYVVSLDKLGVHDVEHVGGKNASLGEMISNLAGAGVSVPGGFATTAQAYRDFLEQSGLNDRIHAALDALDVDDINALTKTGAQIRQWVMEAEFPPRLDSEIRTAFAEMAAGNDNMAVAVRSSATAEDLPDASFAGQQETFLNIRGVDNVIRAAKEVFASLFNDRAIAYRVHQGFDHKLVALSAGVQRMVRSETGTAGVMFTLDTESGFRDVVFITGAYGLGETVVQGAVNPDEFYVHKNTLQAGRPAILRRNLGSKAIKMIYGDEAKAGRSVKTVEVDRAERARFCLTDAEVSELAKQAMIIEQHYQRPMDIEWAKDGDDGKLYIVQARPETVKSRSSANVMERYLLKEKGTVLVEGRAIGQRIGAGKVRVINDVSEMDKVQPGDVLVSDMTDPDWEPVMKRASAIVTNRGGRTCHAAIIARELGIPAVVGCGNATQVLKDGQGVTVSCAEGDTGFIFEGELGFDIKQNSVDAMPELPFKIMMNVGNPDRAFDFAQLPNAGVGLARLEFIINRMIGVHPKALLNYAGLPADLKDSVDKRIAGYNDPVGFYVEKLVEGISTLAAAFYPKKVIVRLSDFKSNEYANLIGGKLYEPEEENPMLGFRGASRYISESFRDCFELECRALKRVRNEMGLTNVEIMVPFVRTLGEASQVVDLLAENGLARGDNGLRVIMMCELPSNAILAEEFLEYFDGFSIGSNDLTQLTLGLDRDSGIIAHLFDERNPAVKKLLANAIAACNKAGKYIGICGQGPSDHPDLAKWLMEQGIESVSLNPDSVLETWFFLAEGQGAA

SEQ ID NO: 19482 - protein, 411 aa, Pseudomonas putida KT2440
MYYRVRCSMSASFWKSGHVPTLFAAFLYFDLSFMVWYLLGPLAVQIAADLQLSAQQRGLMVATPILAGAILRFAMGVLVDRLSPKTAGLIGQVVVIVALAAAWHLGVHSYEQALLLGVFLGFAGASFAVSLPLASQWYPPQHQGKAMGIAGAGNSGTVFAALLAPALAAGFGWNNVFGFALIPLSLALVVFALLARNAPQRPKPKAMADYLKALGDRDSWWFMFFYSVTFGGFIGLASALPGYFSDQYGLSPVTAGYYTAACVFAGSLMRPLGGALADRFGGIRTLLGMYGVAAICIAAVGFNLPSAAAALALFVSAMLGLGAGNGAVFQLVPQRFRQEIGVMTGLIGMAGGIGGFLLAAGLGTIKQHTGDYQLGLWLFASLGLLAWFGLHGVKQRWRTTWGSAAVTAARV

SEQ ID NO: 19483 - protein, 1211 aa, Pseudomonas putida KT2440
MVMARVINRLLLVLLLSGATQAGHREAASFTLLARSSARPVQPVLTPEQRQWREGRQELVLGTSAPDYPPFDITGGGNDYQGLTAEYANLIGKALQLPVRVLRFSSRQAAVEALRHGDIDLLGSANGYEAASDGLALSRPYAVDQPVLVTREDENRALDTDLAGMRLGMLYHYLPRQEVLTAYPKAELLAFGSSSQALNAVAFGQADVFIGDTISTHYQLNRGHLPRLRMANFGKHEAIGFGFALRQQDTVLLDLVNTILDRQSPAIRSSIFKRWSAGSDLLLSDRQLQLSAAEQQWLEKHPVMRVAADDAAAPLSYFDDSGHFRGITADLLELIRLRTGLRFEVQRASGIADMVARLKDGRADVIAALASAGKAGDDLQISRPYLESAYVLVNHKDNNALSSLEQLQGHRIAITRYSTMNAMLSRDYPKISWVETESAFYSMALLNSGAVDAVITTLIDANHALASNPELVIRTSVGSEPANFAMATIAPSPALLSILDKALLSISPEELGVINNRWRGFGRHEDDNSKGYSRLALQVVLATAVLLLLALLWNARLRLQIRQRQRAERALNDQLAFMRALLNGTPHPMYVRDREGCLKSCNYSYLEAVQARSDQVIGKKLKDSLFADSEQARQIQADYQKVMAAGSPLIKDRPLRIKGRDLTIYHWILPYRDSLGEVQGIIGGWIDISERRQLVLELRQAKQQADDANRAKSTFLATISHEIRTPMNAVIGMLELAVKRADQGRVDRSALELAHHSAKDLLGLIGDILDIVRIESGHLSLAPEVVDLAALVESVARIFDGQARQKGLALEVQIAPAARCHVLLDPLRFKQVLSNLVSNAIKFTEHGQVRISVRLLDDGTSTPAVLELEVRDSGIGIHPDDLQRLFNPFIQANPHSQGARAGTGLGLAICRNLCEMMGGSLSMKSLEDVGTQVRLKMPLQRVDGAEQPKPLPEQLDVPDPRLNVLVIDDHPANLQLMAQQLGYLGLEHASARDGQEGLATWREGDFDVLVLDCNMPHMNGYQLATAVRAEERHGKRPPCTILGYTANAQPEVRRKCLTAGMDDCLLKPISLSTLSQRLAGIRPRRQQRPRRKLYQLDGLAAVVGPDPVDRQRFLETLHQSLQADLASLMALHPQHDSGAIAEQAHKVLSAARMLEAPDLMAACEALEASDLPTAQVRLRRQALARHMCRVERALAKELATSTDTQAGNHTC

SEQ ID NO: 19484 - protein, 574 aa, Pseudomonas putida KT2440
MLRNPSRRTFVKGLGAASTLAGLGLWRPLVQAAEGRDLAGQHFELFIGQTPVNITGRPRTALTVNNSLPGPLLRWREGDTVTLRVRNRLAQDTSIHWHGIILPANMDGVPGLSFAGIEPGGDYLYQFTLRQSGTYWYHSHSGLQEQAGVYGAIVIEPREPETHRYQRDHVLLFSDWSDQAPEHLMATLKTQSDAYNFHKRTVGDFIDDVAENGWSATVAERTAWARMRMSPTDLADISAATYTYLLNGQPPQGNFTCLFQPGETVRLRLINASAMTYFDFRIPGLKLTVIAADGLPVTPVSVDELRIAVAETYDVLVTVGDQPAYTLFAQSMDRTGFARGTLARAAGLQAPVPAPDPRPVLSMEDMGHGGMDAMAGMDHRNPQGMNHGSMAGMDHAAMSAMQQHPISETDNPLVDMQTMAPRPNLADPGIGLRDNGRRVLTYADLRSPYPDPDGRPPSRDIELHLTGHMERFAWSFDGIKFSDAEPLRLTYGERVRITLVNDTMMTHPIHLHGMWSDLEDEHGQFLVRKHTVDIPPGSRRTYRVTADALGRWAYHCHLLYHMETGMLREVRVDE

SEQ ID NO: 19485 - protein, 267 aa, Pseudomonas putida KT2440
MSVPSFGLGTFRLTGQTVIDSVKSALAVGYRVIDTAQIYKNEAEVGQAIAESGVPRSELFITTKIWVDNYAADKLIPSLRDSLQKLRTDYVDLLLIHWPAPGNGVELPEYMKALADAKQQGLARQIGVSNFNIELTRQAIAVVGKGEIATNQIELSPYLQNSKLTAFLKEQGITVTSYMTLAYGKVLKDPVLAQIAAKHKATVAQVALAWALQLGYAVIPSSTKRENLASNLLARGLTLDTDDMARIAKLERNGREVSPDGLAPTWD

SEQ ID NO: 19486 - protein, 516 aa, Pseudomonas putida KT2440
MKNPTTLQADGQAMGLPMARDIDWPLFLISGGFLGAFLLAALIDIDTVSALVNTLFAWSTKAFGLYWQVLMLATFAVSLFIGFSRCGRVRLGGVTQRPDISTFNWIAVIMCALLAGGGAFWAAAEPLMHFASPPPFFAGLQPHSEAAATAALAQSFVHWGFLAWAVLGSLLAIVLMHLHYDKGLPLAPRTLLYPLFGKRALKGPIGTLADAASIIAVVAGTIGPIGFLGLQISSAMHAVWELPNTIVTQSLTIVLVTAMYTVSCLVGLKGIRFVSEINVWLMIGLALFMVVFGPTLFILGGFPAAFALHVEHFIPLTMFRADPKWLDWWTVFYWGWFIGYAPMVALYVARISRGRTIREIIMTLSIIAPLVTMFWFTVVGGTGIGLELQTPGSVTAHGAKPEDLLLGVTQNLPLGGLVSALFLFLSFISVATNGDAMAFTVALAMSSDDKPKKWLRGFWAIGMGLAAVVLITIGAGGVTALQSFIVITAVPVSLVILPALWDAVRIARHMAREQGV

SEQ ID NO: 19487 - protein, 151 aa, Pseudomonas putida KT2440
MSPMINAKLLQLMVEHSNDGIVVAEQEGNESILIYVNPAFERLTGYCADDILYQDCRFLQGEDHDQPGIAIIREAIREGRPCCQVLRNYRKDGSLFWNELSITPVHNEADQLTYYIGIQRDVTAQVFAEERVRELEAEVAELRRQQGQAKH

SEQ ID NO: 19488 - protein, 307 aa, Pseudomonas putida KT2440
MTRRAWTLLDGGMGRELKRIGAPFRQPEWSALALFEAPEYVTQVHRAFIAAGARVITTNSYAVVPFHIGEERFARSGRALAELSGRLARGAADEAGASVQVAGSLPPALGSYRPDLFDPARSQAIHRELICGLTPHVDFWLAETQSSLAEARAVHAALDGDGKPLWLSFTLLDPDTEHAVPLLRSGESVQQAVLLALELGASALLFNCSQPESMGAALRSARQVLKQEARELALGVYANAFPPVREDAQANDTLLDIRADLGPEAYLQWAQQWVEEGADIVGGCCGIGPEHIARLDEHLQACKQGME

SEQ ID NO: 19489 - protein, 255 aa, Pseudomonas putida KT2440
MQPNLARLFALDGRRALVTGASSGLGRHFAMTLAAAGAEVVVTARRQAPLQALVEAIEVAGGRAQAFALDVTSREDICRVLDAAGPLDVLVNNAGVSDSQPLLACDDQTWDHVLDTNLKGAWAVAQESARRMVVAGKGGSLINVTSILASRVAGAVGPYLAAKAGLAHLTRAMALELARHGIRVNALAPGYVMTDLNEAFLASEAGDKLRSRIPSRRFSVPSDLDGALLLLASDAGRAMSGAEIVVDGGHLCSSL

SEQ ID NO: 19490 - protein, 326 aa, Pseudomonas putida KT2440
MQPLVSTVLVPSQGIPLCCNEICLKSLQKEVAMPLKDLLIALVVIVAWGVNFVVIKVGLDGLPPMLLGALRFLLVAFPAILLVRRPKLPWRWLIAYGATISLGQFAFLFQAMYSGMPPGLASLILQSQAFFTLGFAALFLGERLRLASVLGLLVAAGGLALIGSEDGGHVPMLALVLTLCGGAMWGLGNIITRRFGSVDLVALVIWGGLIPPLPFLALSWWLEGPERIGHALANISWSSVLALAYLAFVATMLGYSLWSKLLSRHPAGKVAPFSLLVPVIGLSSSALLLGERLTATQGWGALLVMAGLLVNVFGARIGQRLRAANA

SEQ ID NO: 19491 - protein, 253 aa, Pseudomonas putida KT2440
MGEDPGRKAAEVAALQQGIELGLNLIDTAEMYAEGGAEEVVGQAIAGRRDRVFLVSKVYPHNASLRGMAAACERSLTRLGTDCIDLYLLHWRGQHPLEETVEGFERLREQGKIKRWGVSNFDVDDLRELHNPDCATNQVLYNPAQRGIEFDLLPWCGKRGLPTMAYCPLAQAGRLLQHPVLAEIAERHGATPAQVCLAWVTRDDGVIAIPKAVAPEHVRLNAAAGALTLTGEDLRAIDRAFPAPTRKQRLAMV

SEQ ID NO: 19492 - protein, 174 aa, Pseudomonas putida KT2440
MFDNIRADLRAHGGDWGAQGFWVLLVYRFGRWRYTLRPALLRKLCSLIYKVLFKFVQIITGIELPCEVVIGRNFVIDHFGGIVVSGYARFGDDCRIRNGVVVGLKNVDEPIAPVFGNNVDIGTGAKVLGSIRIGNNVIIGANAVVLVDVPDNSLAVGVPAIIKARHPAAVASVE

SEQ ID NO: 19493 - protein, 253 aa, Pseudomonas putida KT2440
MNNRFQGKVALVTGAAQGIGRGVCWRLKAEGAQVVAVDRSELVHELAGEGMLTLTADLEQHADCARVMASAVETHGRLDILVNNVGGTIWAKPFEHYEVEQIEAEVRRSLFPTLWCCHAALPYMLERGSGAIVNVSSIATRGVNRVPYGAAKGGVNALTACLAFETAGRGIRVNATAPGGTEAPPRRVPRNSAEQTEQEKRWYQQIVDQTLDSSLMHRYGSIDEQVGAILFLASDEASYITGVTLPVGGGDLG

SEQ ID NO: 19494 - protein, 341 aa, Pseudomonas putida KT2440
MLVTKQPVLRRFWYALLPMTALEDGPKPFTLLGEALVLWKRPDGTPVAMRDRCCHRTAKLSKGFVSAEGNIACGYHGWEYDCTGTCVKIPQSPTGAIPPGAAVKAYHCQEKYGYAWVSLDDPLQPIPEFPEDGAPGYRRIFQFYEEWKTSPLRVMENSFDNSHFSFVHKANFGLFDQPQPASYEFRETDYGFEAETRVPIRNPEASFRITGTTEPITQRHLLNRYYLPFSRRFGCMYPDSGIHHIIYNCATPIDDNRLMLVQWLYRNDSEEQCSTQELIDWDAAITAEDRDILEATDPDACVDTRRRVELHMPSDKPGLVIRRQLLGLLEAHGESEVFLSH

SEQ ID NO: 19495 - protein, 427 aa, Pseudomonas putida KT2440
MQAWRRRLDQGLNIQPGEGPAVIAGLLLFYLLFTGYFMLRPVRETMGVAGGVENLQWLFTGTFIATLACLPLFGWLASRVQRRHILPWTYGFFASNLLLFAALLAGNPDDLWTARAFYIWLSVFNLLTISLAWSVLADLFSTAQGKRLFGLLAAGASLGGLSGPVLGTLLVAPLGHAGLLVLAAVLLLGSIGATLFLQRWRARQPIAMQTEHQGSRPLGGNPFTGASAVLRSPYLLGIALFVVLLASVSTFLYFEQARIVSETFTDRTRQTQVFGLIDTVVQALAILTQVFLTGRLARRLGVGVLLVAVPLIMAAGFLWLALAPVFALFVVVMVVRRAGEYALVRPGREMLFTVLSAEDKYKAKNFIDTVVYRGGDALSGWVKRALDVMGEHPQLAMLIGALLAVGWGATGAWLGRRQARMDSPPHH

SEQ ID NO: 19496 - protein, 438 aa, Pseudomonas putida KT2440
MVALTGELARERNDSHINELLLYRRVAWRIMPLAIICFLFSYFDRINISFAKTQMQQELGLSDAAYGLAASMFFVGYVLFEVPSSLGLKRYGAPAWICRIMVSWGLATAALVFAYTQYTLYFLRFLIGVMEAGFGPAILFYLACWFPRKHLAKMNGLWFLAVPLAGAVGGPAAGFLLGTMDGVLGLAGWHWLFLMSGLPCVLLGLLVLWKLDRDIEAAKWLSREEKDLLAENLAQDKRTAKPILGSIWRVLLTREVAIMAFIYYVVKTASYGLNFWMPHLIKSSGVQDMLWVGVLSALPYAVACIGMVLLTRHSDRTGERKRYLVYCLLAAAVGYLLACLFSDSPFAMMTALVLATAGTFIAIPIFWTIPQSTFSGLAIATGTAAINSVGQLSGIVAPVMVGKINDLTDSTYMGMLSIAPLILVACLVVMRYVRNPKS

SEQ ID NO: 19497 - protein, 295 aa, Pseudomonas putida KT2440
MKTILGIHRSPHAHWVGDGFPVRSLFTYDNLASQISPFLLLDYAGPHDFTPTRARRGVGQHPHRGFETVTIVYQGELEHRDSTGAGGLIGPGDVQWMTAANGIIHEEFHSPDFARSGGTLEMVQLWVNLPARDKRAAAGYQTLLAGDIPVVALDGDAGSLRVIAGDYHGHQGPARTFTAMDVWDLRLNAGAALQLPVAAGRNAALVVLRGNVRINGEREAGPSSLVLLDREGVDVGVEALDGASVLLLSGEPIDEPIVGYGPFVMNSQAEIAESFDDFHAGRFGQMQDERGGAAH

SEQ ID NO: 19498 - protein, 1093 aa, Pseudomonas putida KT2440
MKQLLASVLLAIGLANSTELQASSEPRHLLARSISAAAPLTLSGDDRHWLKQRERLVMGSARPDYPPFEINVSQHDYEGLSADYAGIIGEQLDIPIEVRRFDSRHEAITALRDGRIDLLGSSNAFEAADAQLSLSTPYADDLPVIVTREGRSLKSTPELAGLRLAMVDHYLPAVSVRTLYPKAQLSLYRSTLAGLAAVALGEADAYLGDAISTDYMIGKSFQGTLKIDHFSQLAPEAFAFAIASDNPRLHRLVDKALSRISESERLNILRRWSSGNTSLLLQRHLTALSEEEESWITAHPTISVLVNTSLAPLTFNDAQHRPSGITLDLLKQISLRTGLQFTPVESASSQAMIDRLVRGEAQMIGALGYGADRLKQLRYTRPYLVSPRVLVTRNDGESPAQAKALDGKRIALVRGSPQQAVLQQRYPQAEIVEVDNPLGQMEAVANGVADAALSSHINAAYYISHVFKDRLRIANMLDDAPAIAAFAVAADQPQLQAILDKALLSIPPEELDQLINRWRTSTLVSDSPWRDYRTLALQVLVLSALLLAGVVFWNSYLRKLINQRTEAQHALQAQLALSRGLLEQLRQAKDDAEQASQTKSTFLATMSHEIRTPMNAVIGLLELALEDSRSGRSDAQTLQTAHDSAIGLLELIGDILDISRIESGHISLQPVPTNLVELVRATLRVFEGNARAKGLHLHGELPAEPVWVLADPLRLKQILSNLISNAIKFTDRGEVQACLLLPKVAGHGILAIELNVRDTGIGISPADQARLFSAFVQVDGPRARQGAGLGLVISRTLAELMGGALSLQSVEGVGTRVQVSLRLPVCEAPAQADPQLTTHESNSGPLNILVVDDYPANLLLLERQLQTLGHHVTLAENGEIALARWQEARFDLVITDCSMPVMDGHELTRRIRSLEGERGLPAGRILGVTANAQAEERTRCLASGMDECLFKPIGLRTLKTHLPQVRPQQPSPEPFHSGFDLAELRHLTQDDEQLTRHLLEQLSISVGEDLAALRALSTDAPDETVRALAHRIKGGAKMIRVRTVVKDCEAIEHAHAKGLPTVEQRAQLQVSLQALLDEMREALNAIAASRLSG

SEQ ID NO: 19499 - protein, 581 aa, Pseudomonas putida KT2440
MAKEHIPETLDLGVTDPSKTAEARQDRHFEGKLDWIVFGFTSLLAIAFVLWGFLNQASLASSASSAQSWVILNFGWFFVLTSSLFVVFVLWLAASRYGRVPLGRDGEQPEFRTVSWVAMMFSAGMGIGLMFFGVAEPLSHYISPPPGSASGQTSEAMQVAMATTLFHWTLHPWAMYAIVGLVIAYGTFRRGRSQLISAAFRPLIGKHANGPLGRLIDMMAIFATLFGSAASLGLGALQIAGGLEYNGWIESPGKLFYISIITLLTIAFVTSAVSGIGKGIQWLSNTNMVLALVLAVFVFMVGPTLLMLNLLPTSLGIYIKMLPEMMARTNASGGEQMNSWLAGWTVFYWAWWISWTPFVGMFIARISRGRTIRQFVTGVLLVPSLVSLVWFTIFGGAAIEAVREGAFQLANGAVNSNHALYQLLDSYPLASATSVLVMILVGIFFVSGADAASLVMGTLSEHGTTAPSRRTVIFWGTLTGTVAAIMLAIGDPGNPGEALTGLQNLTIVVALPFVVVMVLLCLALYRDLRKDPMMLRHLRGNELIEKAVLYGAVKHGEEFYIVVQEKKASAKTAAEAEVTRN

SEQ ID NO: 19500 - protein, 274 aa, Pseudomonas putida KT2440
MQRLSTRTGLDLPAIGLGTWPMTGSECTQAVRQALDVGYRHIDTATAYENEAAVGQALRDSDVPREQIHLTTKVWWDRLEPKAMRQSLEDSLRALGTEQVDLFHIHWPGTDWDLARSIDTLVALRDEGKARHIGVANFPLGLLRQVVETLGAPLSAIQVEYHVLLSQQPLLDFARGHDLLLTAYTPLARGQAAAQPVIQAIARKHGVLPSQVALKWLLDQDGVAAIPKASSRENQLANLAALTVPLDDEDRTAIAGLPKDQRVVSPPFAPDWNS

SEQ ID NO: 19501 - protein, 235 aa, Pseudomonas putida KT2440
MLVNVLIVHAHPEPQSFTAALRDQAVETFRAQGHQVQVSDLYAMGWNPVASADDFTQRENPEYLVYALEQRQGVKRGAIAADIQQELDKLLWADLLVLNFPIFWFSAPAMLKGWIDRVLVSGVCYGGKRFYDQGGLAGKRALVTVTLGGREHMFGDGAIHGPLEDMLRPILRGTLAYVGFEVLPPFVAWHVPYISADARQDFLQQYRQRLEQLSDDQPLVFPRLAQFDEALYPLT

SEQ ID NO: 19502 - protein, 750 aa, Pseudomonas putida KT2440
MIRLHTDGLLRRLLRFILLFSLCFTVLASSVQLYFEYRREMRDIEARMALIRAGYLASLERSLWDLDEAQLDTQLRGLVDFSDVARVRLVSDDFQLLRGEAEPKGPLRIERFPLDYQPPSGPARHLGELEVSIDLGAVHHRLYATGLASLLWMGVFLCGLAVALSGLFYRLVTRHLQVMAEFARRIGAGQWQEPLRLGRRRSSRPDEIDTVANALDDMRRAILSDIERRERDRLELQDKRDELQAMVERRTASLARAKDEAEAANLAKSRFLATMSHELRTPLNGILGMAELLRGGRLEVADRQRVEALYKAGEGLLAILNEVLYFARLEEGESRAERVVFSLRQLCQEVLALLEPMAMENADTLQLQVDEQLAAYQYGAEQYLRQVLSNLLANAIKFTEHGQVQLTVQVLANNECSQRLRLSVRDNGIGIEPAVQAKIFDRFVQASEAVTQRYGGTGLGLAICKHLVEKLGGSIGLESVQGQGSCFWFELDMARGQPVSAGSPAPSPLPSLDILVVEDVALNREVAGGLLMRDGHRVSFAEDASQALQACAQRRFDLVLLDVHLPGMSGVALCRQLRSSPGPNRHSRILALTAGVQPGQVAGYLDAGMQGVLAKPLRLDSLRKALADVAPGEVASAGADMDWSLLDTHRSLLGEQKLQGLLKVLRQSLQQHATALAEALPAQDFTEVLHLAHRLAGSCDSLGFTGLATVLRGLEEAARQHDVQAMQALGEPLATQLGQASATLEQLIQS

SEQ ID NO: 19503 - protein, 355 aa, Pseudomonas putida KT2440
MYPKNTWYVACTPDEIATKPLGRQICGEKIVFYRARENQVAAVEDFCPHRGAPLSLGYVEDGNLVCGYHGLVMGCDGKTVSMPGQRVRGFPCNKTFAAVERYGFIWVWPGDQAQADPALIPHLEWAVSDEWAYGGGLFHIGCDYRLMIDNLMDLTHETYVHASSIGQKEIDEAPPVTTVTGDEVVTARHMENIMAPPFWRMALRGNGLADDVPVDRWQICRFTPPSHVLIEVGVAHAGKGGYHAEAQHKASSIVVDFITPESDTSIWYFWGMARNFAAHDQTLTDNIREGQGKIFSEDLEMLERQQQNLLAHPERNLLKLNIDAGGVQSRKVLERIIAQERAPQPQLIATSANPA

SEQ ID NO: 19504 - protein, 1155 aa, Pseudomonas putida KT2440
MIQAASMDQRSFRKLLSRNIGLPLGVGLLGAVAFVAVINYLLSAMQWVEHTDRVIGNANETVKLSIDMETGMRGFLITGDERFLDPYEVAKPRILGSLKSLRSMVEDNPQQVDRIDRLMALQQAWNDFGNEMISLRRSQGDYQASIGNGRGKRITDEIRKEFDDLIITEQQLRMARNEKVSTVTVTAISAFVLFIVGLSALLAYLGRRDLLALSANYAENLQAQQRSAQRLEHQAWLRTGQTQLAQQVLGQLTLPMLGENILRFFASYLGSVVGAVYVRDEHGRLVRVACYGLSTEEQAREQIESDHHGLLAQAVREGRLLRLEELPEDFYRLSSGLGSGLPRSALLMPATEDGQINGVIELGFLRPLQERDEELLERVGGNLGMSIESARYRQRLQEVLAETQQLNEELQVQQEELKTANEELEEQSRVLKESQAHLETQQAELEQTNEQLSERTEALDRKNDELSQAQLELQARADDLQRSSKYKSEFLANMSHELRTPLNSSLILAKLLAENAEGNLSEEQVKFAESIYSAGNDLLNLINDILDIAKVEAGKLEVRPETTQVERLVEGLRGMFQPLAGHKGLAFEVKVEPQVPVTLFTDRQRLEQILKNLLSNAIKFTERGQVSMNVSFQADSGIVFAVRDTGIGIAADQQQAIFGAFHQVDGTSNRRYGGTGLGLSISRDLAHLLGGQINVDSSPGQGSVFSLILPERYAAEAEDVEPQSLRPAVDALPPAPQAPLAAAVTRPAPAFADDRERAPFDTRCILVIEDEPNFARILFDLAHELGYSCLVAHGADEGFELAAQYIPDAILLDMRLPDHSGLTVLQRLKEQASTRHIPVHIISVEDRVEAAMHMGAVGYAVKPTSREELKEVFARLEAKLTQKLKHILLVEDDDLQRESIARLIGDDDVEITAVAMAQDALALLRQNIYDCMIIDLKLPDMLGNELLKRMTAEDIRAFPPVIVYTGRNLTREEEADLLKYSRSIIIKGARSPERLLDEVTLFLHKVESQLSNERQRMLKTARSRDKVFEGRKVLLVDDDVRNIFALTSALEHKGAIVEIGRNGREAIERLEQHDDIDLVLMDVMMPEMDGFEATRLIRQQPRWRKLPIIAVTAKAMKDDQQRCLQAGANDYLAKPIDLDRLFSLIRVWLPQLERI

SEQ ID NO: 19505 - protein, 255 aa, Pseudomonas putida KT2440
MSKTHLFDLDGKIAFVSGASRGIGEAIAHLLAQQGAHVIVSSRKLDGCQQVADAIIAAGGKATAVACHIGELEQIQQVFAGIREQFGRLDVLVNNAATNPQFCNVLDTDPGAFQKTVDVNIRGYFFMSVEAGKLMRENGGGSIINVASINGVSPGLFQGIYSVTKAAVINMTKVFAKECAPFGIRCNALLPGLTDTKFASALVKNEAILNAALQQIPLKRVADPKEMAGAVLYLASDASSYTTGTTLNVDGGFLS

SEQ ID NO: 19506 - protein, 437 aa, Pseudomonas putida KT2440
MPIANATTVHSDIDHGTKALYSKITWRLIPFLCFCYLAAYLDRINVGFAKLQMLEDLQFSTAAYGLGAGLFFVGYIIFEVPSNLILQRVGAKLWIARIMITWGLLSACTMFVTSTTQFYILRFLLGAAEAGFLPGVLYYLTMWYPTYRRGRIIALFMIGLPLSSVIGGPISGWIMGHFDQVQGLHGWQWLFLLEAIPSVLLGILTFWALPNHFQQAKWLSADDKAQLAADLAADDAEGKDSKHSFRDGFFNLKVWMLGGIDFSILLSAYAMGFWMPTFIRDAGVSDTFHIGLLTAIPSLAALAGMLMIGASSDRHRERRWHIIVPFIIGAIAMASSTLFSQNLVMTVVLFAIASAAIIGAVPVFFSLPATFLKGTAAATGFALACSVANIAGLVSNSLMGVVTDLTGTSHAALWVFAGCLILSCFLVIALPAKLVNR

SEQ ID NO: 19507 - protein, 657 aa, Pseudomonas putida KT2440
MTAAPKPRSTLNPPVFYTSAILVFLLVLYATAFQEHAQTLFEQVQRWIITNASWFYILVVALVLISVVFLAVSRYGDIKLGPDHSEPDYRKSSWFAMLFSAGMGIGLMFFGVAEPVMHFSTPPVGDPGTVAAAREAMKITFFHWGLHAWAIYAIVALILAYFSFRNGLPLTLRSALYPLIGERIYGPIGHAVDVFAILGTVFGVATSLGYGVLQINSGFHHVFGLPVNTTVQVILITATCALATLSVASGLDKGIRILSELNLSLAVILMLFVLLLGPTVFLLQTYVQNTGAYLSDIVNKTFNLYAYEPTDWIGGWTLLYWGWWLSWSPFVGLFIARISRGRTIREFVCGVLFVPAGFTLLWMTVFGDSAIHMILNDGVKDLAAVVSEDSSLALFAFLEHFPFSSIISLVAVLMVVVFFVTSADSGALVVDMLASSGQGHSPLWQRIFWSVCIGAVAIALLLANGLKALQTATIASALPFAVILLVAIWGLFKALSLDATRRGLRNQALPGPRHTRHPHGGWQRRLRNIALMPRRVHVTRFIAEVVRPACEEVAQELRKQGYEVSVNERDDGRVSLELSHAGEGRFLYEVRPRAFNTPSFVMRDTEDGADSRKYFRAEVHLREGGQDYDIMGWSRDDVIGDILDQYERHLHYLHVVG

SEQ ID NO: 19508 - protein, 643 aa, Pseudomonas putida KT2440
MSKRLSWDIHTRTQIISLGPALLLTLLLISFFTFVRIQDLRQELNHTGQLIANQLAPASEYGVISGNNEVLEGLMRATLSIPHVRFLEVQDSRNHILVYVEQSDESANRAQQVEVFQAPIRLQQIRLDNDFLQQGKATSPAIGDDYLGRVIVGMSDDAFSQRQQEIVIKAGILALFALLFTFLLARRLALSLAKPISDMGHAVKAIQQGEYNTPLPVVDDSELGHLARHINNLASALEQASDEQKQAIAELIQAREEAEQANRAKSDFLAMMSHELRTPMNGVLGMLQLLETTPLSSEQADYTAVASESTGHLLKVINDILDFSRIERAALQLEHIDFNLGELITNSVQSFQHSAQQRGLGLHLQLPAGIEQLQVNGDPTRIRQILLNLIGNALKFTERGQVQVDARWQVLDRQLIWLTCSVRDTGIGIDSDRLEMMFVAFQQADSSISRRYGGTGLGLSIARTLAERMGGKLRGESREGLGSTFTLEMPLALANPAPVPLTPPTTVRTTVPDNDQVLLVEDNPVNRSVVEAMLRSLGLAVCTAEDGLEAVELVGRQRFAAVLMDCRLPHLDGYEATRRIRQLPNGAGLPIIALTANALQGDRERCMAAGMDDYLSKPLRRTELQQVLQRWLPGQTTATGDKC

SEQ ID NO: 19509 - protein, 293 aa, Pseudomonas putida KT2440
MPGAFPMSSPLVIHPRAETVEGQPILRPLPSAQCRSVGPFVFFDHMLETDYAPGHGMDIRQHPHIGLSTLTYLFEGAILHKDSLGSAQRVLPGDVSWMTAGSGIAHVERTPEDALAHGSRLHGLQVWLASPREFEQGPASYSHHPAASLPVSDSLGVRICMIAGSGFCLASPVPVLSPTLYAHVRMQPATTLLVPTEHVQRALYVLDGELMMNDEDVEPCSLVVLPEGEEVTLYAEGECQLVLIGGAPLDGPRRMNWNFVASDPELIERARARWAAGDWPVVPGEHSRIELPR

SEQ ID NO: 19510 - protein, 451 aa, Pseudomonas putida KT2440
MAIKVLLVEDDRVLRQALGDTLEIGGFAYQAVGSAEEALEAVLEDAFSLVVSDVNMPGMDGHQLLSQLRRQQPQLPVLLMTAHAAVERAVEAMRQGAADYLVKPFEPKALLNLVERHAAGRVTGEEGPVACEPASRQLLELAARVARSDSTVLISGESGTGKEVLARYIHQQSPRAAQPFVAINCAAIPDNMLEATLFGHEKGAFTGAIAAQAGKFEQAEGGTLLLDEISEMPMALQAKLLRVLQEREVERVGGRKPISLDIRVLATTNRDLAGEVAAGRFREDLYYRLSVFPLAWRPLRERPGDILQLAERLLARHVAKMKHASVRLSPAARACLQAYAWPGNVRELDNALQRALILQQGGVIEAADFCLAGAIPLSAGTEPSLEVVADAGGLGDDMRRHEYQMIIDTLRAERGRRKEAAERLGISPRTLRYKLAQMRDAGFDVEASLFG

SEQ ID NO: 19511 - protein, 308 aa, Pseudomonas putida KT2440
MSAVRKNPDAFAFQVMLGLCLIWGCQQVLIKTAAVDIAPVMQAALRNGIAAVLVGLMLCWRGGWEQVGSTWRAGLVAGGLFGVEFLFIAEGLKLTSAAHMSVFLYTAPVFTALGLHFRLPSERLRLLQWLGILLAFGGIAMAFAGGSSFEHMDGRTLLGDAFGVIAGLAWGATTVVVRCSRLSEAPATLTLFYQLAVGFAGLLLIALLSGQIGAVSLTPLAMGSVLFQGIVVSFISYLTWFWLLRKYLASNLAVFSFITPLFGVTFGVLLLDEPLSANFVVGALMVLLGVILVSAEPWVKQQLRRLVG

SEQ ID NO: 19512 - protein, 300 aa, Pseudomonas putida KT2440
MNLSLYLLTVLIWGTTWIALKLQLGVVAIPVSIVYRFALAGLILFAFLLITRRLQPMNRRGHQICLAQGLCLFCVNFICFLSASQWIASGLIAVVFSTATLWNALNARIFFGQRIAGNVLGGGALGLLGLGLLFWPELSHHAASRETLYGLGLALLGTLCFSAGNMLSSMQQKAGLKPMTTNAWGMVYGAVMLAVFCVVSGVPFSMEWNARYIGSLLYLVVPGSVIAFTAYLTLVGRMGPERAAYCTVLFPLVALNVSAVAEGYQWTAPALLGLVAVMAGNVLVFRKPRARVAEGVVVAK

SEQ ID NO: 19513 - protein, 142 aa, Pseudomonas putida KT2440
MINAQLLQSMVDASNDGIVVAEKEGDDTILIYVNAAFEYLTGYSRDEILYQDCRFLQGDDRDQLGRARIRKAMAEGRPCREVLRNYRKDGSAFWNELSITPVKSDFDQRTYFIGIQKDVSRQVELERELAELRARPKPDERA

SEQ ID NO: 19514 - protein, 306 aa, Pseudomonas putida KT2440
MPASRRFPLLLIGAFLALYLVWGSTYLFIRIGVESWPPMLMAGVRFLIAGGLLYGFLRWRGVPAPTWPQWRAAGAIGFLLLSCGNGGVTVAEHAGVASGVAALAVATVPLFTLLFGLLFGHRNSKLEWAGIALGLVGIGLLNLGSNLQASPIGAALIIFAAASWAFGSVWSKTLPLPQGPMASAAEMLVGGAVLLLGSVLSGERMTQLPTAAGWGALAYLVFFGSILAFSAYMYLLKHVRPAAATSYAYVNPAVAVLLGIVFAGEQIGAEECVAMAVIIGAVVLIGLPQWRKAPEPVQPLKGEICK

SEQ ID NO: 19515 - protein, 923 aa, Pseudomonas putida KT2440
MRRLRIASALIVSLLTLLCMFPAAAEHDGGWTVLLDEQANLQLSDVRSERYRNQFSPLPLADLDAAPAGQALWLHYRLAPGDQEQLLRVFAPDLSGLDLYALEGEQLLRQLHHGRQAGNASPTLRGSDHVLPLPNSRQPLDIYLRLVSEHQLRPAISLEPAAEAASDQRQPLLFGMLFGGLIMLIMHNLIRFLYTRSSTTLILALYHGLMLLSGLILLNLSGPWWHVWHSAQTPAAYLTLVLAGLSGLYFTQHFFSPCNSPRLNRLLQGEMLIVGLSGLVLLFVDTLPLNLMTYALMALGSVSMLLVSSYHWYKGYAPGRLFSLAMVVFNLGGLVLLPALLGLTRTSTPWLLCILLGLTVVSGLLLNLAVSERLRRISEERFSASRALAASDAEINAKAEFLAKISHEIRTPMNGVLGMTELLLGTPLSVKQRDYVQTIHSAGNELLTLINEILDISKLESRQIELDDVQFDLNALIEDCLNIFRAKAEQQNIELISFTQPQVPRVISGDPTRLRQALSSLLENALKNTDQGEILLVVALDQRGEVPRLRIAVQDSGEPLPAADREALLQAELHSHHFLSSNKLGGHLGLVIAKQLIGLMQGEFGIKSSTGMGNTLWLTLPLDPSRLEQPPADLDSPLRDARVLVVDDNDTCRKVLVQQCSAWGMNVSAVPSGKEALALLRTKAHLRDYFDAVLLDQNMPGMTGMQLAAKIKEDPSLNHDILVVMLTGISNAPSKVIARNAGVKRILAKPVAGYTLKTTLAEELAQRGREQAMPASLPGIPQALDLPGDFRVLVAEDNSISTKVIRSMLGKLNLKPDTACNGEEALQAMKAQHYDLVLMDCEMPILDGFSATQQLRAWEAENQRQRTPVVALTAHILAEHKERARLAGMDGHMAKPVELSQLRELIQYWANHREAKVDPAHTS

SEQ ID NO: 19516 - protein, 336 aa, Pseudomonas putida KT2440
MSRVTLSRYLIEQTRSNNTPADLRFLIEVVARACKEISHHVSKGALGGVLGSMGTENVQGEVQKKLDVISNDILLEANEWGGHLAGMASEEMDNAYQIPGRYPKGAYLLVFDPLDGSSNIDVNVSVGTIFSVLRCPNQYLSQNESLNEEAFLQPGTEQVAAGYAIYGPQTMLILTLGNGVKGFTLDRELGSFVLTHENIRVPETTAEFAINMSNQRHWEAPVQRYVGELLAGETGPLKKNYNMRWIASMVADVHRILTRGGLFMYPRDAREPSKPGKLRLMYEANPMSFIIEQAGGASTNGYDRILDIKPESLHQRVSVILGSKEEVERVTAYHKE

SEQ ID NO: 19517 - protein, 667 aa, Pseudomonas putida KT2440
MSSASLTKPPAERVRVNRVVFFTSALMILVLTALLIAVPETAGQVLGVAQKWLTRTFGWYYMLVICGYLLFVVYLAFSDYGSLKLGGKDDQPDFSYGAWAGMLFSSGIGISLLYFGASEPLDHYFNPPEGTPASLEAARQGLQLTFLHWGLHGWAIYALVGLAVGYFAYRHNQPLALRSALYPLVGERWVKGAAGNAVDIFGMFVTLLGLVTNLGIGAMQVSSGLEYLFGMDHSKTNLLVVILVMAGVATVAAVSGVENGIRRLSNLNIMLFSGLLIFVLLGGETLHLLNGFVQNVGDYLNGIVLKTFDLYVYEGEAGKSERWLGLWTVFYWAWWISWGPFVGMFIARISKGRTVRQLVMGVLLIPLGFTLAWLSIFGNTALDLVINQGAVELGKTALEQPSMSIYQLLEHFPAAKIVIGVAVFVGFVLFLTPADSGAVMMANLSCTGGKVDEDAPHWMVVFWSVVITLVTIGLLFAGNFEAMQTMVVLAGLPFSVVLVLFMFGLYKAMKQDVVIEQERAELAARGRRGFSERLTQLELQPTQAVVQRFMDKQVSPALKEAAAQLQTQGFEVETRVGQSRNLMGLRVMMEEGNPFVYEVSLDGYMAAPSEAPVEGEPELRQRFYRAEVYLHDGSQEYDLMGFAPDQIVRDVLDQFESHRQVLGRVYS

SEQ ID NO: 19518 - protein, 284 aa, Pseudomonas putida KT2440
MTTSLQPAYALVPGANLEAYVHTVNSIPLLTVEQERDLGERLYYEQDVEAARQMVMAHLRFVVHIARSYAGYGLAQADLIQEGNVGLMKAVKRFNPEMGVRLVSFAVHWIKAEIHEFILRNWRIVKVATTKAQRKLFFNLRSQKKRLAWLNNDEVHRVAESLGVEPREVREMESRLSGQDMAFDPAAEADDDSAFQSPAHYLEDHRYDPAVQLEDADWSDNSTSNLHEALQGLDERSRDILYQRWLAEEKATLHELADKYSVSAERIRQLEKNAMNKVKALIAA

SEQ ID NO: 19519 - protein, 759 aa, Pseudomonas putida KT2440
MLNTLRKIVQEVNSAKDLKSALGIIVLRVKEAMGSQVCSVYLLDPETNRFVLMATEGLNKRSIGKVSMAPNEGLVGLVGTREEPLNLENAADHPRYRYFAETGEEKFASFLGAPIIHHRRVVGVLVIQQKERRQFDEGEEAFLVTMSAQLAGVIAHAEATGSIRGLGRQGKGIQEARFVGVPGSPGAAVGRAVVMLPPADLEVVPDKTVDDIDAELKLFQNALEGVRDDMRKLSAKLATQLRPEERALFDVYLMMLEDAALGGEVTEVIKTGQWAQGALRQVVGEHVNRFELMDDDYLRERASDVKDLGRRLLAYLQEARSQSLVYADNTILVSEELTPAMLGEVPEGKLVGLVSVLGSGNSHVAILARAMGIPTVMGLVDLPYSKVDGIELIVDGYKGEVFTNPSEVLRKQYSEVVEEERQLAQGLDALRELPCVTPDGHRMPLWVNTGLLADVARAQQRGAEGVGLYRTEVPFMINQRFPSEKEQLAIYREQLAAFHPLPVTMRTLDIGGDKALSYFPIKEENPFLGWRGIRVTLDHPEIFLVQTRAMLKASEGLNNLRILLPMISGIHELEEALHLIHRAWGEVRDEGTDVPMPPVGVMVEIPAAVYQTKELARQVDFLSVGSNDLTQYLLAVDRNNPRVADLYDYLHPAVLQALNTVVRDAHGEGKPVSICGEMAGDPAAAVLLMAMGFDSLSMNATNLPKVKWMLRQINMGKAKELLAEALSHDNPQVIHSSLQLALKNLGLARMIGPGANKTL

SEQ ID NO: 19520 - protein, 415 aa, Pseudomonas putida KT2440
MNAFNYRDGELFAEGVALSAIAERYGTPTYVYSRAHIEAQYRSYADALQGTEHLVCFAVKANSNLGVLNVLARLGAGFDIVSGGELERVLAAGGRADRVVFSGVGKTREDMRRALEVGVHCFNVESTDELERLQVVAAEMGKVAPVSLRVNPDVDAGTHPYISTGLKENKFGIAIADAEAIYVRAAQLPNLEVVGVDCHIGSQLTTVEPFLDALDRLLVLVDRLAECGIHLRHLDLGGGVGVRYRDEQPPRVADYIKAIRERVGERDLALVFEPGRYIVANAGVLLTRVEYLKHTEHKDFAIIDAAMNDLIRPALYQAWMGVSAVKPRAGEGRAYDLVGPICETGDFLGKDRVLNLAEGDLLAVESAGAYGFVMSSNYNTRGRCAEILVDGDQAFEVRRRETVAELYAGESLLPE

SEQ ID NO: 19521 - protein, 462 aa, Pseudomonas putida KT2440
MHVAPTTELKALLRLAGPLIASQLAHMLMVLTDTLMMARISPQALAGGGLGAASYSFVSIFCLGVIAAVGTLVAIRKGANDIEGATRLAQNGLWLAWALALFAALVLWNLEPVLLLFGQKPENVASAAEFLTLLPLALPGYLTFMALRGFTSALGRSTPVMVISLFGTVLNYLFNVALIEGMFGLPKLGLMGIGLVTAVVSMGMATALALYIRWHPAYTAYPLRKGLSRPSLAALRELWRLGLPIGGTYMVEVGLFAFAALCMGVLGSTELAAHQIALQIVSTAFMVPTGLSYAVTMRVGLYYGAGNLLAARSAGRVGIGFGAMIMFAFATLFLLLPEALVGLFIDRNDPAFAAIFQVAVQLLMVAAWFELFDGMQTIAMGSIRGLKDAKTTFLIGLVCYWLVGAPSAWLFTFTLGGGAVGIWWGLALGLACAAVALTFGFEWRMKRLLGKAGVRTEAAVSA

SEQ ID NO: 19522 - protein, 403 aa, Pseudomonas putida KT2440
MQRLYRKRIVLGVGGGIAAYKSAELIRRLLEHGAQVRVVMTRGGAEFITPLTLQALSGHPVHMDLLDPAAEAAMGHIELAKWADLVLIAPATADLMARMAQGMADDLLTTLVLATDATVAVAPAMNQAMWRDPATQANLELLKSRGIQVFGPASGSQACGDVGLGRMLEATDLAWCAAESFKRQALTGKHVLITAGPTQENIDPVRYITNHSSGKMGFALAEAAAEAGARVTLVTGPVHLPTPDRVSRIDVVSARDMLAACEAAKPCDLFIASAAVADYRPEVVATQKLKKDPTTGDGMLLQMVRNPDILATIAGRADRPFSVGFAAETEHLLDYATRKLKDKNLDLIVANDVANPSIGFNSEENALTVIDRQQHQTLFAQTSKGKIARQLVAFIAERLNQVQ

SEQ ID NO: 19523 - protein, 567 aa, Pseudomonas putida KT2440
MRAESGLLKGLNPTVTIWSLLAVVAFVLFCALFAEHAAAVFQRASDFILQNFKWFYLISVTGVLGLLIYLMCSKFGSMKLGRDDDKPEFSFGSWIAMLFSGGMGIGLIFWSVAEPMWHYAGNPFATGLTDEAATTAMRITLFHWGLHPWAIFTIVGLGLAYFAYRKGLPLSMRSILYPLIGERIYGPIGHVVDILAVVITAFGVSQSLGLGVVQMNTGLSQVFDLPISLGVQITLIVLITLVTTVSVMAGVSRGMKRLSEWNMLLSVVLVVLILLLGPTRYIINLMLESTGDYASHVVGLSFWSDTQKDSGWQNWWTAFYWPWWMTWGPFVGLFIARISKGRSIRELIAGALLVPTLVTIIWMSVFGGTALKAEQLDRQQHAELVASGELQGDKAKYEGGTVLLATKQETTAAMFTLLHKIDAGTLGKVLSVLVCILLATYFITSADSGTQVLCTLNSMGSANPPQSIRLLWCILEGAIAMALLMAGGLKAIQMASIAAGLPIAGFILLISYTLMRSLRQEMADGLLDTPPGGRLPIPGIHPQGITPVAGPLACEGLDMGLTAKKAS

SEQ ID NO: 19524 - protein, 669 aa, Pseudomonas putida KT2440
MQSKTTRRSFVKGLAATGLLGGLGMWRAPVWAVTSPGQPNVLTGTDFDLYIGELPVNITGTVRTAMAINGSIPGPILRWREGDTVTLRVRNRLQQDTSIHWHGIILPANMDGVPGLSFHGIAPDGMYEYKFKVQQNGTYWYHSHSGFQEQVGVYGALVIDAKEPEPFTYDRDYVVMLSDWTDEDPARVLSKLKKQSDYYNYHKRTVGDFVNDVSEMGWSAAVADRKMWAEMKMSPTDLADVSGYTYTYLMNGQAPDGNWTGVFKPGEKIRLRFINGSAMTYFDVRIPGLKMTVVAADGQHVKRVAVDEFRIAVAETYDVIVEPEDEQAYTIFAQSMDRTGYSRGTLAVREGMQAAVPAVDPRPLISMSDMGMDHGSMAGMDHGNMAGMDHSKMAGMDHGNMAGMDHSKMAGMDHGNMTGMDHSKMAGMDHGSMAGMDHSKMAEMDHGGMAGMDHSKMAGMDQGGMADMDHSKMAGMDQGGMADMDHSSMEGMGGAMQSHPASETNNPLVDMQTMSPTPKLDDPGIGLRNNGRRVLTYADLRSTFIDPDGREPGRTIELHLTGHMEKFAWSFDGVKFSDAEPLRLKYGERLRITLVNDTMMTHPIHLHGMWSDLEDEDGNFMVRKHTIDMPPGSKRSYRVTADALGRWAYHCHLLFHMEMGMFREVRVDE

SEQ ID NO: 19525 - protein, 374 aa, Equus caballus
STAGKVIKCKAAVLWEEKKPFSIEEVEVAPPKAHEVRIKMVATGICRSDDHVVSGTLVTPLPVIAGHEAAGIVESIGEGVTTVRPGDKVIPLATPQCGKCRVCKHPEGNFCLKNDLSMPRGTMQDGTSRFTCRGKPIHHFLGTSTFSQYTVVDEISVAKIDAASPLEKVCLIGCGFSTGYGSAVKVAKVTQGSTCAVFGLGGVGLSVIMGCKAAGAARIIGVDINKDKFAKAKEVGATECVNPQDYKKPIQEVLTEMSNGGVDFSFEVIGRLDTMVTALSCCQEAYGVSVIVGVPPDSQNLSMNPMLLLSGRTWKGAIFGGFKSKDSVPKLVADFMAKKFALDPLITHVLPFEKINEGFDLLRSGESIRTILTF

SEQ ID NO: 19526 - protein, 63 aa, Aureococcus anophagefferens
MRGILVDWLVEVHLKFKMLQPTIYLTVQIIDRYLSAKQIDRNQLQLLGVAALFIASKYEEIYP

SEQ ID NO: 19527 - protein, 63 aa, Alexandrium tamarense
MRGILADWLVEVAEEYKLCADTLYLSVNYIDRFLSIHPVQRSNLQLVGIACMWIASKYEEIYP

SEQ ID NO: 19528 - protein, 64 aa, Isochrysis galbana
MRGILADWLIEVHHKFKLHIETLYGSVDLIDRYLSKCAPITRSKLQLVGVAAMFIASKYEEIYP

SEQ ID NO: 19529 - protein, 63 aa, Prorocentrum minimum
MRGILTDWLVEVAEEYKLCADTLYLSVNYIDRFLSIHPVQRSNLQLVGIACMWIASKYEEIYP

SEQ ID NO: 19530 - protein, 63 aa, Prorocentrum minimum
MRGILVDWLVEVAEEYKLCADTLYLSVNYIDRFLSIHPVQRSNLQLVGIACMWIASKYEEIYP

SEQ ID NO: 19531 - protein, 58 aa, Skeletonema costatum
MRGILADWLVEVHLKFKLVPETLYLVVNLIDRYLAKKEVTRSKLQLVGVTALFIATKY

SEQ ID NO: 19532 - protein, 104 aa, Fritillaria agrestis
MALAKAKDLVASNPVVVFSKSYCPYCIRVKELLVKLKATYKVIELDLESDGSAIQAALAEWTGQRTVPNVFIGGKHIGGCDKTMELYNSGKLQPLLVEAGALAA

SEQ ID NO: 19533 - protein, 399 aa, Phytophthora infestans
MLRLGRSAASEVSSIRNSLQLQLEQRGARPMQCAYQTQSHSNPEGAKRGRSPMSLAVMGAAALSVGLELQTDGIAQARAAMEPGTQLQRHKWQLFDQIGAGAFGVVRLGMHEESGEVAAVKIVPLENPNDQRSYPALEREIAALKLVKALGGHNSIVDLRDVYVEGRKLFLVTELARGGELFEQIVAYGSFPELKARDVAREMASALSFMHRHGLVHKDVKPENILMSARVVDHNSGVYRKSNRHESSSLVKLADFGSAGPASVNTNLEDIGTAAYLPPEVLNSGMCTSACDMWALGCVLYIMLSGSHPFDLDGMSADSVVEHRVKSEPVTFDFSAWDNVSPHAKDLISKLLVKDPTLRLTADQMLQHPWMNASAEAAAAGLRRPSPLLAGQPIPRGPA

SEQ ID NO: 19534 - protein, 152 aa, Solanum tuberosum
MSSFSEEQEALVVKSWGSMKKDAGEWGLKFFLKIFEIAPSAKKMFSFLKDSNVPLDQNPKLKVHAKSILVMTCEAAVQLRKAGKVVVRDSTLKKIGATHFKYGVADEHFEVTKYALLETIKEASPEMWSVEMKNAWGEAYDQLVSAIKTEMK

SEQ ID NO: 19535 - protein, 247 aa, Staphylococcus epidermidis
MGRTVLITGGCKNIGKQIAQVFAENNYNVIVTSRNNNNKSIITYFKKKNLKVFFYTLNVENEDEVVNVFKEINNDIGKIDILINNAGISQGNTLLEDSKTEDFKSMINTNILGSYYCMKHVIPYMKRNRYGVIINIVSIAALRGIPYSILYGSTKNAVIALTKGAAIENANNGIRVNAIAPGIIKTESLNTEIQNSEDELNEQTIAAIHPMQILGEEKDVANTAYFIANSSFMTGSIVNLDGGYTAQ

SEQ ID NO: 19536 - protein, 321 aa, Cucurbita maxima
MAAASSFSAAFYSGIPLIDLSAPDAKQLIVKACEELGFFKVVKHGVPMELISSLESESTKFFSLPLSEKQRAGPPSPFGYGNKQIGRNGDVGWVEYLLLNTHLESNSDGFLSMFGQDPQKLRSAVNDYISAVRNMAGEILELMAEGLKIQQRNVFSKLVMDEQSDSVFRVNHYPPCPDLQALKGTNMIGFGEHTDPQIISVLRSNNTSGFQISLADGNWISVPPDHSSFFINVGDSLQVMTNGRFKSVKHRVLTNSSKSRVSMIYFGGPPLSEKIAPLASLMQGEERSLYKEFTWFEYKRSAYNSRLADNRLVPFERIAAS

SEQ ID NO: 19537 - protein, 357 aa, Oryza sativa (japonica cultivar-group)
MGRSPCCEKIGLKKGPWTPEEDQKLLAYIEEHGHGSWRALPSKAGLQRCGKSCRLRWTNYLRPDIKRGKFSLQEEQTIIQLHALLGNRWSAIATHLPKRTDNEIKNYWNTHLKKRLAKMGIDPVTHKAINGTLNNTAGDKSAKVTASLSHMAQWESARLEAEARLARESKMRIAASTPSKLHAQSTNPPASTPSPCFDVLNAWQSAKIDLESPTSTLTFAGSNASMLPFSTTTALELSESNSNVWQQRSDELEGEESEWKFVSKQQLQGMHGKETEEHFIGCEESWFPGTANIGAGFTGMLLDGSNMHDTSECWDESSNGQDEQRSQVSEDAENKNYWNGIFSMVNSEQPPLQPPLL

SEQ ID NO: 19538 - protein, 210 aa, Asarum europaeum
GGLLKKARELAILCDAQLGVIIFSSSGKMFEFSSPPISMREIIDRYQKLSGNCAPVYDNQQVYCEITRMKNEIDKLQATMRHFAGEDLTSLTMNEMLQLEQQLEISVNKVRSRKEQLLQQQLDNLRRKENMLEEQNRELYRVIQDHHAASMEQKMVDPSMLDHFGVFYQDDHQAARSSMLQLSPQLHPFRLQPAQPNLQDANLLPHDLQL

SEQ ID NO: 19539 - protein, 405 aa, Pseudomonas fluorescens
MTLSPADQSKLEGFWQHCVTHQYFNIGYPESADFDYSQLHRFLQFSINNLLGTGNEYSNYLLNSFDFEKDVMTYFAELFNIALEDSWGYVTNGGTEGNMFGCYLGRELFPDGTLYYSKDTHYSVAKIVKLLRIKCRAVESLPNGEIDYDDLMAKITADQERHPIIFANIGTTMRGALDNIVTIQQRLQQAGIARHDYYLHADAALSGMILPFVDHPQPFSFADGIDSICVSGHKMIGSPIPCGIVVAKRNNVARISVEVDYIRAHDKTISGSRNGHTPLMMWAALRSYSWAEWRHRIKHSLDTAQYAVDRFQASGIDAWRNENSITVVFPCPSERIATKYCLATSGNSAHLITTPHHHDCSMIDALIDEVVAEAQLNTLRSKRAFTEQTVVERLPAASFNLRTHY

SEQ ID NO: 19540 - protein, 386 aa, Listonella anguillarum
MKLSNEDLCKLNKFWLYCEENQYFNVGYPESAAFDYSILEKFMKFSINNCGDWREESNYKLNSFEFEKEVMRFFSQLFKIPYNDSWGYISNGGTEGNMFSCYLAREIFPTAYIYYSEETHYSVDKIVRLLNIPARKIRSLPSGEIDYQNLVDQIQKDKQKNPIIFANIGTTMRGATDNIQRIQQDLASIGLERNDYYIHADAALSGMIMPFVEQPHPYSFEDGIDSISVSGHKMIGSPIPCGIVLAKRHMVDQISVEVDYISSRDQTISGSRNGHSALFMWTAIKSHSFVDWQGKVNQCLNMAEYTVQRFQEVGINAWRNKNSNTVVFPCPSEPVWRKHSLANSGSVAHIITMPHLDGPDKLDPLIEDVIYDLLPNYNILNVSGQN

SEQ ID NO: 19541 - protein, 228 aa, Raoultella ornithinolytica
NGGTEGNMFGCYLGREIFPNGTLYYSKDTHYSVAKIVKLLRIKSTLVESQPNGEMDYADLIKKIKRDNEKHPIIFANIGTTVRGAIDNIAIIQQSISELGIERKDYYLHADAALSGMILPFVDNPQPFNFADGIDSIGVSGHKMIGSPIPCGIVVAKKKNVDRISVEIDYISAHDKTISGSRNGHTPLMMWEAIRSHSWEEWRRRIERSLNMAQYAVDRFQSAGIDAW

SEQ ID NO: 19542 - protein, 427 aa, Cyprinus carpio
MNKNKREKEFYSVDVGDSTFTVLKRYQNLRPIGSGAQGIVCSAYDHNLERNVAIKKLSRPFQNQTHAKRAYRELVLMKCVNHKNIIGLLNVFTPQKTLEEFQDVYLVMELMDANLCQVIQMELDHERLSYLLYQMLCGTKHLHSAGIIHRDLKPSNIVVKSDCTLKILDFGLARTAATGLLMTPYVVTRYYRAPEVILGMGYQANVDVWSVGCIMAEMVRGSVLFPGSDHIDQWNKVIEQLGTPSQEFMMKLNQSVRTYVENRPRYTGYSFEKLFPDVLFPADSEHNKLKASQARDLLSKMLVIDASKRISVDEALQHPYINVWYDPAEVEAPPPLIIDKQLDEREHTVEEWKELIFKEVLDWEERMKNGVIRGQPSPIGAAVINGSPQPSSSSSINDVSSMSTEPTVASDTDSSLEASAGPLSCCR

SEQ ID NO: 19543 - protein, 427 aa, Cyprinus carpio
MNKNKREKEFYSVDVGDSTFTVLKRYQNLRPIGSGAQGIVCSAYDHNLERNVAIKKLSRPFQNQTHAKRAYRELVLMKYVNHKNIICLLNVFTSQKTLDEFQDVYLVMELMDANLCQVIQMELDHERLSYLLYQMLCGIKHLHSAGIIHRDLKPSNIVVKSDCTLKILDFGLARTAATGLLMTPYVVTRYYRAPEVILGMGYQANVDIWSVGCILAEMVRHKILFPGRDYIDQWNKVIEQLGTPTQEFMMKLNQSVRTYVENRPRYTGYSFEKLFPDVLFPADSEHNKLKASQARDLLSKMLVIDASKRISVEEALQHPYINVWYDPAEVEAPPPVITDKQLDEREHTVEEWKELIYKEVLDWEERMKNGAIRGQPSPLGAAVINGSPQPSSSSSINDVSSMSTEPTVASDTDSSLEASAGPLSCCR

SEQ ID NO: 19544 - protein, 317 aa, Lycopersicon esculentum
MVCPNSNPVVEKVCELYEQISRLENLSPSKDVNVLFTDLVHTCMPPNPIDVSKLCQKIQEIRSHLIKLCGQAEGLLESHFSKILSSYENPLQHLHIFPYFDNYIKLSLLEYNILTKNTTNIPKKIAFIGSGPLPLTSLVLATKHLKTTCFHNYDIDVDANFMASALVAADPDMSSRMTFHTADVMDVTCALKDYDVVFLAALVGMDKEDKVKVVDHLAKYMSPGATLMLRSAHGARAFLYPVLDPRDLRGFEVLSVYHPTDEVINSVIIARKLPVPSVPLLDGLGAYVLPSKCACAEIHAFNPLNKMNLVEEFALEE

SEQ ID NO: 19545 - protein, 325 aa, Oryza sativa; identical to SEQ ID NO: 3964

SEQ ID NO: 19546 - protein, 343 aa, Oryza sativa
MTVEVEAVTMAKEEQPEEEEVIEKLVEKITGLAAAIGKLPSLSPSPEVNALFTELVMTCIPPSSVDVEQLGAEAQDMRGRLIRLCADAEGHLEAHYSDVLAAHDNPLDHLALFPYFNNYIQLAQLEYALLARHLPAAPPPSRLAFLGSGPLPLSSLVLAARHLPAASFHNYDICADANRRASRLVRADRDLSARMAFHTSDVAHVTTDLAAYDVVFLAALVGMAAEEKARMVEHLGKHMAPGAALVVRSAHGARGFLYPVVDPEEIRRGGFDVLAVHHPEGEVINSVIIARKPPVAAPALEGGDAHAHGHGAVVSRPCQRCEMEARAHQKMEDMSAMEKLPSS

SEQ ID NO: 19547 - protein, 332 aa, Oryza sativa; identical to SEQ ID NO: 3160

SEQ ID NO: 19548 - protein, 329 aa, Hordeum vulgare
MDAQNKEVDALVQKITGLHAAIAKLPSLSPSPDVDALFTDLVTACVPPSPVDVTKLGSEAQEMREGLIRLCSEAEGKLEAHYSDMLAAFDNPLDHLGMFPYYSNYINLSKLEYELLARYVPGRHRPARVAFIGSGPLPFSSYVLAARHLPDAMFDNYDLCSAANDRASKLFRADKDVGARMSFHTADVADLTGELAAYDVVFLAALVGMAAEDKTKVIAHLGAHMADGAALVVRSAHGHVGFLYPIVDPQDIGRGGFEVLAVCHPDDDVVNSVIIAHKSKDVHANERPNGVVDSTRGAVPVVSPPCRFGEMVADVTHKREEFTNAEVAF

SEQ ID NO: 19549 - protein, 340 aa, Hordeum vulgare
MGMEGCCSNKKVMEEEALVKKITGLAAAIGELPSLSPSPEVNALFTELVTSCIPPSTVDVDALGPDAQEMRARLIRLCADAEGHLEAHYSDLLAAHDNPLDHLTLFPYFNNYIKLSQLEHGLLARHVPGPAPARVAFLGSGPLPLSSLVLAARHLPDASFDNYDISGEANERASRLVRADADAGARMAFRTADVADVTTELEGYDVVFLAALVGMAAEEKARLVEHLGRHMAPGAALVVRSAHGARGFLYPVVDPEEIRRGGFEVLTVHHPEDEVINSVIIARKAAAPPPVAADRDVPVNMPMPAQCAVAVSRPCLGCACELGARAHQKMKEIAMEEMEA

SEQ ID NO: 19550 - protein, 328 aa, Hordeum vulgare
MDAQNKEVDALVQKITGLHAAIAKLPSLSPSPDVDALFTDLVTACVPPSPVDVTKLGSEAQEMREGLIRLCSEAEGKLEAHYSDMLAAFDNPLDHLGMFPYYSNYINLSKLEYELLARYVPGGIARPAVAFIGSGPLPFSSYVLAARHLPDAMFDNYDLCSAANDRASKLFRADKDVGARMSFHTADVADLTRELAAYDVVFLAALVGMAAEDKAKVIPHLGAHMADGAALVVRSAQARGFLYPIVDPQDIGRGGFEVLAVCHPDDDVVNSVIIAHKSKDVHANERPNGRGGQYRGAVPVVSPPCRFGEMVADVTHKREEFTNAEVAF

SEQ ID NO: 19551 - protein, 329 aa, Hordeum vulgare
MDGQSEEVDALVQKITGLHAAIAKLPSLSPSPDVDALFTDLVTACVPPSPVDVTKLAPEAQAMREGLIRLCSEAEGKLEAHYSDMLAAFDNPLDHLGVFPYYSNYINLSKLEYELLARYVPGRHRPARVAFIGSGPLPFSSYVLAARHLPDTVFDNYDLCGAANDRATRLFRADKDVGARMSFHTADVADLTDELATYDVVFLAALVGMAAEDKAKVIAHLGAHMADGAALVARHGARGFLYPIVDPQDIGRGGFEVLAVCHPDDDVVNSVIIAQKSNDVHEYGLGSGRGGRYARGTVVPVVSPPCRFGEMVADVTQKREEFANAEVAF

SEQ ID NO: 19552 - protein, 335 aa, Hordeum vulgare
MAAQNNQEVDALVEKITGLHAAIAKLPSLSPSPDVDALFTELVTACVPPSPVDVTKLGPEAQEMREGLIRLCSEAEGKLEAHYSDMLAAFDKPLDHLGMFPYYNNYINLSKLEYELLARYVPGGYRPARVAFIGSGPLPFSSFVLAARHLPDTMFDNYDLCGAANDRASKLFRADRDVGARMSFHTADVADLAGELAKYDVVFLAALVGMAAEDKAKVIAHLGAHMADGAALVVRSAHGARGFLYPIVDPQDIGRGGFEVLAVCHPDDDVVNSVIIAQKSKDVHADGLGSGRGAGGQYARGTVPVVSPPCRFGEMVADVTQNHKRDEFANAEVAF

SEQ ID NO: 19553 - protein, 335 aa, Hordeum vulgare
MAAQNNNKDVAALVEKITGLHAAIAKLPSLSPSPDVDALFTELVTACVPPSPVDVTKLGPEAQEMREGLIRLCSEAEGKLEAHYSDMLAAFDNPLDHLGIFPYYSNYINLSKLEYELLARYVRRHRPARVAFIGSGPLPFSSFVLAARHLPDTMFDNYDLCGAANDRASKLFRADTDVGARMSFHTADVADLASELAKYDVVFLAALVGMAAEDKAKVIAHLGAHMADGAALVVRSAHGARGFLYPIVDPQDIGRGGFEVLAVCHPDDDVVNSVIIAQKSKEVHADGLGSARGAGRQYARGTVPVVSPPCRFGEMVADVTQNHKRDEFANAEVAF

SEQ ID NO: 19554 - protein, 329 aa, Hordeum vulgare
MDAQSKEVDALVQKITGLHAAIAKLPSLSPSPDVDALFTDLVTACVPPSPVDVTKLAPEAQAMREGLIRLCSEAEGKLEAHYSDMLAAFDNPLDHLGVFPYYSNYINLSKLEYELLARYVPGGIAPARVAFIGSGPLPFSSYVLAARHLPDTVFDNYVPVRAANDRATRLFRADKDVGARMSFHTADVADLTDELATYDVVFLAALVGMAAEDKGQGDPHLGAHMADGAALVRSAHGARGFLYPIVDPQDIGRGGFEVLAVCHPDDDVVNSVIIAQKSKDMFANGPRNGCGGRYARGTVPVVSPPCRFGEMVADVTQKREEFAKAEVAF

SEQ ID NO: 19555 - protein, 378 aa, Raoultella planticola
MTLSISDQNKLDSFWSYCVKNQYFNIGYPESADFDYTILERFMRFSINNCGDWGEYCNYLLNSFDFEKEVMEYFAQLFKIPFEESWGYVTNGGTEGNMFGCYLGREIFPNGTLYYSKDTHYSVAKIVKLLRIKSTLVESQPNGEMDYADLIKKIKRDNEKHPIIFANIGTTVRGAIDNIAIIQQSISELGIERKDYYLHADAALSGMILPFVDNPQPFNFADGIDSIGVSGHKMIGSPIPCGIVVAKKKNVDRISVEIDYISAHDKTISGSRNGHTPLMMWEAIRSHSWEEWRRRIERSLNMAQYAVDRFQSAGIDAWRNKNSITVVFPCPSEAVWKKHCLATSGDIAHLIATAHHLDSSKIDALIDDVIADLKKQAA

SEQ ID NO: 19556 - protein, 265 aa, Viscum album subsp. album
IAAGVQFGWALQLSLLTPYVQELGIPHKWASIIWLCGPLSGLFVQPLVGVMSDRCTSRFGRRRPFIFAGSLLIAISVLIIGHSADIGWWLGDRGGVRPRAIGAFVFGFWILDVANNMTQGPCRALLADLTGKDHRRTRVANAYFSLFMAIGNILGFATGSYNGWYKVFPFTVTSACNIDCANLKSAFYLDVVFMAITACISISAAQESPLDLPARSMLADEEMLGQSNSVQEAFLWELFGTFRCFPSTVWIILLVTALNWIAWFP

SEQ ID NO: 19557 - protein, 218 aa, Oryza sativa (indica cultivar-group)
MEVEEAAYRTVWSEPPKRPAGRTKFRETRHPVYRGVRRRGGRPGAAGRWVCEVRVPGARGSRLWLGTFATAEAAARAHDAAALALRGRAACLNFADSAWRMPPVPASAALAGARGVRDAVAVAVEAFQRQSAAPSSPAETFADDGDEEEDNKDVLPVAAAEVFDAGAFELDDGFRFGGMDAGSYYASLAQGLLVEPPAAGAWWEDGELAGSDMPLWSY

SEQ ID NO: 19558 - protein, 341 aa, Pseudomonas resinovorans
MSHKVAFSFADGKTLFFPVQSHEILLDAALRNGINIPLDCREGVCGTCQGRCESGQYSQDYVDDEALSAEDLRQRKMLTCQTRVSSDAAFYFDFASSLCNAPGPGRLKGIVRAVEQVSPNTAILHLDAGADGQQLDFLPGQYARLQIPGTHGQRSYSFANRPNSGNQLQFLIRLLPDGLMSNYIRERSLIGDEILLEAPLGAFYLRHVDKPLVFVAGGTGLSAFLGMLDEIAERGGCGHPVHLYYGVRNAADLCETQRIAAYAERIPGFRFTPVISDPSPDWHGKRGYITEHFDLAEFRDQALDMYLCGPPPMVESIKQWLDTQALDQTRLYYEKFTQSNT

SEQ ID NO: 19559 - protein, 269 aa, Pseudomonas resinovorans
MKPLPTADLQGQVAIVTGSTQGLGTDIARQLLRAGASVTLVGRNRDTGAALAEALGERCRFAACDVERDDDIDACIAATLAAFGRLDILVNNACVYDDQGLLSDRAQWLKTLNVNLVSAAIFVQKAAPHMTGGGTVINIGSTGGKFGAAGRALYPASKAGLLQLTRNLAVSLAPAAIRVISVSPAWTWSPSVASLSGGDVAVADRIGATFHPLGRVGRGEEIGQVVAFLCSQGASWITGVDIPVDGGFSILGPDQGLSPRTWFERLRDQ

SEQ ID NO: 19560 - protein, 676 aa, Erwinia pyrifoliae
  unsure (1)..(676): unsure at all Xaa locations
MPAXEIPEKHQKDRINPVVFYTSAVLILLFSLTTILLTDFSDRWINRTLNWVSNTFGWYYLLAATLYIVFVIFMACSRFGSIKLGPEQSKPEFSLMSWAAMLFAAGIGIDLMFFSVAEPVTQYMIPPEGQGQTLXTARQAMVWTLFHYGLTGWSMYALMGIALGYFSYRYGLPLTIRSALYPIFGKRVNGPIGHTVDIAAVLGTIFGIATTLGIGVVQLNYGLKVLFDVPEGLTAQAGLIVLSVIMATISVTSGVNKGIRFLSELNVLLAFGLILFVLFVGDTSFLLNALVLNVGDYINRFMGMTLDSFAFDRPTEWMNNWTLFFWAWWVAWSPFVGLFLARISRGRTIRQFVLGTLTIPFIFTLLWLSIFGNSALNEIIXGNLALAQXTLAHPERGFYSLLAQYPGFTFSASVATITGLLFYVTSADSGSLVLGNFTSRLADINNDAPNWLRIFWSVTIGVLTMGMLMVNGVTALQKTTVIMGLPFSFVIFFVMAGLYKSLRVEDHRRASATVNTPPVTVDRLNWKQRISRVMNYPGTTHTRXMLDXVCRPAMEEVGRELXRRGAKVQVNELPAVEDERLNHLELXXDLADEQSLLYQIWPQRYSVPAFTYRARSGKSDYFRLETFLLEGTQGNDLMDYTKEQIINDILDQYERHLTFLHIHREAPGNSMPFPEV

SEQ ID NO: 19561 - protein, 462 aa, Erwinia pyrifoliae
  unsure (1)..(462): unsure at all Xaa locations
MMKNVSSAVAVSRNPATGEVFARYPFATIAEVDSALALTNGAFQYWRHSAMSDRVQLLCNVADALRQQARELAEMMTSEMGKPVDQGLAEVEKSARLCEWYAGHGPAFLQREPTLVEGNKAFVDYLPLGPVLSVMPWNFPVWQVLRGAVPILLAGNSYLLKPAPNVMGCALLLQQILTRVGVPEGLFAVVNADNDGVAQAINDRRIAAVTVTGSVRAGAAIAALSGAAIKKCVLELGGSDAFIVLADADIDAAVKGAIAGRFMNNGQLCISAKRIIVEAPVFDAFRDKFVSAVKEMKIGDPRESGTWIGPMARYDLRDELDSQVQATLKEGATLLLGGHVLPGEGNYYAPTVLXDVKPGMTSFAQELFGPVASLIQADNAXHAVAMANDSEFGLGGSMWSRDLAVAQKLASRIETGGVFINSPSFSDPRVPIGGVKKSGFGRELSHFGLREFTNTQTVWMEE

SEQ ID NO: 19562 - protein, 289 aa, Mus musculus
MAATAATVNGSTTVSSSGPAATSVGILQAAAGMYEQLKDEWNRKNPNLSKCGEELGRLKLVLLELNFLPTTGTKLTKQQLILARDILEIGAQWSILCKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFAEATRILFFSTPKKMTDYAKKRGWVLGPNNYYSFASQQQKPEDSTIPFTELAKQVIEYARQLEMIV

SEQ ID NO: 19563 - protein, 631 aa, Mus musculus
MESVALLQRPSQAPSASALASESARPLADGLIKSPKPLMKKQAVKRHHHKHNLRHRYEFLETLGKGTYGKVKKARESSGRLVAIKSIRKDKIKDEQDLLHIRREIEIMSSLNHPHIIAIHEVFENSSKIVIVMEYASRGDLYDYISERPRLSERDARHFFRQIVSALHYCHQNGIVHRDLKLENILLDANGNIKIADFGLSNLYHKGKFLQTFCGSPLYASPEIVNGKPYVGPEVDSWSLGVLLYILVHGTMPFDGQDHKTLVKQISNGAYREPPKPSDACGLIRWLLMVNPTRRATLEDVASHWWVNWGYTTGVGEQEALREGGHPSGDFGRASMADWLRRSSRPLLENGAKVCSFFKQHVPGGGSTVPGLERQHSLKKSRKENDMAQNLQGDPAEDTSSRPGKSSLKLPKGILKKKSSTSSGEVQEDPQELRPVPDTPGQPVPAVSLLPRKGILKKSRQRESGYYSSPEPSESGELLDASDVFVSGDPVEQKSPQASGLLLHRKGILKLNGKFSRTALEGTTPSTFGSLDQLASSHPAARPSRPSGAVSEDSILSSESFDQLDLPERLPETPLRGCVSVDNLRGLEQPPSEGLKRWWQESLGDSCFSLTDCQEVTAAYRQALGICSKLS

SEQ ID NO: 19564 - protein, 203 aa, Isochrysis galbana
GEGTYGVVYKAQDTEDPQGATVALKKIWLDDRDEGVPVTTLREVALLRNLDHVNIVRMREFVTIPPRIYLVFEYLDHDLKACLDTKFRSGMPAPLVKSCALQILRGLAFCHSHRILHRDLKPQNVLIDNAGIVKLADFGLARASLLLNSQLYTNEVVTLWYRAPELLLGTQNYINSVDVWAAGCIFTELSCRMPLFPGDSEIE

SEQ ID NO: 19565 - protein, 169 aa, Oryza sativa (japonica cultivar-group)
MAATADNGEKMILLISSDGERFELSEAAASQSKTLSHMIEDDCTDNGVPLPNVTAVVLAKVVEYFKKHAAVTPKPATEAVAADKAKREEELKSFDAEFVDVDRTMVFELILAANFLNAQDLLDLTCQHAADLIKDMSVEEVREVFNITNDFTPEEEAEVRKENAWAFDN

SEQ ID NO: 19566 - protein, 620 aa, Oryza sativa (japonica cultivar-group)
MATREHELRPEQERLGEDREEYEDGEEEEEEGEEGWDDWESDGDDAGGGGGGGGLLCLFCSARFDSESSLFSHCASEHRFDFYRVVKETGMDFYGCIKLINFVRSKVAENKCWSCGQVFSSNSELCGHLHALEIPQLEGKVPWGDDVYLKPFLEDDSLLHSLSVFDDDDEDDCGMPMEKGGCSAGNGSLAETCESNLKSIINDGSDVIDRFERTCTIESTDGECSGSLAQEPSDKQLKIARASAAARGIKSVDESYFGSYSSFGIHREMLGDKVRTEAYRDALLGNPSLMNGATVLDVGCGTGILSLFAAKAGASRVIAVDGSAKMVSVATEVAKSNGFLYDENMEMQQKRDTQVITVVHTKAEELNHKIQVPSNKFDVLVSEWMGYCLLYESMLSSVLYARDHFLKPGGAILPDTATIFGAGFGKGGTSLPFWENVYGFDMSCIGKEVTGNSARFPVVDILASEDIVTETAVLNSFDLATMKENEMDFTSSFELRLSESGVSQSGVTWCYGIILWFDTGFTNRFCKEKPVNLSTSPFSTPTHWSQTIFTFEEPIAMAKEESAVVSSASVGTDECPAVMIRSRISIVRASEHRSIDISIETTGISSDGRKRSWPVQIFNL

SEQ ID NO: 19567 - protein, 300 aa, Oryza sativa (japonica cultivar-group)
MVVSMEMGPHGGGGAAAGKPVPAPFLTKTYQLVDDPCTDHIVSWGEDDTTFVVWRPPEFARDLLPNYFKHNNFSSFVRQLNTYGFRKIVADRWEFANEFFRKGAKHLLAEIHRRKSSQPPPPPMPHQPYHHHHHLNPFSLPPPPPAYHHHHLIQEEPATTAHCTVAGDGGEGGDFLAALSEDNRQLRRRNSLLLSELAHMKKLYNDIIYFLQNHVAPVTTTTTTPSSTAMAAAQHHLPAAASCRLMELDSPDHSPPPPPPKTPATDGGDTVKLFGVSLHGRKKRAHRDDDDGVHDQGSEV

SEQ ID NO: 19568 - protein, 411 aa, synthetic construct
MESVPESVPSPNSNTPSIPPPVNSVPPFLSKTYDMVDDPLTNEVVSWSSGNNSFVVWSAPEFSKVLLPKYFKHNNFSSFVRQLNTYGFRKVDPDRWEFANEGFLRGRKQLLKSIVRRKPSHVQQNQQQTQVQSSSVGACVEVGKFGIEEEVERLKRDKNVLMQELVRLRQQQQATENQLQNVGQKVQVMEQRQQQMMSFLAKAVQSPGFLNQLVQQNNNDGNRQIPGSNKKRRLPVDEQENRGDNVANGLNRQIVRYQPSINEAAQNMLRQFLNTSTSPRYEFSRGRTRNNYGSTIEGLLDLPDDDDAPAEAGLVAPRMSFLSAGQRPRRLSTTAPITDVSLVDELRLDGEEVDMTPADALDDFDLEMLGDVESPSPGMTHDPVSYGALDVDDFEFEQMFTDALGIDDFGG

SEQ ID NO: 19569 - protein, 337 aa, Spinacia oleracea
MVVLSHVALDQFMKTCKPIDTHLFPTVIPTIDLNSPDVKSLIVKACKEFGFFKVVNHGVPIEMTRQLEDEASKFFSLPQGLKESAGNPNPFGYGNKKIGRNGDVGWIEYLLLSASDEFISQTCLSIYPDNPDVFRCALNNYISKMKKMGVRVLETMAEGLNLKGEDRYALSNLIKDSKSDSYFRLNHYPPRPEAFEGINGRNLVGFGEHTDPQIISVLRSNKIGGLQISLNDGTWVSVPPDDNSFFILVGDSLQVMTNGRFKSVKHRVLADNMKSRLSMIFFAGPPLCQKIAPLPCIMQKGEESLYEEFTWCEYKKSAYKSRLSENRLLRFVKRNHN

SEQ ID NO: 19570 - protein, 329 aa, Spinacia oleracea
MVVASPNPLKRSKKTKAMGVPTIDLSLKYQQRSTLTDLIVEACEDFGIFKVVNHGISTEVISALENHGLDFFSKPTPEKHLVVGPTVPKPFGYGFRNIGNNGDVGDLEYLLLHANLSSTHPPLFGEAVDDYVGAVADLSCELLDLMAEGLWVSDKTIFSKLIRDVQSDSLLRLNHYPPLKNKDSFINGSGERIGFGEHSDPQILTILRSNDVGGLQICMPDGLWVPVQPDPNAFYVMVGDALQVLTNGRFGSVKHRAMANNSTTKARMSMNFFGAPPLNATISPIQEMVSPMNPNLYKPFTWGEYKRAMHSSRLSDCRLNLFKRRINDQ

SEQ ID NO: 19571 - protein, 240 aa, synthetic construct
MNSFSAFSEMFGSDYEPQGGDYCPTLATSCPKKPAGRKKFRETRHPIYRGVRQRNSGKWVSEVREPNKKTRIWLGTFQTAEMAARAHDVAALALRGRSACLNFADSAWRLEFSRGRTRNNYGSTIEGLLDLPDDDDAPAEAGLVAPRMSFLSAGQRPRRLSTTAPITDVSLVDELRLDGEEVDMTPADALDDFDLEMLGDVESPSPGMTHDPVSYGALDVDDFEFEQMFTDALGIDDFGG

SEQ ID NO: 19572 - protein, 141 aa, Oryza sativa (japonica cultivar-group)
MEDDKSKEGKSSSSYRGVRKRPWGKFAAEIRDPERGGARVWLGTFDTAEEAARAYDRAAFAMKGATAMLNFPGDHHHGAASRMTSTGSSSSSFTTPPPANSSAAAGRGGSDRTTDKVELECLDDKVLEDLLAETNYRDKNY

SEQ ID NO: 19573 - protein, 489 aa, Citrus unshiu
MWGRQREASMMYKRTSSRDRSSTFDVEETTALVQNGTEVENTNPSWKLSFPHVLVATLSSFLFGYHLGVVNEPLESISLDLGFNGNTLAEGLVVSMCLGGAFIGSTLSGWIADGVGRRRAFQLCALPMIIGASISATTRNLIGMLLGRFVVGTGMGLGPTVAALYVTEVSPPFVRGTYGAFIQIATCLGLMGSLLIGIPVKEIAGWWRICFWVSIVPAAILCLAMVFCAESPHWLYKKGRTAEAEAEFEKLLGGSHVKSSLAELSKLDRGDDGDIVKFEELLYGRHFRVVFIGSTLFALQQLSGINAIFYFSSSVFKSAGLSSGLANVFVGIANLLGSVVAMVLMDKLGRKALLQWSFFSMAVSMAIQVAASSSYIPGSASLYLSVGGMLMFVLTFALGAGPVPSLLLPEIFPSRIRAKAMAVCMSVHWVINFFVGLLFLRLLEQLGPQLLYSIFGTFCLMAVAFVKRNVVETKGKSLQEIEIALLPQE

SEQ ID NO: 19574 - protein, 201 aa, Heliobacillus mobilis
MNHPPKIIAVMSGKGGVGTSTITALLGAGLTKAGLQTGVLDADAVGPVIPMMFGMTQVMERRGRKLHPSVSRDGLQIVSAGLLPEKPVDLSADAPDKVIQAVIPHVQWAPLNVLLIDMPAGFNDVHRFLFDELPVAGVVVVTSQRELDRLAVRNVMSILARRAVPILGVVENGGETECPSCSSPIALVIKRNIAEDSEVCS

SEQ ID NO: 19575 - protein, 257 aa, Heliobacillus mobilis
MHLRGRVDKMGVDLRTALVTGASRGIGRAIALQLAADGFAVAVNYAGSEAKANEVVEEIISAGGKAFAIQGDVSRSDQVDEMVQKVLAEFGRIDVLVNNAGITRDNLLMRLKEEDWDAVLDTNLKGLFLCSKSAIKPMIKQRSGRIINITSVVGQMGNAGQGNYAAAKAGVIGLTKTLAKELGSRNITVNAVAPGYIQTDMTDKLSDEVRESLAKTIPLGRLGQPEDVAKVVAFLASESAKYITGQTINVDGGMVMA

SEQ ID NO: 19576 - protein, 434 aa, Heliobacillus mobilis
MEGFCVSVIAEVYAREILDSRGNPTVEVEVVLEDGTVGRAAVPSGASTGAYEAVELRDGDKERYLGKGVLNAVDNVNTEIAPEIIGWDVTRQMEIDSALIELDGTPNKGRLGANAILGVSMACAKAAAQYQGLPLFQYLGGVFARELPVPMMNILNGGKHADNNVDIQEFMVMPVGAQSFSEGLRMGVEVFHSLKKVLQSKGLNTAVGDEGGFAPNLKSNEEALKVILEAVQAAGYKAGEDILLAVDAAASEMYKDGKYHLEGEGKVMTSAEMVDFWEDLVNRYPIISIEDGLNEDDWDGWKLLTDRLGKRAQLVGDDLFVTNTEKLSKGIETGVGNSILIKVNQIGTITETLAAIEMARRAGYTAVISHRSGETEDATIADLAVAVNAGQIKTGAPSRTDRVAKYNQLLRIEEELDEQATYRGKKTFFNLERR

SEQ ID NO: 19577 - protein, 425 aa, Heliobacillus mobilis
MNNDFKEASSVESMIRDISLAPKGQLKIDWVAQHMPILNQLKKDFEKRKPLAGKRVIICLHLEAKTAYLALTVKAAGAEVAVCGSNPLSTQDDVVAALVQNGVTAYAWYGATDEEYKMHLNKALDFQPDILIDDGGDLVATLHAERPEQAKKIIGGAEETTTGILRLKALAKEGHLSFPMMAVNDAQMKYLFDNRYGTGQSVWDAIMRTTNLVVCGKVVVVGGYGWCGKGVAARARGLNARIVVTEIDPVKANEALMDGFEVMPMVEAAKIGDVFVTVTGNRDIVRREHLEVIKDKAILCNAGHFDVEVNKEDLRALSTSVRIARNNIEEYTFRDGRKVYLLGEGRLVNLACGDGHPAEVMDLTFALQAMSLEYVFTNREQLEPKVYPVPEEIDRKVAQLRLQALGVSIDELTEVQSKYLNSWQE

SEQ ID NO: 19578 - protein, 500 aa, Heliobacillus mobilis
MVKDEGYLWKGDVAVLRDLGMIREGLTFDDVLLVPAKSEILPREVETSTWLTRRIRLNIPLMSAGMDTVTDSRMAIAMAREGGIGVIHKNMTIDQQAHEVDRVKRSEHGVITDPIYLTPKHKINDALAIMERYHISGVPIADEEGKLVGILTNRDLRFETEFSRPISDVMTKDNLVTAPIGTSLKEAKDILRNHKVEKLPIVDVEGHLKGLITIKDIQKARQFPNSTKDERGRLRACAAVGVTVDTMERARALVAAGVDALVVDTAHGHSRGVLNAVEKLKGEFPQVDIIAGNVATYEATIDLINAGADCVKVGIGPGSICTTRVVAGIGVPQITAIADCARAAREKNVPIIGDGGIKFSGDVVKAIAAGANVVMIGSLLAGTEESPGDIEIYQGRSFKVYRGMGSLGAMKEGSKDRYFQEDDKKLVPEGIEGRVPYKGSLSDTVFQLIGGLRSGMGYCGCRNIDELMTRTQFIRITAAGLRESHPHDVTITKEAPNYSL

SEQ ID NO: 19579 - protein, 102 aa, Bos taurus
LILPGFIDFTADEVDLTSALTRKITLKTPLISSPMDTVTEADMAIAMALMGGIGFIHHNCTPEFQANEVRKVKKFEQGFITDPVVLSPSNTVGDVLEAKMRH

SEQ ID NO: 19580 - protein, 353 aa, Arabidopsis thaliana
MSDAQKFQLGTIGALSLSVVSSVSIVICNKALISTLGFTFATTLTSWHLLVTFCSLHVALWMKFFEHKPFDPRAVLGFGVLNGISIGLLNLSLGFNSVGFYQMTKLAIIPCTVVLETIFFRKMFSRKIQFSLVILLLGVGIATVTDLQLNMLGSVLSLLAVITTCVAQIMTNTIQKKYKVSSTQLLYQSCPYQAITLFVTGPFLDGLLTNQNVFAFKYTSQVVFFIVLSCLISVSVNFSTFLVIGKTSPVTYQVLGHLKTCLVLAFGYLLLKDAFSWRNILGILVAVIGMVLYSYYCTLETQQKATETSTQLPQMDENEKDPLVSAENGSGLISDNGVQKQDPVWNSNKDFQA

SEQ ID NO: 19581 - protein, 519 aa, Arabidopsis thaliana
MEDIQEEENGTDEEVLGSSLTMEKVAAAKQYIENHYKAQNKNIQERKERRWILERKLASSGVPKEEQINMIKDLERKETEFMRLKRNKISVDDFELLTIIGRGAFGEVRLCRERKSGNIYAMKKLKKSEMVMRGQVEHVRAERNLLAEVESHYIVKLYYSFQDPEYLYLIMEYLPGGDMMTLLMREDTLREDVARFYIAQSVLAIESIHRYNYIHRDIKPDNLLLDKDGHMKLSDFGLCKPLDCRNLPSIQENRATDDETMSEPMDVDRCFPDTDNKRSWRSPQEQLQHWQMNRRKLAFSTVGTPDYIAPEVLLKKGYGMECDWWSLGAIMYEMLVGYPPFYADDPISTCRKIVHWRNHLKFPEDAKFSSEAKDLICRLLCNVDHRLGTGGGAQQIKDHPWFKDVVWEKLYEMEAAYKPEVNDELDTQNFMKFDEVNSPAPERTRSGLSRKMLLAPKDLSFVGYTYKNFDAVKGLRHSLEMARTMSLDRSPAEAMPVELISGEAAEAQMVSSMDDPMII

SEQ ID NO: 19582 - protein, 417 aa, Malus micromalus
MAAKESNSAAAAASSDGKIKRMLTHGGRYAQYNVFGNLFEVSSKYVPPIRPIGRGAYGIVCAAVNAEAREEVAIKKIGNAFDNRIDAKRTLREIKLLRHMDHENVIATKDIIRPPQKENFNDVYIVYELMDTDLHQIIRSNQPLNDDHCRYFLYQLLRGLKYVHSAGVLHRDLKPSNLFMNANCDLKIGDFGLARTTSETDFMTEYVVTRWYRAPELLLNCSEYTAAIDIWSVCCILGEIMTRKPLFPGKDYVHQLRLITELLGSPDDSSLGFLRSDNARRYVRELPQYPKRSFSLGFPNMSPSSIDLLEKMLIFDPNRRITVDEALSHPYLAPLHDINEEPVCPMPFNFDFEQPSFTEENIKELIWRESVRFNPESHFSMDHDIICCILLQTNLKTDCNDMFVDTVIVECVKGVDS

SEQ ID NO: 19583 - protein, 236 aa, Photobacterium phosphoreum
SISNCGDWREYCNYLLNSFDFEKEVMEYFADLFKIPFEDSWGYVTNGGTESNMFGCYLGRELFPDGTLYYSKDTHYSVAKIVKLLRIKSQLVESLPNGEIDYDDLIAKIKQDDEKHPIIFANIGTTVRGAIDDISKIQAMIGELGIKREDYYIHADAALSGMILPFVDEPQGFNFADGIDSIGVSGHKMIGSPIPCGIVVAKKRNVDAISVEIDYISAHDKTITGSRNGHTPLMMW

SEQ ID NO: 19584 - protein, 236 aa, Photobacterium damselae
SITNCGDWSEYCNYLLNSFDFEKEVIEYFAHTFKIPFDKCWGYVTNGGTEGNMFGCYLARELFPDSTLYYSKDTHYSVAKIVKLLRIKSQVVESLPNGEVNYDDLIKKIEQDGEKHPIIFANIGTTVKGAIDNIFEIQDRIAKLGIAREDYYIHADAALSGMILPFVDEPQGFNFADGIDSIGVSGHKMIGSPIPCGIVIAKKENVDQITVEIDYIAAHDKTITGSRNGHTPLMLW

SEQ ID NO: 19585 - protein, 236 aa, Photobacterium damselae
SISNCGDWSEYCNYLLNSFDFEKEVIEYFAHTFKIPFDKCWGYVTNGGTEGNMFGCYLARGLFPDSTLYYSKDTHYSVAKIVKLLRIKSQVVESLPNGEVNYDDLIKKIEQDGEKHPIIFANIGTTVKGAIDNIFEIQDRIAKLGIVREDYYIHADAALSGMILPFVDEPQGFNFADGIDSIGVSGHKMIGSPIPCGIVIAKKENVDQITVEIDYIAAHDKTITGSRNGHTPLMMW

SEQ ID NO: 19586 - protein, 106 aa, Brassica rapa subsp. pekinensis
QGPQTYPMHIPMLVPLGSSITRSLSHAPDENSHHPHTVAGDHQSFPDHIMSSLLQTPALYTAASFASTFWPPDTSVGPQGNNLTPNLAAMASATVAAASAWWAANG

SEQ ID NO: 19587 - protein, 99 aa, Brassica rapa subsp. pekinensis
SFLFNLNDQFVLDAYGKGDKLKFANHSPEPNCYAKVIMAAGDHRVGIFAKERILAGEELFYDYRYEPDRAPAWARKPEASGSKKDENVTPSVGRPKKVA

SEQ ID NO: 19588 - protein, 113 aa, Araneus ventricosus
MGSSAFEVLTFFLKDYKANTPQKLKIIDAYLLYILLTGINQFLYCCLVGTFPFNSFLSGFISCVASFVLGVCLRLQVNPQNSSNFCGIPPERAFADFIFAHVVLHLVVMNFIG

SEQ ID NO: 19589 - protein, 321 aa, Oryza sativa (japonica cultivar-group)
MSDGGAGAKGAGFGMPRVGMGTAVQGPRPEPIRRAVLKAIEAGYRHFDTAAHYETEAPIGEAAAEAVRSGAIASRADLFITSKLWCSDAHRDRVLPALRQTLWNLQMEYVDLYLVHWPVSMKPGRYKAPFTADDFVPFDMRAVWEAMEECHRLGLAKAIGVCNFSCKKLDTLLSFATIPPAVNQVEVNPVWQQRKLRELCREKGVQICAYSPLGASGTHWGSDSVMASAVLRDIAQSKGKTVAQARHVCLRWVYEQGDCLIVKSFDEARMRENLDIVGWELTEEERQRIAGIPQRKINRALRFVSDHGPYKSLDDLWDGEI

SEQ ID NO: 19590 - protein, 191 aa, Populus alba
RLVPDTVYLTVNYIDRYPSGNVMNRQRLQLLGVACMMIAAKYEEICAPQVEEFCYITDNTYFRDEVLEMESTVLNYLKFEMTAPTAKCFLRRFVRAAQGIIEAPSMQLECLANYIAELPLLEYSMLCYAPSLVAASAIFLAKYILLPSKRPWNSTLQHYTLYEPVDLSDCVKDPHRLCCGDHNSTLPAIRE

SEQ ID NO: 19591 - protein, 211 aa, Populus alba
AQAAAALENKKQVCVNVEKVPAAGVDGVDAVGRKVAVKKPAQKKVTVKPKPEEVVVISPDSEEVVKQEKPVKKKKEGEGSKKNKPTLTSVLTARSKAACGIANKLKEQIIDIDAADVNNDLAGVEYVEDIYKFYKLVENESRPNNYMDMQPEINEKMRAILVDWLVDVHQKFQLSPETFYLTINIIDRFLSVKTVPRRELQLVGIGATLMA

SEQ ID NO: 19592 - protein, 241 aa, Vibrio vulnificus CMCP6
MTRQVLVTGASKGIGKAIAIQLAKDGFTIVVHYMGDKQGAEQTLAMIEQNGGSGRLIQFDISHRQQCRERIEADIAEHGAYYGVVNNAGITKDTAFPAMTEAEWDGVIHTNLDSFYNVLHPCVMPMVQKRKGGRIVTLASVSGLMGNRGQTNYAAAKAGVIGATKSLALELAKRKITVNCVAPGLIDTGMVDEHVKEHALPQVPLRRMGEPEEVAGLVSYLMSDIAGYVTRQVISVNGGLI

SEQ ID NO: 19593 - protein, 462 aa, Vibrio vulnificus CMCP6
MPNQHQYFGHPRGLFLLFGTELWERFSYYAMRAILVLYLTDTTINGGLGWTTKDALDLYGTYTGLVYITPLIGGYLADNYLGQRRSILIGGALMAIGQFTLALPADALGLGSLHTFYLGLALLIAGNGLFKPNISTMVGDLYQEGDNRRDGAFTIFYMGINLGALIAGVVSGSVTTEFGWKAGFVAAGIGMLISLVMQMALAQSWLGDIGREPAAKRDLAIKKSAQKEALTKEEVDRIKVILVMSLFTIVFWAGFEQAGGLMNIYTQQYTDRMIGSFEIPAAWFQSLNPFFIITLAPVLAVLWVKLGKREPNSPVKFALAMFFLALGFLCMVGAVVEQSGDTSVKTSMLWLVGAFFFHTLGELCLSPIGLSLVTKLAPLRLASLMMGAWFGCNAIANYVAGYVGSHVGELGAFAIFSGIAVTATVSGVILLLFSNQLVHWMHGAESGSSTAEQIEEQQALVS

SEQ ID NO: 19594 - protein, 574 aa, Vibrio vulnificus CMCP6
MISGILASPGIAIGKALLLQEDEIVLNTNTITKAQVEAEVQRFYDARSKSSAQLETIKQKALETFGEEKEAIFEGHIMLLEDEELEEEILALIKKEKMTADNAIYTVIEEQATALESLDDEYLKERATDIRDIGSRFVKNALGINIVSLSDINEQVILVAYDLTPSETAQINLDYVLGFACDIGGRTSHTSIMARSLELPAIVGTNDITKKVKNGDMLILDAMNNKIIVNPSEAQIEEAKAVKASFLAEKEELAKLKDLHAETLDGHRVEVCGNIGTVKDCDGIIRNGGEGVGLYRTEFLFMDRDALPTEEEQYQAYKEVAEAMEGQAVIIRTMDIGGDKDLPYMDLPKEMNPFLGWRAVRISLDRREILRDQLRGILRASAHGKLRIMFPMIISVEEIRALKEAIEEYKAELRAEGLAFDENIEIGVMVETPAAAAIAHHLAKEVSFFSIGTNDLTQYTLAVDRGNEMISHLYNPLSPAVLTVIKQVIDASHAEGKWTGMCGELAGDERATLLLLGMGLDEFSMSGISIPKVKKVIRNANFAAVKAMAEEALSLPTAAEIEACVEKFIAEHSK

SEQ ID NO: 19595 - protein, 621 aa, Vibrio vulnificus CMCP6
MTLDISKYPTLALAETPDELRLLPKETLPTLCDELRTYLLNSVSQSSGHLASGLGTVELTVALHYVYNTPFDQLIWDVGHQAYPHKILTGRREQMPTIRQKGGLHPFPWREESEYDTLSVGHSSTSISAALGMAICAEKEGQNRKVVSVIGDGAITAGMAFEAMNHAGDVHSDMLVILNDNEMSISENVGALNNHLARVLSGNLYTSIREGGKKVLSGVPPIKELVRRTEEHLKGMVVPGTLFEELGFNYIGPIDGHDVVELVKTLKNMRELKGPQFLHIMTKKGKGYEPAEKDPIGYHGVPKFDPAHNSLPKSSGGKPSFSNIFGDFLCDMAAQDPKLMAITPAMREGSGMVRFSKEYPEQYFDVAIAEQHAVTLATGMAIGGYNPIVAIYSTFLQRGYDQLIHDVAIMNLPVMFAIDRAGLVGADGQTHQGAFDLSYMRCIPNMVIMAPSDENECRQMLYTGHKHQGPSAVRYPRGNGMGTPIESEFTALEIGKGRLVRQGEKVAILSFGTFLANALEAAEALNATVADMRFVKPLDEALLRQLANEHDVLITIEENAIAGGAGAGVIEFMMQEKIMKPVLNLGLPDKFIHQGTQEELHEELGLDAKGIEQAIRHYLAK

SEQ ID NO: 19596 - protein, 376 aa, Vibrio vulnificus CMCP6
MTQDKFIKSRAAVAWGPKQPLSIEEVDVMLPRKGEVLVRIVATGVCHTDAFTLSGDDPEGVFPAILGHEGGGIVEMVGEGVTSVSVGDHVIPLYTAECGQCKFCLSGKTNLCQAVRETQGKGLMPDGTTRFYKDGKPIFHYMGCSTFSEYTVLPEISLAKVNKEAPLEEICLLGCGVTTGMGAVINTAKVKQGDTVAIFGLGGIGLSAIIGARMAGASRIIAVDINDRKFELAKQLGATDCINPKEHAQPIQEVIIEMTDGGVDFSFECIGNVNVMRQALECCHKGWGESVIIGVAGAGQEISTRPFQLVTGRVWRGSAFGGVKGRSQLPAIVEQYLAGEFGLQEFITHTMPLEGINDAFELMHSGESIRSVVHFE

SEQ ID NO: 19597 - protein, 593 aa, Vibrio vulnificus CMCP6
MTDKLGFLYLGLGLAAFFFMVYIIFSDIGQIKLGDADEKPEFATGSWAAMLFCGGIGASILYWGTIEWAYYYQNPPFQLEAGSEEAIRWAATYGIFHWGPIAWSIYLIPALPIAYFFYVRKQPVLKISAALMPVIGEARSYGKLGKVIDVLFIFGLLGGAATTLGLAAPLINEGISYLFGIPSTTLSQIGVLLLCTALFAYSSYKGMDGGIKVLSNINFWGALALLAFILVTGPTLFMLETGLDSIGRMLSNFFVMATWAEPFGGYGPFEDTHFPQDWTIFYWAWWLVFAPSMGLFVARISRGRTIKQMVSGSIFFGSMGCALYFMVLGNFGLSLQLSGQLDVVAILNQHGATRAIFAILEQLPLSTVVIAVFTILCIIFTATTFDSISFILASVVQNNVTEDPLRWNRLFWAFTLSLMPSILLFMGGLATLQTAAIVGGLPLLGIAIMLMISGIKAASLDLAHQEGYEDPVINIEEFPDVDPWSREGMALAKFERLKDEAVEAAEQEREALAAIWKLKKVIRSEALSRGESGLELGEAPEEQLTEIQRLTNAAMEAKEHKLQASEAAQAARIEFNELIKEKELQSLQSESLS

SEQ ID NO: 19598 - protein, 487 aa, Vibrio vulnificus CMCP6
MLRIAKEALTFDDVLLVPAHSTVLPNTADLRTQLTKNITLNIPMISASMDTVTEARLAIALAQEGGIGFIHKNMSIEQQAAEVRKVKKFEAGVVTDPVTVSPDATIADVVALTDKHGFAGFPVVTESNELVGIITGRDVRFVTDLSKKVSSVMTPKENLAAVKEGATRAEVQEKMHEARVEKVLVVNDDFQLTGMITAKDFHKAERKPNACKDAQGRLRVGAAVGAGAGNEERVAALVEAGVDVLLIDSSHGHSEGVLQRIRDTRAAFPNLDIIGGNVATAAGAKALIEAGVSAVKVGIGPGSICTTRIVTGVGVPQITAIADAAEVANQYGVPVIADGGIRFSGDICKAIAAGASCVMVGSMFAGTEEAPGEVILYNGRSYKAYRGMGSLGAMSQGSSDRYFQSDNAADKLVPEGIEGRIAYKGRLKEIVHQQMGGLRSSMGLTGSATIEEMRTKAEFVRITGAGMQESHVHDVQITKEAPNYRLG

SEQ ID NO: 19599 - protein, 696 aa, Vibrio vulnificus CMCP6
MATQGLTFHGDSIHIQFEEGLVGLVKRSAEPLNLAEASKHPAFKYFPQLGEETYHSFLGAPIIHRKKVLGVLVIQQKTPRLFSEMEESFLVTLSAQLAVIIAHAQSLGHWSLASKPAAVQGIAASSGVAIGEFWYDNSQPILSEVCPASTLDKEREQEWLAVAIEAALADFRRMRKKFDSEINKDALAIFDLFTHLLNDPMLRTDLKKHVERGDRADWALRQVVESYSSRFARMSDVYLRERAHDIRELGQRLLFFLHNSEQEQPRIERPVILVANELTASLLASVPKKYLLAVVALEGAANSHAAILSRALGVPAVMGANLNLEEVHGKQGIVDGYSGEIYIQPNRQILREYRSLVTEESELFAMVNKELALPAKTQDNVDVEVLLNAGLSADSNIAINAGVDGVGLYRTEIAFLLQHRFPSEDEQYQQYRAILSSYPQQRVVMRTLDIGGDKPLPYLPIEEDNPFLGWRGIRFTLDHPDIFLIQLRAMLRASAEHGNLSILLPMISGVGELDDAIRLIQQAYHEVVLLDERVVMPQIGVMIEVPSMVYLIPSIAQRVDFVSVGTNDLTQYLLAVDRNNARVSDVYESLHPAVLQALQQIYQQCGQYHLPVCICGELAGDPFGALLLLGLGYRSLSMNTSNVARIKYLIRHSQLSDLQALSQQALSLSYGKDIHQLMRDYFINHDFAGFIRAGKK

SEQ ID NO: 19600 - protein, 780 aa, Vibrio vulnificus CMCP6
MKPMKNLAQYYVDLLVKLGIVRFSMLLALALVALAVVVQVGITLVLKGNVDDIDIVRSVFFGLLITPWAVYFLSVVVDQLEESRQRLSKLVSKLKDMRSRDQELNVQLQQNIEQLNQEIEERIRAEEAREEAMKDLENEVFQRERTQVELAERTALLRSFIDASPDLIYYRNAEGVFSGCNRAMEELTGKKEHQLVGLSPWDVYSKEVAQQIVDTDQQVFANNRALTYEQWLEYPDGRKHYFELRKVPFYSKDGRHLGLVGFGRDITERKRHEESLEKASRDKTTFISTISHELRTPLNGIVGLSRMLLDTRLTDEQRKYMQTINVSAITLGNIFNDIIDMDKFDRRKLELLPAPLNFEDFVAEIESISALMAEQKGLRFDLERLSELPKAIEVDATRLRQVIWNLISNAMKFTKEGGVVMTVSSEVEEDFATIIIEVEDTGIGIPEAELDKIFAMYYQVKSGKDNLHAVGTGIGLAVSRQLINMMDGDITVSSEEGFGSTFTISIHVPVIESAPSTVDKPKTQLHLSIFMVEDIALNVTVARSLLESLGHKVTVAMTGDEAIRSFDPSRYDLVLLDIQLPDMTGFDVAAYYRKHYSQLPPLVALTANVLKDKREYLDNGMDEAISKPLAVQAIQDVIEKLIIKQESTTIEMEEAEVVEITTSHVENHILDLVMLESYVEIVGPQPVLDSIRMFEEMMPEYLEILDSNMIAKDQPGIVSEAHKIKGAAGSIGLKRIQSVAQKAQSPDMPAWWENIADWVEEIKNEYQNDIQILKSWLEQR

SEQ ID NO: 19601 - protein, 624 aa, Vibrio vulnificus CMCP6
MDHNPQSQLKLLVIRGKEQGYLTYAEVNDHLPAEIVDSEQVEDIIQMINDMGIKVVETAPDADDLALSDETNITDEDAAEAAAAALSSVESEIGRTTDPVRMYMREMGTVELLTREGEIDIAKRIEDGINQVQSSVAEYPGTIPYILEQFDKVQAEELRLTDLISGFVDPNADETAAPTATHIGSELAESDLEDEDNTDIDDEDEDEDEDGDSSSDSEEDVGIDPEMALEKFTQLRNSYQNLQLAVNEHGRESAQTAQAHELMLDVFKEFRLTPKQFDHLVNELRTAMDRVRTQERLIMKSAVEIAKMPKKSFIALFTGNESNEEWLDQILASDKPYVEKIKLHEEDIRRSIAKLRAIEEETSLSVNNIKDISRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPLPEELAERMQMPEDKIRKVLKIAKEPISMETPIGDDEDSHLGDFIEDTTLELPLDSATATSLKAATKDVLAGLTPREAKVLRMRFGIDMNTDHTLEEVGKQFDVTRERIRQIEAKALRKLRHPSRSETLRSFLDE

SEQ ID NO: 19602 - protein, 338 aa, Vibrio vulnificus CMCP6
MSGMRTLGEFIVEKQADFPHASGDLSSLLSSIRLAAKIVNREINKAGLVDITGAAGVENIQGEVQQKLDVYANEKFKSALEARDQVCGVASEEEDEAVAFNKELNKNAKYVVLMDPLDGSSNIDVNVSVGTIFSIYRRVSPIGTPPTQEDFLQPGHKQVAAGYIIYGSSTMLVYTTGNGVNGFTYDPSLGTFCLSHENMMIPQNGNIYSINEGNYIRFPMGVKKYIKYCQENVPEDGRPYTSRYIGSLVADFHRNLLKGGIYLYPSTQSHPQGKLRLLYECNPMAFLIEQAGGLASDGVNRILDLKPTELHQRVPFFVGSTNMVKKVEEFLEVYRDEA

SEQ ID NO: 19603 - protein, 401 aa, Vibrio vulnificus CMCP6
MQTLAGKKILLGISGGIAAYKCADLTRRLKERGAEVQVVMTKAAKEFITPLTMQAVSGRPVSDSLLDPAAEASMGHIELAKWADLILLAPATADLIARMAAGMGNDLLTTLVLATDAPVAVSPAMNQQMYRNVATQENIATLSRRGMEIWGPAAGEQACGDVGPGRMLEPMQLVALCEQFFQPKPLQDKSILITAGPTREAIDPVRYITNHSSGKMGYALAQAAMQLGANVTLVSGPVSLPTPVNVNRINVDSAQEMYDAVMAQASDHDIFISCAAVADYRPATIAEQKLKKTDDSDEMTITMVKNPDIVASVSAMTENRPFTVGFAAETNDVEVYARRKLEKKKLDLLCANDVSVEGQGFNSSDNAITLYWSQGEKALPLNSKAVLSMEILKQIQTLMGH

SEQ ID NO: 19604 - protein, 421 aa, Vibrio vulnificus CMCP6
MTAEPATAEVVPGFATDVLAFNGAIPAPTIRCRQGEEVIIHFTNKLNEPTTIHWHGLRVPIEMDGVPFLSQKPVMPGESFTYRFTPPDAGTFWYHPHMNSVKQLGMGLVGLIIVDEAEPVSFDEDHALMLKHWHLNEKGEWKSLLVPRLSARMGTPGEWGTVNGVHEPIYPLKANAMTRLRIANVDNTITYPIAIEGVDAWVIAIDGNPIKTPYKLSEHKIGPGMRVDVGLIAPGVGERFYVRQMKGKFPFPLCAFESVESDLLNQNILPTLPLNPIAPLDLDTAEQIDFVFEWEGAVTPMDKSGQALPTFWLVNKRAWEGMSQDSIPAPLATLERGRTYIFNLKNVTQYHHPIHLHGHTFTVLELNGQTLAEPFHTDTVLLGKNGSAKAAFVADNPGRWMYHCHVIEHMKTGLMGYIEVK

SEQ ID NO: 19605 - protein, 417 aa, Vibrio vulnificus CMCP6
MDYFNYQDDGQLWAEEVSLTSLAEQYGTPLYVYSRATLERHWHAFDRSVEGHPHLVCYAVKANSNLGVLNTLARLGSGFDIVSGGELERVLAAGGDPRKVVFSGVGKTEAEMRRALELNIKCFNVESEPELERLNRVAGELGVKAPISLRINPDVDAQTHPYISTGLRDNKFGIAFDRAPAVYQFAQSLANLNVQGIDCHIGSQLTAIEPFIDATDRLLALIDDLKEQGINIRHLDVGGGLGVVYRNELPPQPSEYAKALLGRLENHQDLELIFEPGRAIAANAGVLLTKVEFLKHTEHKNFAIIDAAMNDLMRPALYQAWQDIVPVQPRQGEAVTYDLVGPICETGDFLGKDRSLVLAENDLLAVRSAGAYGFVMSSNYNTRVRAAEVMVDGKQHYLVRQREELRSLWELEHILPE

SEQ ID NO: 19606 - protein, 285 aa, Vibrio vulnificus CMCP6
MTTQAYPMALVTQDSLDGYIRSVNSYPMLTADEERDLAERLHYKGEIEAAKGLILSHLRFVVHVARGYSGYGLPMADLVQEGNIGLMKAVKRFNPEVGVRLVSFAVHWIKAEIHEYVLRNWRIVKIATTKAQRKLFFNLRKSKKRLGWFNNGEVETVARELGVEPAEVREMESRLAAVDSTFDLPNEEDDSSSVSTAPVLYLEDKSSDVADNLEAQNWEAHTNNRLAMALASLDERSQHIVRSRWLDDDKATLQDLAEMYGVSAERIRQLEKNAMKKLKMAVGEI

SEQ ID NO: 19607 - protein, 273 aa, Vibrio vulnificus CMCP6
MKHCEKQKVWQSIVKEARELSEQEPMLASFYHATIIKHESLCAALSYILANKLNTASMPAMAVREVVEEAFAADPNITDSAACDICATVNRDPAVSMYSIPLLYLKGYHALQGYRVANWLWKQGRYALATYLQNQISVACQVDIHPAARIGKGIMLDHATGIVIGETAVVENDVSILQDVTLGGTGKECGDRHPKIREGVMIGAGAKILGNIEVGEGAKIGSCSVVLQPVPPHTTVAGVPARIVGRPQSDKPSLDMDQGFNGKYPNFIDGDGI

SEQ ID NO: 19608 - protein, 394 aa, Vibrio vulnificus CMCP6
MLSENTINIVKSTAPLLAETGPKLTAHFYQRMFEHNPELKDIFNMSNQRNGDQREALFNAICAYASNIDNLPALLGAVEKIAHKHSSFLITADQYQIVGGHLLATIDELFSPGQAVLDAWAEAYGVLANVFIQREEQIYQDNQSQTGGWRGLREFELVEKQYESAHICSFVFKPVDGGSVVSFKPGQYLGIYINDEQFENQEIRQYSLSSSVRPDCYRISVKREEGGRVSNYLHDHLDVGSKVKLAAPAGDFFLDAAPTAPVVLISAGVGLTPTLSMLESLTEHQAPVTWIHATENGQQHAFKQHVKQLVETHPHFNSLVWYNQPNSDDKIGDDFQFSGWVNLHEIETVLKQADVQVYFCGPVGFMQFIAKQLLEMGVPEQQFHYECFGPHKVV

SEQ ID NO: 19609 - protein, 335 aa, Vibrio vulnificus CMCP6
MKRDLAMAFSRVTEGAALAGYKWLGRGDKNAADGAAVEVMRTLLNKTDISGEIVIGEGEIDDAPMLYIGENVGLGGDEVDIAVDPIEGTRMTAMGQSNALAVLAAGEKGSFLKAPDMYMEKLVVGPGAKGVIDLNKPLKENLVNIAQALGKTLDTLVVITLAKPRHDEVIAEMQRMGVRVFAVPDGDVAASILTCMPDSEVDVMYCIGGAPEGVVSAAVIRALDGDMHGRLLPRNEVKGDNEENRKFADFELERCAEMGVEANKVLKLEDMARSDNVIFSATGITKGDLLEGISRQGNIATTETLLIRGRCRTIRRIKSIHYLERKDDEVKAIIL

SEQ ID NO: 19610 - protein, 928 aa, Vibrio vulnificus CMCP6
MTRYGLRARVITLTLAPTLIIGLLLSSFFSFNRYQDLERQVITTGNSIIEPIAIASEPHLLSESREAVRRLVSYAHRKNSNLVRSIAVFDSKHELFVTSNFHPNFESLTYPKDQPIPLLGNAEIRSDTMILRVPVLSEGHYLSDLAEPGEATRAIGYIAVELDLSSLRLQQYQEVFSAFLVLILGLGLASVFASRLMQDVTQPITHMKNVVDRIRRGQLDVRIEGKMHGELDSLKNGINAMAISLSEYHVEMQHSIDQATSDLRETLEQLEIQNVELDIAKKRAQEAARVKSEFLANMSHELRTPLNGVIGFTRQMLKTQLTNSQTDYLQTIEKSANNLLNIINDILDFSKLEAGKLALENIPFDFRESLEEVISLQATSAHEKGLEITLKIDPRIPEGVVGDPLRIQQVLTNLVGNSIKFTERGNIDVSVEMRAQSGDSIDLQFMVKDTGIGISERQQAQLFQAFSQADASISRRYGGTGLGLVITQKLVSQMGGEISLTSRLHQGSTFWFTLRLHSTQMPMSDSIEAEYLQGKELLLVEPNMQAAAVTQQVLTQEGINVTYRSLLPDNAKGYDFVLLSLAVNQVYELETIENWLSRALHISANTILAIPSTELALADQLTERFGIQCLTKPLGRRKLLQSLAAKQTLQPLLPAPENAQAERSSLSVLAVDDNPANLKLITALLAERVVSVTSCSSGQDAVDIATSRQFDLIFMDIQMPKMDGVTACKLIKQTELNANTPVIAVTAHAMSGERDRLLKAGMDDYLTKPIEEHILQQVLIHWNPNTCDSQVEKISPSYIATEESSVQQNIARSSDIIIDWQAALKQSANKEDLAKDMLRMLVEFIPEVESVVELALEQEDYPRDELIHVIHKLHGSSSYCGVPRLKALCATIEQSLRSDADLMDVEPELFELQDEMLKVSTTAQLYLA

SEQ ID NO: 19611 - protein, 433 aa, Vibrio vulnificus CMCP6
MSKIVKVLGREIIDSRGNPTVEAEVHLEGGFVGMAAAPSGASTGSREALELRDGDKARFLGKGVLKAIEAVNGAIADALVGKDAKDQAAIDAIMIELDGTENKSKFGANAILAVSLANAKAAAASKGMPLYEHIAELNGTAGQFSMPLPMMNIINGGEHADNNVDIQEFMIQPVGAKTLKEAVRMGAEVFHNLAKVLKSKGYNTAVGDEGGFAPNLKSNAEALEVIAEAVAAAGYVLGKDVTLAMDCAASEFFDKEAGIYNMKGEGKTFTSEEFNHYLAGLVEQFPIVSIEDGLDESDWAGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALAGRAPFNGLKEVKGQA

SEQ ID NO: 19612 - protein, 330 aa, Vibrio vulnificus CMCP6
MSISNTVTKVKDFDVNQMDDDFNDDIEINEKEDLTEEKVKLREEFDASNKSLDATQLYLGEIGFSPLLTAEEEVLYARRALRGDEAARKRMIESNLRLVVKISRRYSNRGLALLDLIEEGNLGLIRAVEKFDPERGFRFSTYATWWIRQTIERALMNQTRTIRLPIHVVKELNIYLRTARELSQKLDHEPTAEEIAAQLDIPVDDVSKMLRLNERISSVDTPIGGDGEKALLDIIPDANNSDPEVSTQDEDMRVSLIHWLEELNPKQKEVLARRFGLLGYEPSTLEEVGQEIGLTRERVRQIQVEGLRRLREVLIKQGLNMENLFDIDMD

SEQ ID NO: 19613 - protein, 120 aa, Vibrio vulnificus CMCP6
MNAFREDAMKLINAIIKPFKLDDVREALADVGIEGMTVSEVKGFGRQKGHTELYRGAEYQVDFLPKVKLEIATQAENVDRVIEAITKAAHTGKIGDGKIFVYDLSHAVRIRTGETDVEAL

SEQ ID NO: 19614 - protein, 1129 aa, Vibrio vulnificus CMCP6
MFKFYRKQKFKRLQSTLMTAFLVLSITPLTITAIFFLQSHSKDLQEQSTSHLLSVRDTKQQQILDYFQAQETEVMGFVRSELAYASGGRFYGLVNAFKSLGVDMEQARENAQQRYIQGSGDQIKTSILPESSSFVGSERYRLLHKRYHWAYLELLKRSDFDDILLVDLDGNVTYSIYKNENFGTNLIEGPFKESMLGKSFRQLANDVSEKRKQNEDYTPVYISDFSVEDGKQVAWLGAPIIQQGYLHSYAMFRLPNNGITKLIADINKDAAIHTLLVGSDHLPRTMTTKQTDIESSIEVVDKALAGLTDVGTYINSSDEATIAAYAPISFKGQTWALVVQLPEKEAFARIHQLEKLFVIAMLIAIVLVFISSHYLSNFITSPLLKLTWAAERVSAGDLDENMINTERKDEIGRLAISFERMQRSIRDKIQLIKTQNAELEKNLQLIQKQNDELQLADKLKDEFLATTSHELRTPLHGMIGIAETLISGANGPLPSNQRYQLDIIIKSGQRLATLVDDLLDYHKMRYGSLDIQKSAVNLASATRLVLELSHHLLGNKTLRIINQVSNDVAPVSADPQRLEQVLYNLIGNAIKYTTEGKIVISANVVDDKVRVQVVDTGQGIPAEQLEHIFEPLIQAGRDSGRYRQGAGLGLSISRQLIELMGGSLYVSSQPMVGTTFSFTLPLASADEISATEVMQNQHHFQAPDSNELISLDNSSLPENPNGPLLIVADDEPVNLRVLESFLRIEGYRVQTASDGPDTLELIEHEKPALLLLDIMMPGMSGYQVCHQLRQQYDMAELPIIMLTALSQSEDRVRGFEAGANDYLTKPFNKQELAARIKAHLMASKAEARRLENNRLEAELRQRAMVEASLLETQGRLLEQLESAPEAIICIREDKRIRFANDAACKLFKRSLEQLKRSNAEELIAPKYLTVKQQHYCGNIDIYVDDVRQHIETDILKLPEGSGLDAMFIFNVGGGAAASRVHNLETAVEVLSSYAFDGDKERLQSLKELGGEFTRLADKALGTNKNKQELMREVLVDLMTHALDYWESVTGENKFTFAEQSGLWRVYLDRSTLQTRTLDKYMRIETLPKTPRWRTVLSSIEYILEHCKEQSPERTYIEMQRDKLQRLLTS

SEQ ID NO: 19615 - protein, 402 aa, Vibrio vulnificus CMCP6
MQKLTILGATGSIGASTLKVIEQNPDKFSVVALAADSNVEKMQQLCQRWQPEYAVMANKEAALRLKMALAVLAPNTQVLGGQEALCYVATLEQVDSVMAAIVGAAGLVPTMAAVKAGKRILLANKEALVMSGQLFIDEVEKSGAQLLPVDSEHNAIFQCLPQTVQGNLGRCDLASQGVSHILLTGSGGPFRYTDVAELEAVTPEQAIAHPNWSMGPKISVDSATMMNKGLEYIEAKWLFNASRDQLKVIIHPQSVIHSMVQYLDGSVLAQMGEPDMATPIALTLSYPERVKAGVKPLDFTQVGELTFLQPDFERYPCLALAIEACYLGQHATTTLNAANEVAVAAFLARQIKFTDIARVNDSVLNQVCKQSLASGLDSLESLLELDRMARTLADEVVRERAQ

SEQ ID NO: 19616 - protein, 114 aa, Vibrio vulnificus CMCP6
MNMKKIEAIIKPFKLDDVREALAEVGITGMTVSEVKGFGRQKGHTELYRGAEYMVDFLPKVKLEIVVTEDVADKCVETIIETAQTGKIGDGKIFVTNVERVVRIRTGEEDEDAI

SEQ ID NO: 19617 - protein, 773 aa, Vibrio vulnificus CMCP6
MVEPPVRSNIERNLDLRTELLASQIKSPFNRAVGVLNSLVGVAQSQQKGTNQPQILGRIIASSDQVIASGGVWPEPQQIDGSLRYVSLFFNKGEDGRIEQIHSYNNPESSGYHTESWYLSVVNLPENSVAWSNVYTDPYTQVQMITASQPYFIDGEFAGVATVDISLETLFDFVKGHTEKYQLGVSISDPGGKLLLEHAFHLTRDRYISEIEVADIGWRVRVINSQLTVSDEVFGQVMRVEAGILPFLLICVLVGYYTLNRYVIKPIISIAKKVDVSKTGGIIDIHYDSEDEIKHLIETINEKTVYLEAEKVKAQASTNAKTAFLATLSHEIRTPMNGVLGTAQILLKTPLNEEQRKHLKTLYDSGDHMMTLLNEILDYSKIEQGHMEFDNNPFPFDSIIGSVNSVYYTLCAEKGLQFKVYTTVPTGRWYCADKARLRQVLFNLLNNAVKFTARGLVEVYFEEHTREQANYLSIKVKDTGIGIPESAQKRIFRPFEQAESSTTRRFGGTGLGLAIVKQIAEQMGGSVAVSSQVGLGTCFTVELALECTSPETESPEPRYKLNYQGLRALIVEDNRTNAIIIETFLRNKGFSCERVENGEQAIACVTQHPFDLILMDNHMPVMDGIEAITAIRAMDSPCRHTLIFGCTADVFKETRERMLGVGADHIIAKPIVEAELDDALFQHAKLLYQFRAEDVQAQVEEQSIESLLVGFYIAIENGELTQAHNAISQIRGQHKDAIEPALAQSLARIEQQLSENKQPDQEEINLLTVLLAD

SEQ ID NO: 19618 - protein, 523 aa, Vibrio vulnificus CMCP6
MTKGIDKYSIDSTDYTVGQDNVQRWGFDVHNPVFGISAGLVGLFLVAALVLDAHTMKTALDGIKWQIIGAFDWLFIWSGNIFVIFCLALIVSPLGKIRLGGRDAVADYSFLSWIAMLFAAGMGIGLMFWSVAEPVAYFTGWYETPLNVTPNSPEAAKLAMGATMFHWGLHPWAIYGVVALSLAFFTYNKGLPLSMRSIFYPLLGDRAWGWAGHLVDILAVVATLFGLATSLGLGAQQAASGIHHVFGVEAGLGLQIAVITVVTLLAVVSVVRGIDGGVKVISNINMLVAFALLALVGLIGWAVSVGSVSTTLSAYIENIIPLSNPIGREDEAWFQGWTVFYWAWWISWSPFVGMFIARVSKGRTVREFMTAVLIVPTVVTLLWMSVFGGMAIDQVINGIGELGAKGLTDVPLAMFQMFDQLPYGTLLSVIAVVLVLVFFITSSDSGSLVIDSITAGGKVDAPVLQRVFWAFMEGAIAVALLWVGGTEAIQALQAGAISTALPFTFILLAMCVSLLMGMRTEKQ

SEQ ID NO: 19619 - protein, 571 aa, Vibrio vulnificus CMCP6
MDDSLHLNRKLQRAIASRKEAERLLEEKSLELYQSNQQLKLALKQLELKSEQQLFKFEFEQQIDDTLITFGRVFIVDGIDDLLLANLLERLSRASVIRQAWLKLDKPILTTLKSLEYGLKPTGFLYRADDTRTRAEWFGDALCIPIILESEHVGSMVFTIDHFDIDLDFISNQLCLIADLVSNALNRQLWMERETELRKRAEESEKATKEFVAMINHELRTPLNGVLGSAELLGNTYLNDEQQLYLRNLRQGGELLRVIINDLLDFSKMNAGMMEIVPKVFRWREVEESIVGIFAAKASEKQIGFHIEKQFGMPSCVCGDVERIKQILVNLIGNAIKFTQHGAVTFRTHWQDDVLSVEIEDTGIGIAEQAKSTLFDPFVQADRSSKRNYEGSGLGLAICQNLCHLMGGEIGFRSELGQGSCFHFAIPLPASDEPLLEPHTEQVERHQLDWVALKVLVVDDIRMNQVIINQMLKKLQVTPDVRNNGVEALQAVSQQDYDFIFMDCRMPEMDGYEATHYLREQGLAIPIVALTAGTTLEEREKCLVSGMNDILTKPYTADDVERIMLKWLVSG

SEQ ID NO: 19620 - protein, 483 aa, Vibrio vulnificus CMCP6
MVFADRKRPNVPRTLSIFIFFLNIGVNVHRYKKEASNLIKLATPVLIASVAQTGMGFVDTVMAGGVSATDMAAVSVAASIWLPSILFGIGLLMALVPVVAQLNGAGKREQVPFEIQQGAVMALLISIPIIGVLFQTQWILGYMNVDAVMATKTIGYIHAVMFAVPAFLLFQTLRSLTDGLSLTKPAMVIGFIGLLLNIPLNWMFVYGKLGAPALGGVGCGVATAIVYWIMFLLLLFYVTTSHRLRQVQLFTTFHPPQLNAQVKLFKLGFPVAAALFFEVTLFAVVALLVAPLGSTVVAAHQVAINFSSLVFMLPMSIGAATSIRVGHMLGEKSTEGARIASHVGILVGLSTAVFTALLTVILREQIALLYTDNRVVITLAMQLLIFTAIYQCTDAIQVIAAGALRGYKDMRAIFNRTFIAYWLLGLPTGYVLGLTDWIVEPMGAQGFWIGFIVGLSSAAAMLGVRLHWLHRQNDEIQLNYEAR

SEQ ID NO: 19621 - protein, 574 aa, Vibrio vulnificus CMCP6
MKVNNMTTFEKEALHDALVELKKSRELEKRLAEENKAILSAISAMSEAKNRHEIFLGLNNVLKKYINFDDFVVLTRHCDKESFATLLTTNQVFNNTTWCDGKKFSRVLNGECIILFEPTELSEFKQLNSFIKSHINSVLLTGIDAQVTQSVILLIGNTKGQFSIEAKETLKRFLPLIERAVIDIENKEKLQRIVELRTRELALAREESERANRAKSEFLAMMSHELRTPLNSVLGMLDVLKQSDMSAGHINLLSHMESSAGLLLAIISDILDLSKIESGEFSLSPQWININDTVTFVVSQQQLVAATKGLNIELSIELDDKRHYWLDPSRLSQVLFNLIGNAVKFTQQGQIDIRVNLENDELSISVIDTGIGIEKDKISSLFTAFKQADSSITRKFGGTGLGLAITKHLVELMSGTVRVSSQFGKGSTFVVKIPVKSRKLIRLSQDGTTNKRDRALNVLVVEDTHSNQMVIQLLLNKLGHNVFIANNGSEAIEFIESNTESLDVVFMDVSMPVMDGLTATKILRAKGFEVPIIALTAHALASDKQNCLDVGMDSFVAKPVRKQELANAIEALIV

SEQ ID NO: 19622 - protein, 762 aa, Vibrio vulnificus CMCP6
MSFRIKTIIGIACIEIIMLMLLVFSAMNFMRQSNQEQFIQKANATSQMFARASKDALLSLDLATLDDLTQEILSLPDILYVDIRNNDQQLAFAGALPKVSADWQADDHVSLGDLVFDVSEKITVDGLTYGEIRMGFNTTAIQTALDEASKAIVLIAVLEIILVALFSYFLGSYLSQNLYQLTRAAERVANDGPGFQLQLKAKDEIGKVAAAFDSMSHNLATSYQELEQARTQAELANESKSRFLASMSHEIRTPMNGVLGLLGILGETKLDNHQQNLVHTAKESGELLLSIINDILDFSRMEANTLILYPRPFELKSCVEEIVNSFEPLAKTKGLYLSLTFNDECDYVVVGDSNRYRQVLLNLLGNAVKFTQKGSVSLHVTTQNEGDKLYIRCEINDTGIGIAPDAMAILFEEFTMVDQGYSRTREGSGLGLAICKRLAQLMEGEINVESEVGKGSCFVFSVEMPLAEHDTVTQQAQPDNDSVCTLLQGKRILVAEDNTANQMVIKAMFERLGVAIDLANDGYEAVSMASNHHYDIIFMDISMPGKDGMQACKEIRQLPDAKQAATPIIALTAHALYGDKEKFLRSGMNGYLSKPLRSRHLIEELNNILSASNHHDTAHKPLETEKTNHMQITLTSEKNTTAPLVDELIIQQMIRDTSAEVMPMLIEHYIEESERRLVKIDQAIAHSDFQQLEFELHTLGSSSLALGNRRLSNLARKLERLCVAKEYDAVMEDASGIAQLAHDSLSALNERKQLGFVEPNSI

SEQ ID NO: 19623 - protein, 397 aa, Vibrio vulnificus CMCP6
MTTRTPILFVHYGDNWIRGSETTLIHLLATLDTQQFEPIVWSNCQPLLDHFAQCGITTYQDPFSVLGVIGANKFNPLNTMKLVARAITLIQRHHVSLIHVNSGAPCQWMSIAARLCHCPQLLQLHGDYPLRERFLMGFHLADKIVCVSNAISQAMQSEGLTLPQLSVVHNGVGLPSSSLDTSLKTQLSIPRQAFTFITIGSLIARKGVDRLLKALYLLKKNGEKAHLVIIGDGPERITLKHLSETLGLSEQVHWLGEKANAAMWLKSDADAFVSGAYQEAFGLVIAEAMMAELPVIAPRTGGIPEFVSHNRNGLLYHNSGVFSLVQAMQTLMLNPALSHKLKQTAYVDAHENLTIHCNTQTLQAHYLALMKRDQPAPQWRAMLRPLLYFFRRKELLS

SEQ ID NO: 19624 - protein, 368 aa, Vibrio vulnificus CMCP6
MNKDKPRKTIFHVVQHLAPGGLETLVLDMMNVCSTDHDVYIISLEGTKQDAVLHWPKLRKYARQCVFLDKGTGIRVQTIHYLVKLFRQFSPDVVHTHHIGPLLYGGIAARLSGVACRIHTEHDGWHLTQTKNALLQTWALKLVQPILVADATEVKLSIEQHLHHENIITIKNGIDCDYFAPADKTWARKQLDLPLDKRIVGCAGRLESVKGQQWLIQALPMLPHNVHLAIAGHGSLRQELERLVFTMQLQDRVTFLGLCCTMPTFYQSLDLFCLPSLNEGFPLSTLEAQACNVPVVATSVGGTHETLCPHLSRLCPPADAAALAQEINALLVMDRSAFAHTLRDFVVRHHNIRHMVAQYNQLALGASL

SEQ ID NO: 19625 - protein, 248 aa, Vibrio vulnificus CMCP6
MTDLLNLSGKVALVTGASRGIGRAIAETLVARGATVIGTATSENGAAAISEYLGENGKGFALNVTDAESVESVLKAINDEFGAVDILINNAGITRDNLLMRMKDDEWNDIMDTNLTSIFRLSKAVMRGMMKKRDGRIINVGSVVGTMGNAGQANYAAAKAGVIGFTKSLAREVASRGVTVNTVAPGFIETDMTRALNDEQRATTLANVPAGRLGDPREIAEAVVFLASPAAAYITGETLHVNGGMYMV

SEQ ID NO: 19626 - protein, 359 aa, Vibrio vulnificus CMCP6
MHQFTSKQDFCHWLNQFEHETLAPRWSEVHGVVMVQADGTFAIQLPFAAQQLQDALSEWIVQQQQRGAVPPFAFTVGQQVKALETQVSQSVRGVKNIIAVTSAKGGVGKSTTAVNLALAIASQGAKVGLLDADIYGPSLPIMLGSVDQRPDVRDGKWMQPILAHGIYTNSIGYLVDKNEAAIWRGPMASKALSQLLNETEWPDLDYLVIDMPPGTGDIQLTLSQQIPVTTSVIVTTPQDLALADAKKGAAMFEKIGVPVAGIVENMSYHICSQCGAKEHIFGQGGAVQMAQQFGLSLLAQVPLHISVREDLDSGVPTVVARPDSEHGRIYRQLALQICSSMYWNGKAKPETILFTRIDG

SEQ ID NO: 19627 - protein, 718 aa, Vibrio vulnificus CMCP6
MAMITICPETLPIGWLSITQEGWIEAYNQQAQSCELWHQPLMVGEALTCVHPSRIFYEWVKQLSAQSPPLSIMSTRATHWTLSASPRTQGGFDLWLQEAVCDDALRDENTRLRRDIERLDFAAQGANLGIWDFNPSTGCIFGNKTWATQKKLEPNHLFADDALFSEIINGIEKWSEIVHPDDVAETTDKIQAHLDGETELYHAEFRVRCGDGQWKWILDLGRVFERDQDGVPVRMNGIHVDIDKLKRLQQSLSETKDKAEVANRAKSIFLANMSHELRTPLNAVLGYTQLMKCDQRLTAKHHEYLEIINRSGEHLLSLINDVLDMSKIDAGHSVVERKWFNFREVSEEINDLMQMKAMQKQLTLHCRVEDSVPHFVLGDVVKTRQVLINLLGNAIKFTYRGNVRLNIASEALQNGQHKVTFEVSDSGIGISEENQERVFQPFEQLDSDITQNGTGLGLSISKQFVELMGGQLVLKSELHRGSTFSFSLVMETSEHLVENKPANLPRVLGLKSGSFSPKILIAEDQLDNQTLLATLLQEAGFTVKLARDGEEAVALHKSWGPDFIWMDRRMPKKDGLQATKEIRAASENSQVKIVALTASVFNDEIEEMLASGMDDFARKPFMPQDLFYMMKKHLDLEYDYEQRQDEAENTSFDDLDLSFLDDLTHESTQDIVEAIEQGQQQELYYLFEQTIANSEVRTRLNSLVENYQFDELYELFQE

SEQ ID NO: 19628 - protein, 796 aa, Vibrio vulnificus CMCP6
MFLEKDMQKNTLWFNSLSMEDVDKVGGKNASLGEMVSNLANAGVSVPNGFATTSYAFNQFLDYEGLDERIHQLLDELDVDDVDALRKTGATIRQWVLEAPFPADLEQDIRENYSTLTDGNDEISVAVRSSATAEDLPDASFAGQQETFLNVRGIDAVLEATKHVYASLFNDRAISYRVHQGFDHRGIALSAGIQRMVRSDKAASGVMFTLDTESGFDKVVFITSAWGLGEMVVQGAVNPDEFYVHKPLLEAGQAPIVKKTFGSKLSKMIYANSQVIGKQVEIVDTSEAERNQFSLTDAEIVELAKQAMIIEKHYQRPMDIEWAKDGIDGQLYIVQARPETVCSQSDANVIERYELSHKAEVLIEGRAIGQRIGSGVVRLVDSLDQMSLVQTGDVLVTDMTDPDWEPVMKKASAIVTNRGGRTCHAAIIARELGIPAIVGCGNATSQLTDGDLVTVSCAEGETGYVYQGQLDFEVRRSSVDELPMLPTKVMMNVGNPDRAFDFAQIPNEGVGLARLEFIINKMIGIHPKALLNFDQQSESLKAEITQRIRGYQDPIDFYVSKLTEGIATIASAFWPKRVIVRMSDFKSNEYSNLVGGKAYEPHEENPMLGFRGASRYISPVFEDCFELETQAIKRVRNEMGLKNVEIMIPFVRTPSEAAQVVDLLAKFDLRRGEQGLKVIMMCELPSNAVLADEFLKYFDGFSIGSNDMTQLTLGLDRDSGDVAHLFDERNPAVKAMLKMAIDAATKAGKYVGICGQGPSDHEDFAEWLMEQGISSVSLNPDTVIDTWIQLGKANHK

SEQ ID NO: 19629 - protein, 1072 aa, Vibrio vulnificus CMCP6
MTESISLTLTNNESSRFLIRQRLLSILQAFGYDACRCDIHMLRLGEFVRITLADIQRFTLSFELDDDSLKVILASSELDPQTCSFPACVHTFQREKAIGVSIPSLIPLSDEILNQLTQFLAKPSRDELMSELKAKNQELAVHQAGLEKEIELRTADLKASEELSRTIIDGAPSSVAIVDESLSISLWNSTAQNVYGYSSEEATGENILTLLNMSLPDALSHVLSAPLALQNQPDVEGGFFEVETTTKEGHMVPIDLGVSIFELNGACHAALFLRDVTSRKAVEKELNDAKAKAEEAVEVKSMFLANMSHEIRTPMNAIIGMSHLALKTDLTPKQHDYVSKIHSSATLLLGIINDILDFSKIEAGKLSIETTEFYLDDVFHNVSMVTGQKAFEKGLELIFDLPRETPRCLLGDPLRLGQIIINLVNNSVKFTEKGEITVSVHHIRNVEDLVELEFRISDTGIGMTDKQMKSLFTAFTQADGSTTRKYGGTGLGLSICRRLVELMGGQIRVESEAGKGSHFIFNVLVKADPANSSAPSIVPQSLEKIRILVVDDNEHALEIMQEMLSTLPGKVALANSGQQAVDCIRKASEQREKFDLIFMDWNMPEMDGIETSRLIRESFASEYQPQIVIVTAYDKEDVLDATNDLDIAGFLSKPVGQSYLFDLLVELFGRDRNPTTQIRKKELPTHDSKNDLKGLKVLLTEDNEINQQIAVELMEGNGLLVTVANNGQEALEHLEAMEKGESHFDIVFMDLQMPVMDGYEASHRIRANSSYDTIPLIAMTAHAMVEERERCLNLGMNDHISKPIDPEILFNTIRKWCPRTLNEKDESPVDVEQSQTQQLDSSIESAATPKSTERAAAEKRTLETLESLDYKNGLLRVAGNQTLYRRLLSQLMDKEISAPERLTIALDKQDTEQAIIIAHSLKGSASNLGAIRLSDIASRLEMAIQHGKERAEIDKLNKELDGYLEHFFQDLALALGRPKPSSDKRLELKDEELMIIHTLDSLLDSLDAYAIEFLDEHYVLLNTLLKSEDFEACCRCVNDCDFESASKSLRKAVSIYPLDLGKLSGEKNGRES

SEQ ID NO: 19630 - protein, 970 aa, Vibrio vulnificus CMCP6
MLLATASIGRKLLLSFIAMAMLVMLSALIGVSGFSFVAKTERNVVDTAIPAMIEARQVSELSSRIIASVQTLSNAKNEEERKQSGKELFSQLESLLSHIKALGGGESFDPLLLERLETHVQSVIDNLADLGVSVEKKLWLAKEIDSRVEEMRLLSEELEQLTRTQVLNTSTIAVANVTHIYDLLESNKIPQAYQALDALVEVDLDLSERLHELHLLAFKMLNQIEEARTLTNIERIQDVRNEFDANLKIMVRRVQAVEDPTRSAQMSSLLTELGKRQVVFNILGQQYQNNLESQKLMQQNLALFSELNGTVNKLVDDSNQTTTKAVSELTRTLNLAQLILTVISLAGLIVAIVIVWRVVYVSVVTRLTEYSAALLQVAQGNLDIELQVRGNDELAHMGQAIITARNTAQALKIVAEGEAKAKKELQEHKEHLEELVTERTRQLQLTNEKLNHEVLNHAKARSLAEQANRAKSAFLATMSHEIRTPMNGVLGTARLLMDSGLNPLQKRYADIINRSGKNLLAILNDVLDYSKIEAGHLEIRESAFELHQMVEDTFQLMQSRAAEKSLTFSYHIESDVNHYWRGDVTRISQVLNNLVGNAIKFTHQGAVDIYVSLDLEQENVVQFEVTDTGIGIAQQEQATLFDAFTQASGGQKAAGGTGLGLAISRRIIQAMGGQMEMASEEGEGSRFWFTVPLTPCDAVEPVVCPLETENRQATILLVEDNAVNRIVAEGFLSSLGHTVVMAEDGAEAQMLFEQQLFDIALVDINLPDCNGTDLIQRLKQQEYSSERKTPMVAVSAHVFNEEVESYLASGFDGFLAKPLEKEALSALIQKMLEGKVLVCVESEATVVSSDACSSIAQSKNSNLMDPQVVLSDMEVLGADKMRQIIELFKSSSDEILQALVSAANEANEAQVKGLAHKLKGSAGSLGLNKLMTLCKTIETHSSPTSLYLNEKEALEECVELSYHALKNLVQ

SEQ ID NO: 19631 - protein, 1199 aa, Vibrio vulnificus CMCP6
MLRIAAIALLSLLTSLTSAANYLSDADRDYLSAHPVLNVGILNNSWLPYWGGLELAPQGIHHDYAMSFARELGIQIRYQGYDSIREMLLGLKNEEVDMVIGFGKTPSRANDFLFSLPLYKNVRVIWLRDKALELEPLESLKWVCVEKTSYCEVLAERGYHNVITARNYQAATQMILQGLADATISNYVSLSHFLSEKEVSQGKVLFDKSLGTQINRVLFNKEQRKLKSIIDKVILAEQRGLTRSRIHSKDIYFLNDQASLRLLFDEGREQVIRYTIEEETFPLSYRDQDGKVKGYVHDILDRISMRSVLEFEYVPAEGRDVLQMLEDGVVDLLPARNYQGVDQRDFLVTEPYANITFDMVESTADYQERNLAILDRTGNYYSYLDVNRDYRNVRVFRELEELLPQLESGKVSHALMNQDLIHQLLIDDHRDHFKPLADSLETEFVVKLAMVVRKDDPMFHDMLNTALKTFSVKEIDSIQSAYRKVMLHFGYDKQQVIIYSLIALCLALLIVLLFSLWSTRLKDSLRQSEKVVELSQHQISWLTKLLDTIPSMISISDSKGRLVLSNQAYQASFRQCRENGCVDLESACSFLHLSEREQAEFEEIIQVPASECGLGERFYHVTRKAILHDQMEMTHYLTLFSDISDLKQTELALRESNRAALQAVEARNQFLAVVSHELRTPIAAMLGLMEILSHRLSNSESQQLLDNAIRSAERLSLHVNDILDFSKIEASQLQLDIQEYRIIEELGPVLRSFEASAQLKGLQFNVHWQPTAYIDAQYDALRVNQIVSNLLSNAVKFTEVGQIKVEIACDENALSIEIVDTGCGMTEAQLDCVFQPFVQADTSITRRFGGTGLGMSIVKSLLDLMGGTIAFYSELEQGTKVSVWIPVKGRAYASEIEVAHYLGASDLVMAWFEKWGTRGNAVHGLPKFVDWSLSPMDNLYPDLLLKQWLAQESDNVRRPNEQVTRQLQGRVLIVDDEPINRLLMQKQLKEIGITSVALADGEQAFRYLQQHGEGIDLLITDCHMPIMDGFELTAKTRSDILSFAAKPIVGCTAEDSRIAAEKAMSAGMDKVIYKPYSLAQLQRVLAHYLPEQVQQADTNANWLKEYQEEEREEMANVVIESFGFDIEQLEQEGADVAAIAHRVKGAAGALLLHELAALAKRVEQQKEPEHVERNKQQLILSMQTVVEQANAWLASSKGE

SEQ ID NO: 19632 - protein, 1370 aa, Vibrio vulnificus CMCP6
MISFADLRIRPKLIALLIIFGILPMVCVTLFSGRMASEALIKKSFQELLAIQTLRSASIDTFFEKRLLDIGTLAGTDELRDFATGLTTGVSVNYSIEEVEDSVISSFTSAYDYNDFFVLSPDKGKILYALHDKSRINANSLSYENTDPSLAKVWAKTVAKSTTYFTDFAKSKAAQGQYVAYFSAPILDHDGNLIAIAAMQVSPQLVTKIVDSRVGMGETGESYLLGLDATSNQFTLRSDIVTMGNGRYVVGFRLGYDLDYWTDARSAGDTGGQGTYIDSAGRPVLVTFNRIQVPGYDWYLISKINQDEVTTPITRIYQALTIITAMIFVLICFVAIKFSNSVTSPLLASMDFAQHIAKGKLDSSLTIDRKDELGELGSSLNNMASQLRDLDWLKSGKETLDNELRGDIELSELSNRFIRFFTRHLNAQLGAFYLFENGQLELNASYAFSDRAGNFNRIQIGEGMVGQASLEQQVIAFNHVTDEAPVYNFAAGDCVPTHFLAIPLCVDKQLIGTVLLGAFHEFSPIQRRFINEVVGNLAIVFNATKARLVIKSLLEETQQQKAHLSKANEDLEAQTQALRVSEEELQAQQEELRVTNEELEEQTKVLRASEAELQAQQEELRVTNEELEERTKALESQQVEMKEKNEALHQAQLVVEEKAKELEIASKYKSEFLANMSHELRTPLNSILILSQLFANNKDGNLTAKQIESAKAINSSGSDLLSLINEILDLSKVEAGKIDLHIEDVPLQTVEQDLLRLYQDIADDKGLDFQVICAPNLPQTLETDAQRLQQILRNLLTNAFKFTHEGAVTLNMALPSPEQAKLLDKPREALIAFSVKDDGIGIKQEQQLAIFQAFQQADGSTSRKYGGTGLGLSISKELTHLLGGRIHLKSEEGKGSIFTVIFPTRYEVKESESQPTLSPISLAPMEPMDVVEREEPTPPAQDAPSVEKEPVPQLNGFKKADSIKQDNDSYVEDDRQTVVPEDRTLLIIEDDRAFASVMRDFGRERGFKCIVAETGETGLHFAQYYKPSAIILDIGLPGIDGWTVMERLKENPETRHIPVHFMSANDANLDALRMGAIGYLTKPVDMKKLEKAFGNIEDILSKPVKRLLVVEDDAIQQESIRQLIGEDDIHIVAVPTGEKALEELESNRYDCMVLDLGLEDMTGFELLERIRRSETAARVPIIVYTGRELSKEEERELNRYAESIIIKGVKSPERLLDESALFLHRVEANLPSEQRGILRAVHNKESVLTGKKVLLVDDDMRNVFALSSILEDKGMDIVIARDGVESLDKLKENPDIDVVLMDIMMPKMDGYEAMEEIRKQKVYEKLPVIALTAKAMKGDRSKCIEAGASDYLAKPVNTDKLLSMLRVWLY

SEQ ID NO: 19633 - protein, 205 aa, Vibrio vulnificus CMCP6
MKLYETEMTPSCRRVALFLAEIGASVERVQLNVREGDNLTPEFLQKSVNGKVPMLELDDGTTLCESVAICRYFDEIHPNEMALFGRDALEKAQVEMWHRVVEFQGLYAAFQAFRNITAIYQDRETCVEAWGVESKKRVEAFLPVLEKRLSESPYVATEHFTIVDITAFIFVTFAVKGLELAVFEQFSHIEKWYEQVSNRAAFQPL

SEQ ID NO: 19634 - protein, 348 aa, Vibrio vulnificus CMCP6
MRIEQELKLGFKDVLFRPKRSTLKSRSQVNLTREFTFKHSGRQWSGVPVIAANMDSVGSFEMAKALSQHGVMTAIHKHYTVQDWADFVKDADSETLNKVMVSTGTSEADFQKTKDVMALSDELIFICIDIANGYSEHLVQYVQQVRAAFPDKVISAGNVVTGDMVEELILAGADIVKVGIGPGSVCTTRVKTGVGYPQLSAIIECADAAHGLGGRIIGDGGCACAGDVAKAFGGGADFVMLGGMLAGHEESGGEIVLKDGESYMKFYGMSSKSAMDKHSGGVAGYRAAEGKTVLLPYRGSVHGTIQDILGGVRSTCTYVGAAELRELTKRTTFIRVLEQENNVFGKEK

SEQ ID NO: 19635 - protein, 857 aa, Vibrio vulnificus CMCP6
MTNEQLQRKHQSLATLITRIIFLVLGLITIGIFIQSYYFSNKIIKQEVMLTKQQTSALVKSLFNNHLSILQIHHDSNSKNEAIRRFFLDGDDEKLEYYFLSMDQADPTHTPEFRFLTTGEGLLWDDGNAHFYGVNEVLLEKISQSVLFGNNWHFMSLHTLMGLRNMLVRRSPVIDTTTGEVLGQYYISVVLDNNFPLVEMLESGSNSDNIVMLVGDKVISHSLSGNEPYDLDSLLAMRDEPSAFDDCLISQTPIEINSTDTLVSILAIQENSHVASLQRQHYLGLATSVVLMLMLSLAIRSWIQNRVANALESLMAYSRFAGTGEKYERFNGSDILEFAHIGHTLENTFEQLESQRRSFQDLFNFALSPMMVWSESGLLIQMNPAAMKELGIEHASPQDFSNPLFQLFKLKLSPHLKMAAQGATLTGINVPIGEKIFRWNLSPIVVENGISGIIVQGQDITTLIDAEKQSNLARREAEQSAKTRADFLAKMSHEIRTPLNGILGIAQLLKRSVNDAENLKQVDVLCNSGEHLLAVLNDILDFSKIEQGKFNIKKRDFNFYDTLNTLENIYRPICREKGVSFEIHNQIPLDCQLHTDQVRLNQIMFNLISNAVKFTPAGRIEVSFKLEKFARSEHSILSIQVSDTGIGIDESKLESIFEPFVQADSLSTREYGGSGLGLTIVKNLVEMLEGEISVQSELCKGSTFYLSIPVEKGECEEQKTPTNPKPEQLFGQGLKVLLVEDNHTNAFILKAFCQKYQMSVEWVQDGTQALEKLKEHAFDLILMDNQLPKMGGIEATREIRETLKLGTPIYACTADAQESTKQEFLSAGANRVIVKPIKEQELHDELLHFKAHYWVEH

SEQ ID NO: 19636 - protein, 815 aa, Vibrio vulnificus CMCP6
MRYLDELSQSDSFNQFMYSLDVSSELSGLKNDLIEALSEIKSQPAQERLISSEWGFDVLREMLEAIENEHLHLSLNDAEMTEKLITQLISLSYWAQKEALLTYKLQTQGTYGFDYAAFYQAIERQQQALERFLDLGASHHQVEKLLQFFSSERYQSSVQYRDSIAAGTLSLDQLKAYSVELDYRLQTLLLLINSFSIQAETSLRSQIEHQQWYFTGMTGAVFAMLFVLFMLGTSTWLRVYNKLNAILNALQSLTKEDEQSQQTRVIPDGNDEFTVFAKQINQIIDEKQQQMVEIIHAKESAISANRAKSVFLANMSHEIRTPLNGIIGMTEILSQSELSSQQKEILGDIDTSSQSLLILLNDILDLSKIESGNLNISLQEADIRETVYQAMTLFQSKATSKNIELHITMGEDIPAKVMADDHRIKQVLTNLVGNAIKFTKEGYISTFVNYQADEHDHQGYLTFKVTDTGIGIDQAKLETIFEPFTQEDDSITRQFGGTGLGLAICRQLVAMMGGELTATSTKGLGSCFSFTIPVETLDTENWRSPVIKKGLLIADNYGYTNQLINECRLCGIELTIAEGVEQVQLLKPDFDVVFYCHSLHQNATRDLEQLEQVIPLQRVVVCQHHLFSSHINIERVHALLTQPFLGKRFKACIESLAQNLSQPTASSSTRMPAKQEVCFDTRVSPSYGRNHRRILIAEDNLMNQKIASFFLEKAGFDYLITSNGQEALDAITQGGKFDAVLMDCMMPVMDGITATREIRRWETEQGSGKTPIIALTASVLEEDIQSCFEAGMDAYLPKPYKSNQLYDLFSELKIA

SEQ ID NO: 19637 - protein, 506 aa, Vibrio vulnificus CMCP6
MIYAQPGSDNAVVNFKSHYDNYIGGEWVKPVSGEYFDNISPVNGQAYCKVARSSAADINLALDAAHSVRYQWAKTSVTERANILLKIADRIEAHLEELAVAETWENGKPVRETLAADLPLVVDHFRYFAGCIRAQEGSAAELDANTASYHFPEPIGVVGQIIPWNFPMLMAAWKLAPALAAGCCVVLKPAEQTPTSILVLMEKIGDLIPAGVVNVVNGFGAEAGQALATSDRIAKLAFTGSTEVGNHILKCAAESLIPSTVELGGKSPNIYFPDVFDHEDAYLDKCIEGTLLAFFNQGEVCTCPSRVLVHESIYDQFIAKVAERAKSIKQGNPLDTDTQVGAQASQEQFDKILSYLEIGRQEGAKVVFGGEIAKQEDDLASGYYIQPTLLQGHNKMRVFQEEIFGPVIAVTTFKDEAEALAIANDTEYGLGAGVWTRDQNLAYRMGRNIEAGRIWINCYHAYPAHAAFGGYKKSGIGRETHKMMLNHYQNTKNLLISYDVNPLGFF

SEQ ID NO: 19638 - protein, 256 aa, Vibrio vulnificus CMCP6
MHYMILDSFSLQGKVAVVTGCDTGLGQGMALGLAKAGCDIVGVNISEPTETMEKIQATGRKFVDIRANLMKLDDIPSIVDRAVTELGRIDILVNNAGIIRRNDAIEFSEQDWDDVMNINIKSVFFMSQAVAKQFIAQGEGGKIINIASMLSFQGGIRVPSYTASKSGVMGVTRLMANEWAKHGINVNAIAPGYMATNNTAALRADEQRNQEILERIPANRWGTPEDLAGPCVFLASKASDYINGYTVAVDGGWLSR

SEQ ID NO: 19639 - protein, 716 aa, Vibrio vulnificus CMCP6
MKQNSKLPILAILLVTLGSALFFLIAAAFFSYQNMTSQAMAPYVSIVNNNLGAKTKLLHIKSSLQDFLVEPSAANLQKTQIRTRIMRASIENDLRSHATIELHSDYGDFAQLDAMTQGLHQLTSRVAALKEVTSAEAVMPSLISEIDALYDRWNTYTSEVILQVEHNQSDFLLTREQFYHQQHWYYLAILFVSILIIALVFKLYIDQVRLTRFTQQQSLDMQEAKRAAEASAETKSKFLANISHEVRTPLNAIIGLSDTDHYLNASEQIREYIDLIHRSGKHLLALMNDILDISKIDSGKLTLEQVEFSLKDIVDDTRVLFHERTQTPGVESFIITPQDCDMIFYGDPLRLFQIISNLCSNAIKFTHEGQIKVAFTVQNRGPNSVLQICVSDTGIGISEAQLQKVFDEFVQADDSTTRKYGGTGLGLAICQKLTNLMQGTLRIESELNRGTHVTLSLTLPLLHAPHFEPKPPCPSDILVHNDGSEYYSTIQHDVNRLALLADHTESYFVYYHHNQRLIANILPTLYEEAGGRKLLVITDIEQQQNLESSAKVEYLSKPYVSYRMYELLLGKPTPSLATITMPHKTYLDLQVLLVEDVHINQLVATHFLARLGIVPDMANNGEEALARMRKQVYDLVLMDIQMPVMDGLQAMKVIQAEQLAKGAIIIAVTANVFEEDEKKYRQAGFDDILAKPFNVDALQSLIETHCLTNTVKSRTV

SEQ ID NO: 19640 - protein, 1320 aa, Vibrio vulnificus CMCP6
MLLFLAMGICSIAMLSVTQKVAELRTQSRDYQQDLYRFYRLSQELKQSSDHLTKFARAYVVTGDDYWEALFNKVLDIRDGKLPLPAGNEYEYWDLAASSAEYVPPFTSETGVPLLQRLRDSGISATEFLELKSALMLSDNLVNLEREAFLAVKGFKLEPDGKEFYTGKPDLPYAQSLLYGKVYFEEKAKIMKAIGSAHQAIVHRIEGNIEQTDTQELQYQYVYRVLVAILLASIVVSFTLLWRLYISPLSKLLRTVVNQVKAQDYAFTITQTAYAELQKFIDSLNVVFHHISEQLSQNTLVKDFNIVLRTSQSTQSLCHEVTQFLLHQFPVQQVSIAIYRDDKLIRIAGAGYDDTISREISDQSSTQLSVLLSDKPYSMKSLQGKYTTHVNGGVLELNEIYYFPLCVNKQPVALLELGTVDTLTPLQYQWLSQMLDDLSVSIQLSQNVELQRKAEQKVLEQSQLNQEILNATPNPMYCLSAQGKYLTVNAKFSELTGLAMHEIVGRTPIEVFSQQDASHHFTQVHQELSQEQCSKNYELSLLDSQGGCRDMLVCEASFNNSQGRVSGIVGILLDLTERKQMESELRDAKDTADAMSRAKGDFLANMSHEIRTPMNAILGMAHLALNTELDPSQRKYLTRINESAKNLLGIINDILDFSKIEAGKLSVESIDFSLDEVFENLTNVISFKAQEKGIEFLLDIDPRVPVGLVGDPLRLGQVLVNLCGNAVKFTEKGEILVSVMPESQSSDDVTLRFSVKDTGIGIDKEKIADLFNAFSQADTSITREFGGTGLGLSISKQLVELMGGQLSVSSAVGMGSTFTFTIHCGLQEAKMRDIAKPISGLAGKRALIVDDNDSARNILMTLLSAMQFDAKAVSNGFEALDELRQGAFDMVFVDWNMPGMNGLELLQTAHQERLLAETKNFLVTAYGREISMDENSSKLVDSLIVKPVNPSNLLDAIMDSYGIEHVTRSSTTVTFEKPVFDGQTLLLVEDNEVNQEVAIGLLNGTNLNIITADNGKLAIEALEHHPIDLVLMDMQMPVMDGITATKAIRERAEWATLPIVAMTANAMQSDVERCHEAGMNDHVAKPINVHNLYQVLSQYLSASNAASHTSSSHSTSSSQSTPDRTASADEDDLPTLSGINLKEAIFNTGGNKESYLSILSRFLEMQLEELPMFKEVVEKEDWDMAARMAHTLKGAAANLGVTPLAQLAIKMEKSIDHRSKTVIGELELAGVALDKLHAQLSEWQKRHVNVSEQECEEAAELYKRLVELVEQYDVAAVDVIKQAKDCDVWTDEQKQQLINAIESFEFEQAKEMLAAFPKPE

SEQ ID NO: 19641 - protein, 458 aa, Vibrio vulnificus CMCP6
MDKWYFSMDAVSFPHIALIEDDEIVRQATAQWLQLAGFHVEAFSHGLPALAAIKTGDFDGIVSDVRLPDLDGITLLAELQREQVGCPIILVTGHGDVDMAVKALQNGAYDFIEKPFNPDRLASTLQRAVSEYQQQADYGNRSHYLQQLSGIEQVLIGQSAIMRQLREQVARVASMDTNVIIYGETGTGKELVARSLHTESARRANPFVAINCGAIPENLFESELFGHEAGAFTGASKRRIGKLEYADKGTLFMDEIESMPMAMQVKVLRSLQENQVERVGANRPVNVDLRVVAAAKENLFNHPAFRQDLFYRLNVAQLHLPPLREREEDALLLFEHFAAQANPNKRRLSAADSRALLSYAWPGNVRELRNVAVRFALDESLSVMEILSSRAAMVQESLPVGVPLAIQLHNFERKVIHDALVRHQGSILEVMNELDLPRRTLNQKMQKLGLNRADYTDS

SEQ ID NO: 19642 - protein, 399 aa, Vibrio vulnificus CMCP6
MAHSQSIFDIHSLTSPVLSAEEIHLIEASVEQFGAPLLLLDCDVIRQQYRALKNALPNVTLHYALKPLPHPVVVRTLLAEGASFDLATTGEVELVASEGVPADLTIHTHPIKRDADIRDALAYGCNVFVVDNLNELEKFKAYRDDVELLVRLSFRNSEAFADLSKKFGCSPEQALVIIETAKEWNIRIKGLSFHVGSQTTNPNKYVEAIHTCRHVMEQVVERGLPALSTLDIGGGFPVNYTQQVMPIDQFCAPINEALSLLPETVHVLAEPGRFICAPAVTSVASVMGQAEREGQIWYYLDDGIYGSFSGLMFDDARYPLTTIKQGGELIPSVLSGPTCDSVDVIAENILLPKLNNGDLVIGRTMGAYTSATATDFNFFKRAQTIALNEFVASSERMIG

SEQ ID NO: 19643 - protein, 253 aa, Vibrio vulnificus CMCP6
MILEAFNLDGKVALVTGCNTGLGKGMAVALAQAGCDIVGVNYAGPDETPALIEATGRRFYSIVADLSDASVIASVVDRAVTQAGRIDILVNNAGIIRREDAINFSEQDWDDVMNLNAKSVFFLAQAVARQFQAQQSGGKIINIASMLSFQGGIRVPSYTASKSAVMGITRLLANEWASQGINVNAIAPGYMATNNTAALRADAERNQAILERIPAQRWGLPSDLAGPVVFLASSASDYVNGYTIAVDGGWLAR

SEQ ID NO: 19644 - protein, 642 aa, Vibrio vulnificus CMCP6
MNGKRQIGIDKQLMIAVILLSLAFTLVSTGFNVYWDYKQELKKRQAELNWVEQSYLQSLTESLWVEDRQHLESQVQGMMTLPFIDAIDIANENEVIVKTGDVGHSKRVLERRWPMEYQLADNHYLLANLTVRSNLDEVYQGLWRKFALLLVGESIKTFLLMVGVIYIALSLIVKPISLLSRAVSDFKDGETPSRLRLPARAFDDEISLLAEKYNSSVERLRSNYAELKSAKEQAEVANVKKSEFLATMSHEIRTPMNGIIGVASLLKEMELSSEQKQYVEMINHSSESLLDIINDILDFSKIEAGKMAISLEPFCLSDLVEQMCAIYTLKAHAKNLQFVVELAEDVPHTMSGDSKHLKQVLNNLLGNAVKFTERGYVKLVVAKELDAQHIPHIRFQVFDSGIGIAKEKQELVFERFQQADGSTTRKYGGTGLGLAICRRLVSLMGGELELKSEVGLGSCFEFSVPCVDGEGVFAKDRKDNVRHLQELGVTEVDSEPSSAHQSSQVAALPRALLVEDTFINQKVAKLMLEKIGLAVDIAEDGEQALVLCQQQQYGIIFMDCQMPVLDGFETTEILRASDGWTRDVPIIALTANVVVEDKQRCFDVGMNDFLAKPVTQQRMSDMVKRYLPFDDSSTGSHRHQQP

SEQ ID NO: 19645 - protein, 281 aa, Vibrio vulnificus CMCP6
MAKVRALKQIRESIATKDGDGVNITRLAGFECPDFSPFLMIDELKSEDSADYIGGFPPHPHRGIETLTYMLNGHFQHKDHMGNVGELRSGGAQWMAAGRGVIHSEMPIMTEGQLHGFQIWINQPAAKKMMPARYHDFQPESITEYRSEQHDLLRVIAGELEVNGRILSGPLTETGVPLTVADWRAETPTTLIAKVSHHFQCMVFVYEGAVSIDGQKLTQGHLGLMSEGDVLKLTASPNCGVLIFAGEPIREPIVHYGPFVMNSVDEINQAINDYNSGHFVD

SEQ ID NO: 19646 - protein, 454 aa, Vibrio vulnificus CMCP6
MTITNPFNDEVIGTVPNMGEKETQEVIAGADKAFQQFKALTAQERANLLHRWHQLILEHSDELAHIMTLEQGKPLAEAKGEVLYAASFIEWFAEEARRAYGTLVPSHKANAKILVTKEPIGVVAAITPWNFPAAMITRKCGPAFAAGCPVILKPAPDTPFTALALAVLAEKAGFPAGVFNVITGDAVAIGGELTSNKRVRKLSFTGSTPVGKLLMRQSADNIKKLSLELGGNAPFIVFEDADLDAAVEGAMIAKFRNAGQTCVCANRLYVQRSVYSEFCQKLVAKVSALKVGNGFDQGVHIGPLINDAAVAKVVQHVEDAQSKGAQIECGQLPTAGSRLVQPLVLSGVTDEMLVAQEETFGPMAPLFVFDSEEEVLARANNTDFGLAAYFYTQSLSRAWRMSEALEAGIVGINEGLISTTVAPFGGVKESGLGREGSFLGMDDYMESKYILMGL

SEQ ID NO: 19647 - protein, 632 aa, Vibrio vulnificus CMCP6
MKNKHNVKIGYGPDLLPWDELVPDFARGLISPPEADPTEVYRRANQSFNFEVNEIRQADFEIPPNGQTDDQQNTAFAEVHHYVNRQKERFLGYQTEENINYRERIAPFLDVSMNNVGDPFVDGNYTINTKFVERMVLDYFASLWNAKWPSQGPYLKDDGRWERGDPESYWGYVLTMGSTEGNLYAMLNARDYLSGQTLLDDEICGEDAHGRTITTSQLYAHYPQAPQENPNAYTPVAFFSEDTHYSIVKAMSVEKIETFGALGNRLYPNDNPLGKGEVWPAEVPSEAPAEGLPVGSGAIDVDKLVKYVEFFAEKGYPIIVVLNYGTTFKGAYDNIDQATLALETVLKKHGLYERQVPVDPNDPSKTETRTGYWIHVDGALGASYMPFVKMAANLREYEGFFEENHCYTGPDFDFRNPMVHSIVTSGHKWPGAPWPTGVYMTKHQFMVSPPDNPTYIGSPDTTFAGSRSGISPLILWDYFAKHSYEKQIELAMKGQKMAQYAYEKLQEVANYWEDKGADIGVPKGLWLQRTPLSLSLIFCQPKDDIIFKYSLAKEEIDEPNPETGRKTRKYVHMFTMWDVTEKLIDELCDDLKADDAFNVADFKPLTNVRRTRDLPHSSAHLVKLPLKGRSFR

SEQ ID NO: 19648 - protein, 1217 aa, Vibrio vulnificus CMCP6
MLNAHIRFVSFLILLSGLLFSGNALPQEENSEQETNPPSTIVIGITSKSINPSLDSESLGVYWGVNVEYLRNIAKILNINIQLKHYSNVVELLHDVETGAIDGTVGFAKTPERMNRFLFSKPLFKSSVSIWFKESFYQTRPFSTLNWTCVQGTSYCEYLRIKGIKNIHYALNFTDAVAIMNKGQANAFISSFVTINEYLDKHDVVRGAVEIPDWIEPEEISFITAKNNVALMESIDKVLEWEVKGKNIRSVASNNLYHLNDRLLSEYRREHHDDSVITFSTSNNAYPFFEISDNGEQRGLLADFLDLIQSRSGLDFEYKSPIFEYNQELATFNANIIPVAYIDRVESPNWLLTKPFMQIKFHKVELASAKAINNRKPISGILLSLQKQGLIHINAWNNENFREYSDIKKLMKDLEDGKIQSAYLSDDVLYSLLSQFNKGQLKIDKSQEKRFSIAFSVSNHDIKLNKLLDSIIDTIDSKEIEKINKSYRDFNLTYGYDSETVIFSAIIISVLLIIIAIIIYFVITNMKLKVSLAEINADNEEKEKQWLTQIIQELNNKVFIHDDKGQLVLSNCSEYLKGHCTNCQIKNAATQISLVGDFEEVQQVLSGKRIKEYSQTVNCDLQIEHIYRERKAIRSLDHRKQFVLTVLQDVTAQKEREAALIAAQHEAQSAVKARERFLATMSHELRTPLAATYGLLDLVATHSTSERDKELVLRAKQSLNHLNLLVDEVLDYSKLEAGELQIHPAKNELLRLLSQTLRGFEAKANSKGLDYTVNIIPFSLRWAMIDDLRFNQIVSNLISNAIKFTEQGDITLTAQVVDERLLLTIKDTGIGMTQEQLANIFKPFVQADDSITRQFGGTGLGLAIVEQLLKQMGGHIALHSALNVGTQVDIELPLTLCEGAYPELNALSYSSQLPTVIQDWCQCWGLVKNDANPSVNKGLSGECNTLSCQPSGCQRNSALECTQYPDALLDCLLKMTSAEQERHIEDIPMDTLAGKVLVAEDNKINQHIVKMQFAELGLTPIVVNNGVEALNYMKQHGDVALLLTDFHMPEMDGYELVRTLRANERFATLPVVGVTAEDSRIANEKSMQSGINEILYKPYDLKQLGALLARYLAKPKARENWLDKFSENDAQEVAKVFIVEMAKDLTQLKQAESGHQMRAAVHKVKGACGALGIQHIVALCEDAESVDMAHKPALVEKVISELDAEINRTIMWMESYA

SEQ ID NO: 19649 - protein, 650 aa, Vibrio vulnificus CMCP6
MSELIFLKPNWLFGLIVLPVAWLFWRFKRQASQGPVAAHLSQTPTKGAKNARSILLWLLAWVIAILALASPSWQHTTRPSFNSHQNRVLVMDMSQSMYAQDIAPSRLQQARYKALDLLPQWKEGNTALIAYAGDAYLLSPLTSDSQTLANLIQNLSPDIMPYQGSRLTSALVLAKAQLEKAGAAKGDIIVISDDIDDQELQAALKLVANSAIRVSILGIGTPNGSPIPLPNGSLLTSSTGQVVVAKSDFNNMAALAQKTGGYFAPIQFSNQDVVEIAAATQANSEMHQAKANNTQQSEVRENGGYWLLPLLLLAGLGLFRRGFVWMALVLSLPLTQMPRAHASAFLTADQQGKSLFDQGQYKAAAEQFSNPQWKGSAAYKAGEYEQAATLFAQSDSAESLYNLGNALAQNGQYDKALEAYQKALAKNPNLKQAQTNREIVEKAKQQQQQQQQQQQQQQQQQQQQQQQQQQQQQQQQQQQQQQQQQQQQQQQQQQQQQQQQQQQQQQQQQQQQQQQQQQQQQQQQQQQQQQQQQKSSNRDNQSQSENRENAPNKAKEKSQENSEQGNAQRQKKPSEQGEEQVKPSDKPAQERETEPKSVEAQQPAPKNADDPDFKKLESVENARDPAYLLKAQMLLQAQQKPAPDNKDKTW

SEQ ID NO: 19650 - protein, 215 aa, Vibrio vulnificus CMCP6
MKFNAAIFDMDGLLLDTERVCMRIFKQACDVQNLPFYQETYLSIIGRNSAGIDAILRAAYGDDLDRLHAEWRKRYNQVVLHEAIPVKEGVIALLEWLKAHQIPAAVATSTQKDVALVKLKLAGLDHYFESITTGCEVTHGKPDPEIYLLAASRLNVPPAQCLAFEDSNNGVRAAVAANMMTYQIPDLVEPCEEVIAFGHRICPSLTEVLKELQPD

SEQ ID NO: 19651 - protein, 486 aa, Vibrio vulnificus CMCP6
MEVTAHYIGGKPFVGDTGESFATLNPATGEVLAHIEQADERVLGHAIESAKLGFSVWSSMSAAERSRCLLKAAQLIRDHNDELAELEVRDTGKPIQEASVVDIATGADVIEYFAGLVNGLGGEQQSLGSNQFFYTRREPLGICAGIGAWNYPIQIAMWKAAPALAAGNAMIFKPSEETPLSALKLAELFTQAGVPDGVFNVVQGDYRVGQMLTAHPEIDKVSFTGESGTGKKVMADSAATLKPVTMELGGKSPLIIFDDADLDDAVSAAMVANFYTQGEVCTHGTRVYVQRAMYDAFVEQLKERTEKLIVGDPMNMETQIGSLISKSHLEKVLGAISSAKESGATLLTGGFQVTERGLEKGCFVAPTVFVDCRDEMPHVQNEIFGPVMSVLVFDDEDEVIARANNTQYGLAAGVFTQNLSKAHRVIHQLQAGICWINTWGNSPAEMPVGGYKLSGIGRENGQETLLHYTQTKSVFVELGAFDSPYA

SEQ ID NO: 19652 - protein, 249 aa, Hydra vulgaris
MSHLSEQELVDMAKLAEQAERYDDMVKFMKELTVKSKKLSDEHRNLLSVAFKNVVGARRSAWRIISSIESKQEEKGDSTELTTKYKKEIEHELQERCREVLDLLDNHLLVEVDSGCNGENGNYEGKVFYQKMKGDYYRYLVEVSSSEKRNELAAKSQQAYDEATKTAEKLPNTHPISLGLALNFSVFHYEIMNDSPKACALAKKAFDGAIAELDSLKEESYKDSTLIMQLLRDNLTLWTSETEQDEQNE

SEQ ID NO: 19653 - protein, 248 aa, Hydra vulgaris
MASTDSKEILIQRAKLAEQAERYDDMAAAMKQVTKMTDEPLTGEERNLLSVAYKNIVGAKRSSWRVITSIEQKANDKQALAAQYRSNIEKELKGVCEEVLELLAKYLVNKSIERVDPANKKTLESAVFYLKMKGDYYRYLAEVAVDEERKRVIFEADAAYKQASEISENLISTDPIRLGLALNYSVFHYEIRNKPSEACTLAKKAFDDAIVELDSLAEDSYKDSTLIMQLLRDNLTLWTADADATTEE

SEQ ID NO: 19654 - protein, 302 aa, Yarrowia lipolytica
MSDFLVDFMMGGISAAVSKTAAAPIERVKLLIQNQEEMIKQGRLSRPYAGIIDCFKRTAAEEGVVSFWRGNTANVIRYFPTQALNFAFKDKFKKMFGFKKSEGYWMWMMGNLASGGLAGATSLAFVYSLDFARTRLANDAKSVAKDGKAAGERQFNGLIDVYRKTIASDGIAGLYRGFGVSVVGIIVYRGLYFGLYDSLKPVVLVGPLEGNFLAAFLLGWTVTTGASTASYPLDTIRRRMMMTSGTGVKYSSAFDCGVQIVKAEGVASLFRGCGANILRGVAGAGVISMYDQMQMILFGKKF

SEQ ID NO: 19655 - protein, 110 aa, Yarrowia lipolytica
MPRVIIRREVLTQTQHFWIDFLMGGVSAAVSKTAAAPIERVKLLLQNQEEMIKQGRLSRPYKGIIDCFRRTWGEEGLASFWRGNTANVIRYFPTQALNFAFRDKFKAMFG

SEQ ID NO: 19656 - protein, 657 aa, Mus musculus
MAGERGANAVLFDITEDRSAAEQLQQPLGLTKPVVLIWGSDAAKLMEFVYKNRKAYVWIELKEPPAGANYDVWILLTVVGTVFVIILASVLRIRCRPHHSRPDPLQQRTARAISQLATRRYQAGCRRARAEWPDSGSSCSSTPVCAICLEEFSEGQELRVISCLHEFHRTCVDPWLYQHRTCPLCMFNIVEGDSFSQAPAASPSYQEPGRRLHLIRQHPGHAHYHLPSAYLLGPSRTSVARTPRPRPFLPSQEPSMGSRHQRLPRTSHLRAPEEQQHLAVSPHPYAQGWGLNRLRCTSQHPAACPVALRRARPHESSGSGESYCTERSGYLADGPASDSSSGPCHGSSSDSVVNCTDVSLQGIHGSSSTFRSSLSSDFDPLVYCSPEGDLQGKGIQPSVTSRPRSLDSVVPRGETQVSSHIHYHRHRHHHYKRQFQWHGRKPGPETGIPQSMPAASHTQLEPSLPDQQLITPNPTASSMLPNPQRPRALTEPAPGLAEASSPSPSPKPNPSGLLNLQKSSLTVRHPHRKRRGGPSEPLPTSLPPDLTVHTACPVFPHYSPRLAYPWPPEVHPLMFRPPGPDRRLLHEVPGPCYSSSQPVWLYLNPCQPLGPCLPGEGHSKWTFDSPEGRRCPYSHCQVLPAQPGSEEELEELCEQAV

SEQ ID NO: 19657 - protein, 802 aa, Mus musculus
MSAFPDSMDQKFHNMTVNECFQSRSTVLQGQPFGGIPTVLVLNIILWVFVVLLYSFLRKAAWDYGRLALLIHNDSLTSLIYGEQSEKSSPSEVSLEAERRDRGFSSWFFNSLTMRDRDLINKCGDDARIYITFQYHLIIFVLILCIPSLGIILPVNYIGTVLDWNSHFGRTTIVNVSTESKFLWLHSLFAFLYFLINLAFMGHHCLGFVPKKSLHFTRTLMITYVPTEIQDPEIISKHFHEAYPGCVVTRVHFCYDVRNLIDLDDQRRHAMRGRLYYTAKAKKTGKVMIKTHPCSRLCFCKCWTCFKEVDAEQYYSELEEQLTDEFNAELNRVQLKRLDLIFVTFQDARTVRRIYDDYKYIHCGRHPKQSSVTTIVKNYHWRVAHAPHPKDIIWKHLSIRRFSWWTRFIAINTFLFFLFFFLTTPAIIINTIDIYNVTRPIEKLQSPIVTQFFPSVLLWAFTVTMPLLVYLSAFLEAHWTRSSQNLIIVHKCYIFLVFMVVILPSMGLTSLHVFLRWLFDIYYLEHATIRFQCVFLPDNGAFFINYVITAALLGTGMELMRLGSLCTYCTRLFLSKSEPERVHIRKNQATDFQFGREYAWMLNVFSVVMAYSITCPIIVPFGLLYLCMKHITDRYNMYYSYAPTKLNAQIHMAAVYQAIFAPLLGLFWMLFFSILRVGSLHSITLFSMSSLIISVVIAFSGVFLGKLRIAQRYEQPEEETETVFDVEPSSTTSTPTSLLYVATVLQEPELNLTPASSPARHTYGTINSQPEEGEEESGLRGFARELDSAQFQEGLEMEGQSH

SEQ ID NO: 19658 - protein, 478 aa, Mus musculus
MAEKGDCIASVYGYDLGGRFIDFQPLGFGVNGLVLSATDSRACRKVAVKKIVLSDARSMKHALREIKIIRRLDHDNIVKVYEVLGPKGSDLQGELFKFSVAYIVQEYMETDLACLLEQGTLTEDHAKLFMYQLLRGLKYIHSANVLHRDLKPANIFISTEDLVLKIGDFGLARIVDQHYSHKGYLSEGLVTKWYRSPRLLLSPNNYTKAIDMWAAGCILAEMLTGKMLFAGAHELEQMQLILDTIPVVREEDKEELLRVMPSFVSSTWEVKRPLRKLLPDVNSEAIDFLEKILTFNPMDRLTAEMGLQHPYMSPYSCPEDEPTSQHPFRIEDEIDDIVLMAASQSQLSNWDRYPVSLSSDLEWRPDRCQDASEVQRDPRAGSTPLAEDVQVDPRKDSQSSSERFLEQSHSSMERAFEADYGRSCDYKVGSPSYLDKLLWRDNKPHHYSEPKLILDLSHWKQAASAPPQGCSSSRPCVT

SEQ ID NO: 19659 - protein, 497 aa, Mus musculus
MQEPLLRTEGLDYDTFPEVPATPGERERAGALKNRRVFLATFAAVLGNFSFGYALVYTSPVIPELKLSSDPALHLDKIQASWFGSVFTLGAAAGGLSAMLLNDLLGRKLSIMFSAVPSAIGYAIMAGARGLWMLLLGRMLTGFAGGLTAACIPVYVSEIAPPDVRGALGATPQLMAVFGSLSLYALGLLLPWRWLAVAGEGPVLIMILLLSFMPNSPRFLLSKSRDEEALQALTWLRADSEVHWEFEQIQDNVRRQSSRVSWAEAREPRVYRPVLIAVLMRFLQQLTGITPILVYLQTIFDNTSVVLPSQQDAAIVGAVRLLSVLIAAVTMDLAGRKVLLYVSASVMFAANLTLGLYVQFVPRPLTPNSTVEIVILGDTAFNYLTLIPLLATMLFIMGYAMGWGPITWLLMSEVLPLRARGVASGLCVLVSWLTAFVLTNYFLLAVNAFGLQVPFFFFSAICLLSLLFTGCCVPETRGRSLEQIEAFFHTRRMSFRP

SEQ ID NO: 19660 - protein, 1054 aa, Mus musculus
MPIVQRAFQDRSTDTRKMAAQIIGNMYSLTDQKDLAPYLPSVTPGLKASLLDPVPEVRTVSAKALGAMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVDRRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLFFSESLVPTARKALCDPLEEVREAAAKTFEQLHSTIGHQALEDILPFLLKQLDDEEVSEFALDGLKQVMAVKSRVVLPYLVPKLTTPPVNTRVLAFLSSVAGDALTRHLGVILPAVMLALKEKLGTPDEQLEMANCQAVILSVEDDTGHRIIIEDLLEATRSPEVGMRQAAAIILNMYCSRSKADYSSHLRSLVSGLIRLFNDSSPVVLEESWDALNAITKLDAGNQLALIEELHKEIRFIGNECKGEHVPGFCLPKRGVTSILPVLREGVLTGSPEQKEEAAKGLGLVIRLTSADALRPSVVSITGPLIRILGDRFNWTVKAALLETLSLLLGKVGIALKPFLPQLQTTFTKALQDSNRGVRLKAADALGKLISIHVKVDPLFTELLNGIRAVEDPGIRDTMLQALRFVIQGAGSKVDAAIRKNLVSLLLSMLGHDEDNTRISTAGCLGELCAFLTDEELNTVLQQCLLADVSGIDWMVRHGRSLALSVAVNVAPSRLCAGRYSNEVQDMILSNAVADRIPIAMSGIRGMGFLMKYHIETGSGQLPPRLSSLLIKCLQNPCSDIRLVAEKMIWWANKEPRPPLEPQTIKPILKALLDNTKDKNTVVRAYSDQAIVNLLKMRRGEELLQSLSKILDVASLEALNECSRRSLRKLACQADSVEQVDDTILT

SEQ ID NO: 19661 - protein, 464 aa, Mus musculus
MAMTAGATTTFPMSNHTRERVTVAKLTLENFYSNLILQHEERETRQKKLEVAMEEEGLADEEKKLRRSQHARKETEFLRLKRTRLGLDDFESLKVIGRGAFGEVRLVQKKDTGHIYAMKILRKADMLEKEQVAHIRAERDILVEADGAWVVKMFYSFQDKRNLYLIMEFLPGGDMMTLLMKKDTLTEEETQFYISETVLAIDAIHQLGFIHRDVKPDNLLLDAKGHVKLSDFGLCTGLKKAHRTEFYRNLTHNPPSDFSFQNMNSKRKAETWKKNRRQLAYSTVGTPDYIAPEVFMQTGYNKLCDWWSLGVIMYEMLIGFPPFCSETPQETYRKVMSWKETLAFPPEVPVSEKAKDLILRFCTDSENRIGNGGVEEIKGHPFFEGVDWGHIRERPAAIPIEIRSIDDTSNFDDFPESDILQPVPNTTEPDYKSKDWVFLNYTYKRFEGLTQRGSIPTYMKAGKL

SEQ ID NO: 19662 - protein, 702 aa, Mus musculus
MAGARRGWRLAPVRRGVCGPRARPLMRPLWLLFAVSFFGWTGALDGSGGTTRAMDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYTLKGEISSHELNNVQDNEMLRKVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFIAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPDNERRTTKAESAWLFRMWYNFDHNYLKPLLTHSGPPLTTTLPACCGPIARCLTSPQAYENQEQLKDDDSDLILNDGDISLTYGDSTVNTESATASAPRRFMGNSSEDALDRELTFGDHELVIRGTRLVLPMDDSEPALNSLGDTRHSPA

SEQ ID NO: 19663 - protein, 459 aa, Mus musculus
MAGYLSESDFVMVEEGFSTRDLLEELTLGASQATSGKVAAFFVADLGAVVRKHFCFLKHLPRVRPFYAVGCNSSLGVLKVLAELGLGFSCANKAEMELVQHIGVPASKIICANPCKQVAQIKYAAKHGVRLLSFDNEVELAKVVKSHPSAKMVLCIATQDSHSLNHLSLRFGASLKSCRHLLENAKKSHVEVVGVSFHIGSGCPDPQAYAQSIADARLVFQMGEELGHTMNILDLGGGFPGLEGAKVRFEEMASVINSALDLYFPEGCGVDILAELGRYYVTSAFTVAVSIVAKREVLDQASREEQTGAAPKSIVYYLDEGVYGVFNSVLFDNTCPTPALQKKPSADQPLYSSSLWGPAVEGCDCVAEGLWLPQLQVGDWLVFDNMGAYTVDTKSLLGGTQARRVTYAMSRLAWEALRGQLLPAEEDQDAEGVCKPLSCGWEITDTLCVGPVFTPASIM

SEQ ID NO: 19664 - protein, 619 aa, Mus musculus
MGKEPLTLKSIQLAMEELYPKNRALALAPHSRVPSPRLRSRLPSKLLKGSHRCGEAGSYSAEMESKAVSRHQGKTSTVLAPEDKARAQKWVRGKQESEPGGPPSPGAATQEETHASGEKHLGVEIEKTSGEIVRCEKCKRERELQLGLQREPCPLGTSELDLGRAQKRDSEKLVRTKSCRRPSEAKSTDGEEGWKGDSHRGSPRDPPQELRRPNSNSDKKEIRGSESQDSHPQGAPKAQKDLVEGPPAVEEGPIDMRREDRHTCRSKHAAWLRREQQAEPPQLPRTRGEEKQAEHEKKPGGLGERRAPEKESKRKLEEKRPERPSGRKPRPKGIISADVEKHYDIGGVIGDGNFATVKECRHRETKQAYAMKMIDKSQLKGKEDIVDSEILIIQSLSHPNIVKLHEVYETEAEIYLIMEYVQGGDLFDAIVENVKFPEPEAAVMITDLCKALVHMHDKNIVHRDVKPENLLVQRNEDKSITLKLADFGLAKYVVRPIFTVCGTPTYVAPEILSEKGYGLEVDMWAAGVILYILLCGFPPFRSPERDQDELFNIIQVGQFEFLSPYWDNISDAAKDLVRNLLEVDPKKRYTAEQVLQHPWIEMVGHTNTGNSQKEESPNS

SEQ ID NO: 19665 - protein, 355 aa, Mus musculus
MPATRDEAGGRSAEGSTYHHRQAHHHFHHGAHRGGSLLQHVGGDHRGHSEEGVDEQPGTPAPALSELKAVISWLQKGLPFILILLAKLCFQHKLGIAVCIGMASTFAYANSTLREQVSLKEKRSVLVILWILAFLAGNTMYVLYTFSSQQLYSSLIFLKPNLETLDFFDLLWIVGIADFVLKYITIALKCLIVALPKIILAVKSKGKFYLVIEELSQLFRSLVPIQLWYKYIMGDDSSNSYFLGGVLIVLYSLCKSFDICGRVGGLRKALKLLCTSQNYGVRATGQQCTEAGAVCAICQAEFRDPMILLCQHVFCEECLCLWLDRERTCPLCRSVAVDTLRCWKDGATSAHLQVY

SEQ ID NO: 19666 - protein, 245 aa, Xenopus laevis
MDKNELVQKAKLAEQAERYDDMAACMKRVTEEGGELSNEERNLLSVAYKNVVGARRSSWRVVSSIEQKTEGAEKKQEMSREYREKIEAELREICNDVLNLLDKFLIANATQPESKVFYLKMKGDYYRYLAEVAAGDAKSDIVGQSQKAYQDAFDISKTEMQPTHPIRLGLALNFSVFYYEILNCPDKACSLAKTAFDEAIAELDTLSEESYKDSTLIMQLLRDNLTLWTSDTHGDEAEQGEGGEN

SEQ ID NO: 19667 - protein, 296 aa, Xenopus laevis
MGFVKVVKNKAYFKRYQVKFRRRREGKTDYYARKRLVIQDKNKYNTPKYRMIVRVTNRDIICQIAYARIEGDMIVCAAYSHELPKYGIKVGLTNYASAYCTGLLLARRLLNKFGLDKVYEGQVEVTGDEYNVESIDGEPGAFTCYLDAGLTRTTTGNKVFGALKGAVDGGLSIPHSTKRFPGYDSESKEFNAEVHRKHIFAQNVAEYMRLLMEEDEDAYKKQFSQYIKNGVTADQVEDLYKKAHAGIRENPVHEKKPKKEVKKKRWNRAKLSLEQKKDRVAQKKASFLRAQEKADS

SEQ ID NO: 19668 - protein, 291 aa, Xenopus laevis
MELLCCEVDTIRRAHLDRNLITDRVLQTMLKAEETSCPSMSYFKCVQKEILPNMRKIVATWMLEVCEEQKCEEEVFPLAMNYLDRFLSVEPLRKSWLQLLGATCMFLASKMKETIPLTAEKLCIYTDNSIRPDELLIMELRVLNKLKWDLASVTPHDFIEHFLNKMPLTEDTKQIIRKHAQTFVALCATDVNFISNPPSMIAAGSVAAAVQGLNLGNADSVFSTQRLTLFLSQVIKCDPDCLRACQEQIESLLESSLRQAQQQHNASSDTKNMVDEVDISCTPTDVRDVNI

SEQ ID NO: 19669 - protein, 244 aa, Xenopus laevis
MDKSELVQKAKLSEQAERYDDMAASMKAVTELGAELSNEERNLLSVAYKNVVGARRSSWRVISSIEQKTEGNDKRQQMAREYREKVETELQDICKDVLDLLDRFLVPNATPPESKVFYLKMKGDYYRYLSEVASGDSKQETVANSQQAYQEAFEISKSEMQPTHPIRLGLALNFSVFYYEILNSPDKACSLAKSAFDEAIAELDTLNEESYKDSTLIMQLLRDNLTLWTSETQGEEADNVEGDN

SEQ ID NO: 19670 - protein, 434 aa, Xenopus laevis
GGQCKVSWSLCCCLSHCLCCLTMYWLWLLVLGALGPLVGTEEGLHFPTYDGKDRVLELGEKNYRQLMKKHKVFCILLQTAPPSGDKIAQRRLHLTDMVLELTAQVLERKQIGFGLLDPKKNSKIAKKLGCSEEGSLYVFKEDNVIEFDGEMAADVIVDFLLDLIEDPIEVINSKVELKVLDHMEEEMKLIGYFKGEDSEHYKEYEEAAEHFHPYIKFFATFEKTVAKALSLKMNEVDFYEPFMEEPVTIPEKPYSEEELVDFIQKHKRATLRKLRPEDMFETWEDDLDGIHIVAFAEEEDPDGYEFLQILKEVARENTENPELSIIWIDPDNFPLLVSYWEKTFHIDLFRPQIGVVNVTDADSVWMEMKDAEDLPSPDELEQWIEDVLSGKVNTEDDDDDDDDDDDDDDDDDDDDDDDDDEDDDDNDDEDDDDY

SEQ ID NO: 19671 - protein, 352 aa, Cypripedium parviflorum var. pubescens
MENGNHEIPENAREHCPGPQSESAGKSDSCEGCPNQQICATAPKGPDPDLVGIAERMATIKHKILVLSGKGGVGKSTFSAQLSFALASKDYQVGLLDIDICGPSIPKMLGLEREDIHQSNLGWSPVYVDSNLGVMSIGFMLPNPDEADIWRGPRKNGLIKQFLKDVNWGEIDYLVVDAPPGTSDEHISIVQFLQASGIDGAVIVTTPQQVSLIDVRKEISFCKKVGIQVLGVVENMSGLKQPVLDLKFERLVAGDKVGAVEDVTEWAQRYIRQNAPELLSLFACSEVFDISGGGAAKMCTEMGVPFLGKVPLDPQLCKAAEDGRSCFQEDQKCRLSAPSLPRIAEQLIASHE

SEQ ID NO: 19672 - protein, 438 aa, Lycopersicon esculentum
MASSNCLHAILLCSLLFITSTIAQNQTSFRPKGLIIPVTKDASTLQYLTQIQQRTPLVPISLTLDLGGQFLWVDCDQGYVSSSYKPARCGSAQCSLGGASGCGECFSPPRPGCNNNTCGLLPDNTVTGTATSGELASDVVSVESSNGKNPGRSVSDKNFLFVCGATFLLQGLASGVKGMAGLGRTKISLPSQFSAEFSFPRKFALCLTSSSNSKGVVLFGDGPYFFLPNRQFSNNDFQYTPLFINPVSTASAFSSGQPSSEYFIGVKSIKINQKVVPINTTLLSIDNQGVGGTKISTVNPYTILETSLYNAITNFFVKELANVTRVAVVAPFRVCFDSRDIGSTRVGPAVPSIDLVLQNANVVWTIFGANSMVQVSENVLCLGVLDGGVNARTSIVIGGHTIEDNLLQFDHAASRLGFTSSILFRQTTCDNFNFTSID

SEQ ID NO: 19673 - protein, 247 aa, Ipomoea nil
MGRGRVQLKRIENKINRQVTFSKRRTGLLKKAHEISVLCDAEVALIVFSTKGKLFEYATESCMEKILERYERYSYAERQLNSTDQNSQGSWTLEHAKLKARMEVLQRNQRHYEGEDLDSLSLKELQNLERNLIQHSNIRSKRNQLMYESILCSEKDKHCRTKYQLSKKIKEREKEMATQQQQQQEVQWEQPNDDINSSYVVPPPLVHLSSEGEYQGEGEYGETEGTQRQQQNNTSAMPQWMLSHLQG

SEQ ID NO: 19674 - protein, 57 aa, Ipomoea nil
MGRGRVQLKRIENKINRQVTFSKRRSGLLKKANEISVLCDADVGVIVFSTKGKLFEY

SEQ ID NO: 19675 - protein, 57 aa, Perilla frutescens
MGRGRVQLKRIENKINRQVTFSKRRAGLLKKAHEISVLCDAEVALIVFSHKGKLFEY

SEQ ID NO: 19676 - protein, 57 aa, Perilla frutescens
MGRGRVQLKRIENKINRQVTFSKRRSGLLKKAHEISILCDADVGLIVFSTKGKLFEY

SEQ ID NO: 19677 - protein, 245 aa, Nicotiana tabacum
MGRGRVQLKRIENKINRQVTFSKRRSGLLKKAHEISVLCDAEVGLIVFSTKGKLFEYSTDSCMERILERYERYSYAERQLTATDHETPGSWTLEHAKLKARFEVLQRNQRHYAGEDLDSLSMKELQNLEHQVDSALKHIRSRKNQLMHESISELQKKDKALQEQNNKLSKQVKEREKELAQQTQWEQQSHDHLNSSTFVLSQPLSSLHLGEAYSTAGDNGEVEGSSRQQQQNTVMPPWMLRHLNN

SEQ ID NO: 19678 - protein, 49 aa, Amorphophallus abyssinicus
FHLYDQCREFLLQVQNLARERGHKCPTKVTNQVFRYAKEAGASYINKPK

SEQ ID NO: 19679 - protein, 47 aa, Amorphophallus canaliculatus
TLFHLYDQCREFLLQVQNLARERGHKCPTKVTNQVFRYAKEAGASYI

SEQ ID NO: 19680 - protein, 43 aa, Amorphophallus zenkeri
  unsure (1)..(43): unsure at all Xaa locations
QCREFLLQVQNLARERGHKCPTKVTNQVFRYAKEAGASYMNXP

SEQ ID NO: 19681 - protein, 35 aa, Amorphophallus eichleri
REFLLQVQNLARERGHKCPTKVTNQVFRYAKEAGA

SEQ ID NO: 19682 - protein, 41 aa, Amorphophallus coaetaneus
QCREFLLQVQNLARERGHKCPTKVTNQVFRYAKEAGASYIN

SEQ ID NO: 19683 - protein, 48 aa, Amorphophallus pingbianensis
HLYDQCREFLLQVQNLARERGHKCPTKVTNQVFRYAKEAGASYINKPK

SEQ ID NO: 19684 - protein, 47 aa, Amorphophallus ochroleucus
YLFHLYDQCREFLLQVQNLARERGHKCPTKVTNQVFRYAKEAGASYI

SEQ ID NO: 19685 - protein, 53 aa, Amorphophallus symonianus
YLFHLYDQCREFLLQVQNLARERGHKCPTKVTNQVFRYAKEAGASYINKPKMR

SEQ ID NO: 19686 - protein, 53 aa, Amorphophallus henryi
YLFHLYDQCRQFLLQVQNLARERGHKCPTKVTNQVFRYAKEAGASYINKPKMR

SEQ ID NO: 19687 - protein, 48 aa, Amorphophallus margaritifer
FHLYDQCREFLLQVQNLARERGHKCPTKVTNQVFRYAKEAGASYINKP

SEQ ID NO: 19688 - protein, 40 aa, Amorphophallus napiger
  unsure (1)..(40): unsure at all Xaa locations
FLLQVQNLARERGHKCPTKVTNQVFRYAKQXGASYINKPK

SEQ ID NO: 19689 - protein, 43 aa, Amorphophallus corrugatus
QCREFLLQVQNLARERGHKCPTKVTNQVFRYAKEAGASYINKP

SEQ ID NO: 19690 - protein, 50 aa, Amorphophallus longituberosus
FFHLYDQCREFLLQVQNLARERGHKCPTKVTNQVFRYAKEAGASYINKPK

SEQ ID NO: 19691 - protein, 50 aa, Pseudodracontium harmandii
LFHLYDQCREFLLQVQNLARERGHKCPTKVTNQVFRYAKEAGASYINKPK

SEQ ID NO: 19692 - protein, 46 aa, Amorphophallus smithsonianus
YLFHLYDQCREFLLQVQNLARERGHKCPTKVTNQVFRYAKEAGASY

SEQ ID NO: 19693 - protein, 48 aa, Amorphophallus rhizomatosus
YLFHLYDQCREFLLQVQNLARERGHKCPTKVTNQVFRYAKEAGASYIN

SEQ ID NO: 19694 - protein, 49 aa, Filarum manserichense
FHLYDQCREFLLRVQNLARERGHKCPTKVTNQVFRYAKEAGASYINKPK

SEQ ID NO: 19695 - protein, 49 aa, Gonatopus angustus
LPPLRQCREFLLQVQNLARERGHKCPTKVTNQVFRYAKEAGASYINKPK

SEQ ID NO: 19696 - protein, 47 aa, Anchomanes difformis
LPLYDQCREFLLQVQNLARERGHKCPTKVTNQVFRYAKEAGASYINK

SEQ ID NO: 19697 - protein, 1307 aa, Drosophila erecta
MDTSVGDHLEDRLCALEEIKQAVQSAGANFQRVQFERLDFGETNVLETFYNADVAVIDLSILPQQRPLSYHYGVRESFGMKENILTYNDIESKQTLSLKLSCANYLFLSYKRNAETNSCHLTSQPNSNNNNKEPAAEGRVPTLQWRLKRKLQDVEIQSKAHMREKFLSDMRTARDTYATNGAKLQSILHEMRKRLDDPHVLSGEVVHSFMCSLRDVQDYDAMVRLVNDLKNIPNTRKYVETGNMSFLYAFALNRRNRKGDREKALESSLKALEKKENHFPDMLCLCGRIYKDIFVESDYTDATSLAHAIKWYRQSFEVQPNEYAGINLATLLVIEGKEFTNTEELQHIGMTLNNLIGKKGSLSSLSEYWDVATFFEISVLAKDYAKAIQAAECMFKLKPPNWYLKSTIGNISLIHRFRKKPEERQPPIEEQVFQFWMDFFLEATNTEEVKNSIRFPILILEPQKIYMPSYVTINMDADEKSIQIVNNCLAHAKNACKKIHDFLFVASKIKSVSLYKRDDRCAYLYVHHNSDDFQIYFPSTERRQKFYDLILEMTADQVVFVNLSNDDAQIEYEYDYDEQNRKMVLGKGTYGTVYAARDKQTQVRIAIKEVPEKNSQDVQPLHEEIKLHSQLRHRNIVRYLGSRSEDGFFKIFMEQVPGGSLSDLLETKWGPLKDNESTMAFYSKQILEGLKYLHEQDIVHRDIKGDNVLVNTYSGVVKISDFGTSKRLARINPMTETFTGTLQYMAPEVIDQGVRGYGPAADIWSFGCTNVEMATGKPPFIELGCAQAAMFKVGYYKKHPNIPEELSANAKNFILRCFAISVMDRPSASQLLEDPFLQEKPRKVRPALPINTEFGRSISVPADRFVHKSTPPLSYNTTCNTPTTPEFSITNTSSVDIDELPSNQFMLERRNSHGFLLSPEIEPSTPSLRTSISETSETDGFYRLKKDSQRRTTLSKVLALDESKICDIWLKKVDADQHSIAIRKSDLEDAVVCVLRYHCIKPHWMFALDNLVKRAVQAAVTIFSPELGANLADKDLSGNDDETLHTSLMQQGPTESQEKQSVEKMLPTSSTREGVGLTPAESGGDALSSSTECARILRDIRDNQQKLQRQLLEQQRQSMRALHNISQELAHIYMGGRKRLRRTINGFNKKCHRMSPSVGGTSAVRPNLAGNPRRQLNKHHFGLHEIDEQLEQWLTQQEIDEFSKTLILNEGFTFDDFIYNMEKLDLMRLGLRVGIEVRLWKLIVQERVCTSSDCADSPPSTYHKPIGGNSSSLIDNNNTLPSPTTPGTPGIKTKIKKSESEYDSCSE

SEQ ID NO: 19698 - protein, 354 aa, Drosophila erecta
MPIGNPRPLLKSRPERVNLQRTTAAPMASAEMLTRRQSAPALVIPPEETTHIVVVKRDTTTPDTTAAGELVPSRKKNSVAMQSGIVAKGPLDTIRSGASDEFLISLLECPVCFGYMMPPIMQCARGHLICSSCRSKVNLCPVCRVSMTNIRSLAMEKVASKLVFPCKHSNFGCRAQLSYAEKSTHEEDCDCRPYFCPYPDDKCSWQGSFKEVYQHLMSSHENVITMEGSDIIFLATNVNLEGALDWTMVQSCHGRHFLLSLEKIHLGEGCQQYFTACRMIGTMRDAAEFVYNISLEAHNRTLRWQSKPRSIRESFASFTNADFLVLNKSTVELFSEDGNLALNVVIRKVQGNTN

SEQ ID NO: 19699 - protein, 1334 aa, Drosophila willistoni
MDVVCVIDTVIGDHLDDRTCALEEVKLAVQSAGANFQRVQQFERLDFGETNALATFYDADVAIIDLSILTQQRPLSYHYGVRESFGMKENILIYNDVESKQTLSLKLSCANYLFLSYKRNEETNTCNLTNQANAKELPAAEGARVVPTLQSRLKRKLQDVEIQSKAHMREKFLSDMRAARDTYATNGAKLQSILHDMRKRLDDPHVLSGEVVHSFMCSLRDVQDYDAMVRLVNDLKNIPNTRKYVETGNMSFLYAFALNRRNRKGDRKKALESSLKALEKKENHFPDMLCLCGRIYKDIFVESDYTDAKSLANAIKWYRQSFEVQPNEYAGINLATLLVIEGKEFTNTEELQHIGMTLNNLIGKKGSLPTLSEYWDVATFFEISVLAKDYAKAIQAAECMFKLKPPNWYLKSTIGNISLIHRFRKKSEERLPTIEEQVFQFWMDFFLEATNTEEIKNSIRFPILILEPQKIYMPSYVTINMDAEEKSIQIVNICLAHTKNACKKLHDFLFVASKIKSVSLYKRDDRCAYLYVHHNSDDFQIYFPSTECRQKFYNLILEMTADQEVFVNLNNDEAQIEYEYDYDEQNRKMVLGKGTYGTVYAARDKQTQVRIAIKEVPEKNSQDVQPLHEEIKLHSQLRHRNIVQYLGSRSEDGFFKIFMEQVPGGSLSDLLETKWGPLKDNESTMAFYSKQILEGLKYLHEQDIVHRDIKGDNVLVNTYSGVVKISDFGTSKRLARINPMTETFTGTLQYMAPEVIDQGVRGYGPAADIWSFGCTNVEMATGKPPFIELGCAQAAMFKVGYYKKHPNIPEELSQNAKNFILRCFAISVMDRPSALQLLDDPFLTEKPRKLRPGLPINTDFGRSISVPADRLVHKTTPPLSYNTTCNTPTTPELEVTHTSSVDIDELPSNQFLLERRNSSGFLLSPEIEPQTPSLRTSISETSETDGFYRLKKDSQRRTTLSKVLALDEPKICDIWLKKINADQNSIAIRKSDLEDAVVSVLRFHCIKPHWMFALDNLVKRAVQAAVTIFSPELGANLADKDLSGNDDESVNTCLASEGQEKQQQQQQQSLDKLLPTSSSGGHLAQTDGNIPEAMGSSLECARILRDIRDNQKQLQRQIMEQQRQSLRALHNISQELAHIYMGGRKRLRRTFNGFNKKCHRMSNSGAAPSAIRPSNASHPARRQLNKRNFGLHEVDEQLEQWLSQNDIDDFSKTLILNEGFTFEDFIYNMEKLDLMRLGLRVGIEVRLWKLIIQERVCTSSDCVDSPPSTYHRPIATATTTCTASTTSSLALINNNNNNNNIDNTLASPTTTTPGTPGIKTRIKKSESEYDSCSD

SEQ ID NO: 19700 - protein, 844 aa, Drosophila littoralis
MNIVGEYEYSSKDMLGHGAFAVVYKGRHRKKHMPVAIKCVTKKGLIKAQNLLGKEIKILKELTELHHENVVALLDCKESQDCVNLVMEYCNGGDLADYLSVKGTLSEDTVRLFLIQLAGAMKALYTKGIVHRDLKPQNILLSHNYGKTLPAPSKITLKIADFGFARFLNEGVMAATLCGSPMYMAPEVIMSLQYDAKADLWSLGTIVYQCLTGKAPFYAQTPHELKFYYEQNANLAPKIPHGVSPDLRDLLLCLLRRNSKDRISYESFFVHPFLQGKKAAVSPVDMPPLSSGTPPAKAKSPLQQQMEQELQLVKLAEQQQKEREEQEAAQEEENTVSVVANPAICATITNVGVLCDSENNSGSCSSHEDSDDFVLVSKNLPEDARQGQGHAVAAQPRQHPTPNQSSPPRPSSLPISEPKPVPAPARRQLTNAGAGVTVGSPGKQGGIPLTVATLAAAGHQIPRSQPISVKHPRPDQRKSSVSSDINSISPPAVQFAIGTPPTRVRSASGGSLSETPPPHAPSTWQVSPGHSQSPLRRSGNSSPVLPSAALTKLPTLGSPTLLVAPGSLGSIGSAGSGSENNNQHHMLGPRAFTLPELGATGGLQSLLDTAGGPGTEPHAFQAPELSEETLMDREHNETLSKLNFVLALTDCIQEVADSRCAPLSTLMVAGSQTTTEQHQIPPHAPEHCKRAERLVLLVRALQLLSSGLNLASQQLRNGQLKPSSNVKNALLTMNAKYRSILFESKRLNGSGLLQKANAFNITADKILYDYALDMCQTAALDELLKNTKNCFERYNTAHILLHSLVQKCNHPQDKMLLNKYRDAVEKRLSILQQHGYIYVTDENA

SEQ ID NO: 19701 - protein, 1310 aa, Drosophila pseudoobscura
MDVVCVIDTVVGDHLEDRICALEEVKRAVQAAGANFQRVQFEKLDFGESNVMETFYNADVAVIDLSVLAQQRTLSYHYGVRESFGMKEIILIYNDVESKQTLSLKVSCGNYLFLSYKLNAESNSCLLTNQPNSKDQPGDGRVSTLQGRLRRKLQDVEIQSKAHMREKFLSDMRTARDTYATNGAKLQSILHEMRKRLDDPHVLSGEVVHSFMCSLRDVQDYDAMVRLVNDLKNIPNTRKFVEAGNMSFLYAFALNRRNRKGDREKALESSLKALEKKENHFPDMLCLCGRIYKDIFVESDYTDATSLAHAIKWYRQSFEVQPNEYAGINLATLLVIEGKEFSNTEELQHIGMTLNNLIGKKGSLSTLSEYWDVATFFEISVLAEDYAKAIQAAECMFKLKPPNWYLKSTIGNISLIHRFRKKPEDRMPPIEEQVFQFWMDFFLEATNTEEIKNSIRFPILILEPQKIYMPSYVTINMDADEKSIQIVNICLAHSKNTCKKLHDFIFVASKIKSVSLYKRDDRCAYLYVHHNSDDFQIYFPSSECRQKFYDLILEMTADQEVFVNLSNDDAQIEYEYDYDEQNRKMVLGKGTYGTVYAARDKQTQVRIAIKEVPEKNSQDVQPLHEEIKLHSQLRHRNIVQYLGSRSEDGFFKIFMEQVPGGSLSDLLETKWGPLKDNESTMAFYSKQILEGLKYLHEQDIVHRDIKGDNVLVNTYSGVVKISDFGTSKRLARINPMTETFTGTLQYMAPEVIDQGVRGYGPAADIWSFGCTNVEMATGKPPFIELGCAQAAMFKVGYHKKHPNIPVELSTNAKNFILRCFAISVLDRPSASQLLEDPFLADKPRKPRPGLPINTDFGRSISVPADRLVNKTTAPLTYNTTHNTPTTPELDVTHSSSVDIDELPSLLERRNSSGFLLSPEIEPSTPSLRTSISETSETDGFYRLKKDSQRRTTLAKVLALDESKMCDIWLKKIDADQNSIAIRKSDLEDVVVCVLRYHCIKPHWMFALDNLVKRAVQAAVTIFSPELGANLADKDISGNDDESVQTSPLQHAGSSDSQEKQQCLEKVLPSISSGGVLPSDSGYDGALHSSVEYVRILRDIRENQHKLQRQMMEQQRQSMRALHNISQELAHIYMGGRKRLRRTINGFNKKCHRMSPNAAAAGGARPALSGNPRRQLNKHNFGLHEIDEQLEQWLTQQDIDEFSKTLILNEGFTFEDFIYNMEKLDLMRLGLRVGIEVRLWKLIIQERVCTSSDCLDSPPSTYHKPIGGGGSSLNNNTLASPTTTTPGTPGTSGSIKTKIKKSESEYDSCSE

SEQ ID NO: 19702 - protein, 434 aa, Drosophila pseudoobscura
MKSATHCAVLIIVALIAASSAAGGGEQERPYRRSFINPYPRYKFFDDGVDPGEPLFLTPLIHNASIPKEDVQKLARVVGSQYHGVESYSGYLTVDKGFNSNMFFWYFPAEQDAVYAPVVLWLQGGPGASSLFGLFTENGPLELDAHSKLQKRNYTWSKTHNLIYIDNPVGTGFSFTDKDEGYAKNEKDVGRNLHEAVMQLYELFEWSNSSGFWVTGESYAGKYVPALAYHIHQVQNAIETRVYVPLKGVAIGNGLSDPLHQLKYGDYLYQLGLIDDNGLQSFHAAEDKGATCIKNHDMECAFNVFDSLINGDLTNGSLFSNLTGFNWYYNYLKTHDNSGENLGKFLQAGETRRSIHVGNKPFHDLDKENKVELHLKHDVMDSVAPWIAELLAHYTVCIYSGQLDIIVAYPLTRNYLNHLKFPGSDRYKVAPREI

SEQ ID NO: 19703 - protein, 331 aa, Drosophila willistoni
MSNKINPKRREPTAAAAAAVAAGVGGGVGGGASGVATANTNTTGSSSTGGSSSAGTTSSANTSSSSSSSLSSAGGGDAGMSADLTSLFECPVCFDYVLPPILQCSSGHLVCVSCRSKLTCCPTCRGPLANIRNLAMEKVASNVKFPCKHSGYGCTASLVYTEKTEHEETCECRPYLCPCPGASCKWQGPLDLVMQHLMMSHKSITTLQGEDIVFLATDINLPGAVDWVMMQSCFGHHFMLVLEKQEKYDGHQQFFAIVQLIGSRKEAENFVYRLELNGNRRRLTWEAMPRSIHEGVASAIHNSDCLVFDTSIAQLFADNGNLGINVTISLV

SEQ ID NO: 19704 - protein, 326 aa, Drosophila willistoni
MLPRRQSAPALALPCCVVSTSSSKEATSTAAIQEDLHNSPTVSTSTTDGAGEQIMERLPLVCGKPQEASISDFLVSLLECPVCFGYMMPPIMQCSRGHLICSTCRQKLTVCPVCRVTMSNIRNLAMEKVASKLIFPCKHTHFGCRVRLSYADKKDHEDDCEFRPYFCPYPDEKCVWQGALKDVYKHLITSHENVITMEGSDIIFLATNVNLEGALDWTMIQSCHGRHFLLSLEKIHLGEGCQQYFAACRMIGTMRDASEFVYGISVEANNRTLKWQSKPRSIRESFVAFTNADFLVLNKSTVELFSEDGNLALNVIITRAEDINES

SEQ ID NO: 19705 - protein, 376 aa, Nicotiana benthamiana
MADANMGGGGGGQFPDFPSVLTHGGQYVQYDIFGNFFEITTKYRPPIMPIGRGAYGIVCSVLNTELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLLNANCDLKICDFGLARPNIENENMTEYVVTRWYRAPELLLNSSDYTAAIDVWSVGCIFMELMNRKPLFAGKDHVHQIRLLTELLGTPTEADLGFLQNEDAKRYIRQLPQHPRQQLANVFPHVNPLAIDLVDKMLTLDPTRRITVEEALDHPYLAKLHDAGDEPICPVPSSFDFEQQGIGEEQIKDMIYQEALSLNPEYA

SEQ ID NO: 19706 - protein, 393 aa, Nicotiana benthamiana
MDGSGQQSDTMMSDAGAEQPPPAAQPVAGMDNIPATLSHGGRFIQYNIFGNIFEVTAKYKPPILPIGRGAYGIVCSALNSETIENVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLIMELIGTPSEAEMEFLNENAKRYIRQLPLYRRQSFTEKFPHVHPDAIDLVETMLTFDPRRRITVEGALAHPYLNSLHDISDEPICMTPFSFDFEQHALTEEQMKELIYRESLAFNPEYQHM

SEQ ID NO: 19707 - protein, 261 aa, Bradyrhizobium japonicum USDA 110
MAKDSLCAIVTGSASGLGAATAEILARSGARLVINYSSSQKEAEATAELCRNAGAAEVLVAQGDVSKDEDCRKIVAAASGWGRLDVLVNNAGTTKHVAHADLDGLSAEDFQRLYGVNTIGPFQMVRAARSLLEAGAKASGRPSAVVNVSSVAGISGVGSSIAYAASKGALNTMTLSLSRALAPLIRVNTVCPGYIDTPWFTKGRGEAGAKQVRDSVVAKVPLKVASTADDIAQLVCFLAMPASSNMTGEVVRMDAGMHLIA

SEQ ID NO: 19708 - protein, 755 aa, Bradyrhizobium japonicum USDA 110
MRSASGGPRVLLRRLRETMAEQVSAQERLDKIVVLIAANMVAEVCSVYVLRIDNTLELYATEGLNREAVHHTVLSAHEGLVGLVASEATPLNLNDAQSHPAFSFRPETGEEIYHSFLGVPILRAGNTLGVLVVQNRAKRTYVEEELEALQTTAMVLAELIASGELSALAQPGLEPAARHSMQKVGAILSEGIALGHVVLHEPRVVIKDYIAEDLPKEIKRLDTALAKLRADLDRMLERGDVAEGGEHREVLEAYRMFANDQGWSHKLHEAVATGLTAEAAVERVQSDTRARMLRSTDPYLRDRLHDLEDLGYRLMRQLVGQDHAPSREQLPDNAIVIARAMGPAALLDYDRKRLRGIVLEEGTANSHVSIVARALGIPAVGEVPNAPGIADPGDAIIVDGTSGSIYVRPSQEIEAAFAERVRFRARRQAQYLALRDRPCVTKDGQKVELMINAGLAIDLPHIEDTGSAGIGLFRTELQFMVGQSLPRTSDQLALYRTVLDAAGTKPVTFRTLDIGGDKALPYMEAVIEENPALGWRAIRLGLDRPGLLRGQIRALLRAGGGRALRIMFPMISEVAEFDAAKALVERELTYLRQHGHTLPERIDIGTMVEVPALLYQLDELLKKVDFISVGSNDLFQFLFAVDRGNAKVSERFDTMSAPILRALRDIARKSHAAQKSLSLCGEMASKPIGALALIAMGYRSLSLSATALGPVKAMVIDLDAKKAEAMLGPLLDAPSGSVSIRQKLTEFAEAEGLAL

SEQ ID NO: 19709 - protein, 307 aa, Bradyrhizobium japonicum USDA 110
MQTSHEVARSASVAAAGAAVSAPFLSAYSAAIRRYELLEPGQEQQLARRWHETRDRGAADALVTSHLRLAAKLARGYKGYGLPMVDLIAEANLGLVIAASRFEPGRGARFSTYAIWWIKAAIHEYILRSWSLVKIGTTAAQKKLFFKLRSEIRKATGSVMSGLTPDVAELIAGKLDVTAREVIEMDARLNGDMSLNARVGGEESGTELEALLVDGAVDAETMLADHEQTERRAKALRVALGGLAARERHVFEARRLTECPVTLDQLARELSISSERVRQIEIRAFAKVKRAVMLAAQDAPRAAVCNV

SEQ ID NO: 19710 - protein, 452 aa, Bradyrhizobium japonicum USDA 110
MTDILQGPDAVDQLRREAVKLKKINAALMSRVERSMDQQLNAFSLFETAIALDHKVRDRTHQLREALHSVERANEGLYRAKQQAEAASSLKSSVLISVTHDLLQPLNAARLTLSALTEMMESQEAGLLIDQADRSLLMLEDLLRSLLEIAKLDAGALKPDVRAIALAPLFEQLRNEFEPVAARQGLSLRIRTSPRAVRSDAMMLRRILQNLLANAIRYTRNGGVVMGCRLRGDHICIQVSDTGPGIAQAQQQAIFREFQRGEATATDQAGFGLGLSIVRRFATVLGHEVRLSSQVGRGSTFTLELEPADLAEVSDEVHEVKLAERRYSGLEGAKILLIENDPNGSEAMAALLEGWGCDVATTRSAADALLRLSELGGAPDAVIADLHLDHGESGLSAIADVRQHLKLDTPAMIITADYSEKAAKDASRHGLEVLKKPIKPAEMRALLSFLLS

SEQ ID NO: 19711 - protein, 745 aa, Bradyrhizobium japonicum USDA 110
MTNLRFVLLATTALTAMQLANTASHAQGASPLVVAQAQPQETGPDGKPKQPPKGPPGAAPPAAPARPAAPPPAAAPPHPPAAPPPAAAPPRPAAPPPPPPPPAARPAPPPPPPPPAAPKQPSPPPAAAPQQHAPTPPPPAPPAARPAPTPPAPPPAAAPQHAPPPPPPPAARPTPTPPPPPPAGPAARPTPAPTATPTPVAPPPAAPTARPGSPAPAATPAPTPTPAPTATPAPTATPAPGSTPGAPPAGRPGAPPPGVRPGSPPAAGSPPAPGATPAPTTTPAPGGTATPPSGRPGPASTPAPGAATPAPTATPAPGGALTPPPGRPGAGPTPGPQGGTPPAGAPAAGTPAAPPQAGGLPARPAAPAGAAAPSTVPGSAAATPPPNRAQFAPPTVTPAFQAAPTVVAPLPPPPRPPQRDLTPLAIGAGVVAGAVIGATIADLHNQRRESIEGGRTVYTEPDRIIIRDPGGQAYVRGNDLYRFRYGARDIRTDTVGGDTRTVVIRPDGSEIITVVAPDGRLLRRIRRDPGGRELIIIDNSYRDPQSVGGFYVDAPPPVVNIPYDRYIVDAEEASPDVIYQTMEAPPVQRINRRYTLDEIRYSPNIRMQMPSIDVNTITFETGSWTIPPDQAAKLQVIADGLNRAIQANPRVVFLIEGHTDAVGNEVDNLSLSDRRAQSAAELLTQQFGVPAENLTSQGYGEQYLKEQTQGPSAINRRVTVRNITPLLNGGQASLPPPPPGTAPPR

SEQ ID NO: 19712 - protein, 112 aa, Bradyrhizobium japonicum USDA 110
MKLVVAIIKPFKLDEVRQALTAIGVHGMTVTEVKGYGRQKGHTEIYRGAEYVVNFLPKLRIEIAVASDVADKAVAVITATARTGQIGDGKIFVTPIDHALRIRTGETDSDAL

SEQ ID NO: 19713 - protein, 133 aa, Bradyrhizobium japonicum USDA 110
MANQSRNARPRPDRAQAGIGPMKIVMAIIKPFKLEEVRDALTAIGVHGLTVTEVKGYGRQKGHTEIYRGAEYAVSFLPKIKIEVAVASDQVDKTIDAITSAAKTGQIGDGKIFVINLDHAVRIRTGEADAAAL

SEQ ID NO: 19714 - protein, 743 aa, Bradyrhizobium japonicum USDA 110
MAMGRTFRIKVRMRRFRRQHPRIAFAIRSFMIFSATFGGAYGFVSGSRSENSGYDPHTFAIGASFLFALACLGLATLSMRLRFVNKRLRKLAAHNEALIDRNWELKEAEERARSLFEQQGDLIVLRDHQNRITFANDAYCALAGQARGALVGTRFDFDVLEQGDSARESSGTRVHDQKIATPLGARWIAWREGYVRLDAGQPAELQSVGRDVTDRTETERALSDARDQADAANRAKSRFLAMASHEIRTPLNGIIGMGGLLLDTTLTPEQATYAKAVKTSGEALMALIEELLDYSKIEAGKLDLEQRPFALSTLIEEITELLAPRAQAKTLEIAAYVDERLPLEVVGDAARLRQVLLNLAGNAIKFTASGGVALIVEPGIRPNEISFLVRDTGIGIAAEAQQRIFREFEQADERVARTYGGTGLGLAISERIVKRMGGRITLASEPGKGSTFEVAVPLAPSEARAGQTAFPSPDLTGKSILLIAEGIEASLIARRLERWGSQTCLVTDATVAEALLPERSWHAVLVDRAIGPAIADRLGGVARAHAPQRLVLLTSSSRHEKQSAAFTGFLVKPLRAASLAARLALTPEVASPELAPEPPVEATSAAPARGLSVLVAEDNEINALLMRSLLTKLGHRVVIAVHGEAALESWLAASSAGTPYDLVLMDIQMPQLDGIEATKRIRAHEAATGGHHTPILALTANTLVEDRYACFEAGMNGFLIKPLDRDKLDEALAGLAASRQLAG

SEQ ID NO: 19715 - protein, 862 aa, Bradyrhizobium japonicum USDA 110
MESRWGYCRLIRARRGSPRVNSCGLGATMSGVIVSMRRTLLSCTSLVRDGLIGSALAALLPAAPAEAADFVGTLSELLDFNRQELAVLATALALLGFSVMAAILLMRTRVRTAKNEARLRARIGELQLQADRFGALLFAEPQILISWPAGDNRAQISGDVSMVLPRDSSPQRVLAFGTWLPPEPALQMDHAVDALRDRGDGFQLTLTTAHGHTLEAIGRAIGGQAIVRIRELSGLRRDLAETNLRYKALSDETEMLRGFAAAAPWPIWAKGENGALTFANPAYVRATEAASFSDAHERKLELLDSADRGAMERGLKDAANFTSRLPIVIGGERRIYDVRAVNVGSGSVGVAIDASEADALSSALVRMAEAHRRTLDQLSSGVAVFDGHRRLAFYNDSYRRLWDLDRTFLDANPDDSSVLDQLRAARKLPEQPDFRAWKAKLHEAYRAVEAAKDTWYLPDGRALSVVTTPNPEGGVTYLFDDVTESLELARRFDGMIRVQRETLDSLAEGVAVFGSNGKAQLFNPAFVRMWKLSSDAMRDEPHIQTVEGWCHQLFDDPVVWRQIREAVTSIESRADVPLKLDRKDGSVLDGMIRPLHDGATMLTFQDITDTENVERALRERNEALEAADQMKVDFVHHVSYELRSPLTTIIGFAHFLSDPSTGPLTPKQAEYLDYVTKSTNALLALTNNILDLATIDAGAMKLELGPVDVSKTIELAAEGIQDRLATDRIRLKVEIAPDIGSFIGDEKRVVQVLYNLLANAVGFSPQDSTVGISARRTEHSVVFTVTDSGPGIPADMKDKVFNWFESRSQGSRHRGAGLGLSLVRSFVELHGGKVRVDSIVGRGTVVICDFPTDQAAHRDAAE

SEQ ID NO: 19716 - protein, 333 aa, Bradyrhizobium japonicum USDA 110
MADVKYDVLGIGNALFDVLVRTDEAFLAKHGMTKGSMSLIDEARAAAIYQDMGPATEVSGGSAANTIVGIGSLGARAAYVGKVKDDQIGKLYVHDIRAAGVAFNTPAAKDGPATGCSYILVTGDGERTMNTYLGAAQDLSPADIDPAEIASAGIVYLEGYLWDPKNAKEAFVKAAKIAHDARRKVALTLSDSFCVDRYRDEFLSLMRNGTVDIVFANESELHSLYMTSDFDTALKQLRNDVNLGVVTRSEKGCMVVSAEDAVAAPAAPIAKLVDTTGAGDLFAAGFLYGLARNLPYKQCGELGALAAAEVIQHIGARPQVSLKELAEQRGLTA

SEQ ID NO: 19717 - protein, 305 aa, Bradyrhizobium japonicum USDA 110
MSWQPSNDPVLGDPMSCDALDLVIVPRTRDLGDGFVVRRALPHGRRQMVGPFIFFDHFGPVQFVSGKGMDVRPHPHIGLATVTYLFDGSIMHRDSEGNVQEIAPGAMNLMTAGRGIAHSERTPDAQRASGQQMLGLQSWIALPAGSEEIAPSFQHYGAGDLPMISERDFTARVIAGSAFGITSPVSMVSPWFYTEVTAVAGASVPLDPDHEERAIYVVDGEVEIANERYEGPRLLIFRPGDRITVKALKATRMMFLGGDALEGPRHIWWNFVSSSKDRIEQAKQDWKTGRFAAVPQEHEFIPLPE

SEQ ID NO: 19718 - protein, 466 aa, Bradyrhizobium japonicum USDA 110
MTMLDTVQHHSQPQSGVPQNHLADEFVETLRLAVPMMLTQLGQIAMITTDLALIGRLGEDAVAAAALAHTVYFVSFTFGLGLMAAVSPLVAQAFGAGDVRRIRRALRVGLWVALLISLPMMASPLYGEHILIALGQVPQSAALAQRYLNGLAWGIAPALGFIALRGMMSAVNRPQPPLWITVAAIPVNAALVYVLIHGLFGLPELGLFGAGLATTLVNLGTFLAVLAIAAWRKPFSDYRPLAHLWRIDWPLVRQLIALGAPISSSLLLEYGLFSSAALLMGLISTTALAAHQIALQVTAVLFMVPLGIGMAATVRVGHAFGRNDPAAVRRAGLVAAVLGVALVSALTVAIILGRYELGRLFFGGSEASAATVELTATLLLVGATFFIADGLQTIMGGALRGINDTRMTLAFAAIGYWCVAFPVAWVLAFHTGLGAVGVWIGFSIGTFVYAGLLVLRFRMLARRLVG

SEQ ID NO: 19719 - protein, 486 aa, Bradyrhizobium japonicum USDA 110
MLPRSAGAGRNKVAVARCPFGQPTGALVMSMQNVAAPALQFTAPRRNELTHIPGDEGWPVIGKTFQVLADPKGHIEANGAKYGPVYRTHVFGETNVVLLGPEANELVMFDQQKLFSSTHGWNKVLGLLFPRGLMLLDFDEHRLHRKALSVAFKSGPMKSYLSDLDRGISARVAQWKAKPGEMQLYPAMKQLTLDLAAASFLGADIGPEVDEINRAFVDMVAAAVAPIRRPLPGTQMARGVAGRKRIVAYFRQQIPLRRGNHGGDDLFSQLCRATHEDGALLSEQDIIDHMSFLMMAAHDTLTSSLTSFIGELAANPDWQDRLRAEVLALGLAPGAPSSFDDLEKMPLSEMAFKEALRIKPPVPSMPRRAMRDFTFKGFRIPAGTAVGVNPLYTHHMKDIWPEPDRFDPLRFTEEAQRNRHRFAWVPFGGGAHMCLGLHFAYMQAKCFARHFLQNIEVSLAPGYKPDWQMWPIPKPRDGLKVRVKAV

SEQ ID NO: 19720 - protein, 317 aa, Bradyrhizobium japonicum USDA 110
MSSPQAIPSAGRPLSAGAIALMLMLCLTWGFNQIAVKLVLPDIPPMLQAMIRSMGALPVLFIIGTLRGVKFFEKDGTWKPGLIAGLMFGIEFVLIFQGLRLTPASRAVVFLYTAPFFVALGSYQVLGERLGGTQWLGLAVSFAGVALAIGVPQPDVDAKVLLGDLMIVGGAALWAATTLVAKGTRLRFAAPEKALGYQVATSIPILGLAAWLFGESITHTPAPLSLALMAFQAIWVVGTTFTLWFALVKAYSASKLSAFTFITPLFGVVGSYFIMHDTLSLTFGAAAVLVIAGLFLVNRPSQTAAAPRDALLNVTKT

SEQ ID NO: 19721 - protein, 536 aa, Bradyrhizobium japonicum USDA 110
MIAAKFQTFLILLAVLAGTALVARRFNIAPAILLMLSGVGLAFVPGMPPVELPPELVLLMVLPPLIYSASVAMSWREFRNNLRPIVLLAVGAVIFTAAMVAAATHYLIGLPWAIGFLLGAIVAPPDVVAPLAIARRLNIPRRLLVILEGEGLANDATALILYRFALAAIMVGHLSLPMAAGEFVLIIAGEIAFGIGVGWLSLRFRRWAKDQQVELTLSLITPYVSYWLPEHVGGSGVIATVACGLYVSWNGPLLISSATRLQGIFFWDLIIYLIEGLLFLLTGFQMRALYEKSKAFPLDDILIATAVVLTIIVTARFAWLYPATYLPRILSKSLRKRDPSPPWQWPFVLAFTGVRGAVSLAAALALPFTLPDGNAFPYRDLILFVAFGVIFVTLIGVGLTLPPVVRWLGVAEAGRNEHVAEHEAEIAARRQALDAALKSLDALTEAKEVSDEVMRLLRARHEIRVNQLPDSLDPTHHDVSAAGTALTRELIAAERKFIHDLLRDGQITDETRRRIERDLDLEEASLANREYRGVPL

SEQ ID NO: 19722 - protein, 1123 aa, Bradyrhizobium japonicum USDA 110
MAGRQRIDRVRRQYNQWVANQTLEDYALRFTAKSARRWSTARVANTALGAISFLAMEAIGGTITLNYGVTNATAAILVVSTIIFCCGVPIAYYAAKCGIDIDLLTRGAGFGYIGSTVTSLIYASFTFIFFAIEAVILASALEMCFGIPRPVGYLISAVVIIPLVAYGITLISRFQLWTQPLWIILHILPFAAIAWANPYSFTEWRKFSGEHGDLNGHFDLLLFGVAASVVFSLVAQIGEQVDFLRFLPRDRRASRTSWWIALMSAGPGWIVLGALKLLAGSFLAFFALSHGVPPEEAAEPAHMYLEAFRYVLSQPDLALALTGTFVILSQVKINVTNAYAGSIAWSNFFSRLTHSHPGRVVWLVFNVIVALLLMEIGVYKALEQTLALYSNVAIAWVGALVADLVINKPLGLRPQQIEFKRAHLYDINPVGVGAMTIATIISISAFYGLFGPTAKALSAFIALAVAFLAAPLIAWATGGKYYIARKPKRSWQNIEAIQCCICEHSFEPEDMASCPAYAGPICSLCCSLDARCHDLCKPHARVQTQFSETLGKILPQPIYQRINSQLGHYIGVFVISAGLVALVLGLIYLQTSASAHGENMLVSDVLWKVFFSLSIIIGVVAWLFVLAQQSRRAAEAETRRQTTLLIQEIDAHKRTDAELQRAKEVAESANLAKSRYVVGLSHELRSPLNAISGYAQLLEQDTTLNTKPRDQVRVVRRSADHLSGLIDGILDISKIEAGRLYLSRDEVRLSEFLDQLVGMFRLQAAAKGIDFVFRRPAHLPVVVYADEKRLRQVLINLLSNAIKFTQTGSVQFVVHYRSPVAEFEVIDTGPGIQGDDLERIFAPFERGALGVSQPQTGTGLGLTISRLLAGVMGGDIKVMSTVGTGSTFKVKILLSEVANPQRIAPVEAPVSGYHGARKTILITDDDPVHRDLLREVLTPLGFILLSAADGPGCLALAQHCRPDLFLLDISMPGMDGWTVAETLRASGHHQARILMVSASALEAHGTPLAQPFHDGYLMKPIDIPRLLETIRQLLKIEWQYGSDEIAVPFWQPESGSRPPVRHIEELIGLGQIGYVKGIQLKLDEIGSEHPEHADFVAQMRSLVDRFDLDQYMTTLKTLHAHEH

SEQ ID NO: 19723 - protein, 452 aa, Bradyrhizobium japonicum USDA 110
MMSQEQNDLITRTGPKDPCGKLMRSYWQPTALVDELEGARPIRPVRLLGENLVLFRDERGRYGLIDRHCAHRGADLAFGRLEHGGLRCAFHGWLFDATGQCIETPAEPKDSKLCQNIRQRSYPVVEKSGILWAYLGEGEPPAFPEIDCFVAPDTHTFAFKGHMACNWLQALEVGIDPAHASYLHRFFEDEDTSTAYGKQFRGASAGSDLPMTKILREYDRPIINVEHTEYGLRLIALREIDEERTHVRVTNQLFPHGFVIPMSTEMTITQWHVPVDDENCYWYAIFTSYTNPVDKKKMRDQRLELYELPDYKSRKNSGNDYGFDPHEQQTATYTGMGNDINVHDQWAVESMGAIQDRTKEHLGQSDKAIVQYRRLLRQEIEKVGGGEKPMLFLDEANARSIQGPATMDGIGPTRGWETYWMEVDVKRRRGAPWTAPVPKEIDGKVHRLTAAE

SEQ ID NO: 19724 - protein, 266 aa, Bradyrhizobium japonicum USDA 110
MFNDLFSLKGRIALVTGGSRGIGKMIAAGFLAQGAAKVYITARKAGPCEATAKELSALYDGECIALPIDISTVEGCDKLAGEIIKLEPKLDILVNNAGAAWGAEFDEFPESGWDKVMDLNVKSLFFLTKALAKPLRAAASAERPAKVINIASVDGIFVNPSETYSYAASKAAVIHLTRRMATKLIKDNINVTAIAPGAFKSDMNRAARDHADDVAKRIPARRIGTDEDMAGVAIYLASRAGDYVVGNTIAVDGGVVYANAGLEIAG

SEQ ID NO: 19725 - protein, 313 aa, Bradyrhizobium japonicum USDA 110
MSLAPSIPVPRSRFNTLPLAIGLFCLLWSYAFVAGKIGVTHCPPLILLAARFSLAGILILGATLIRGDSWSLSWRDAAIFAVLGIANNALYLGLGYTGLQSVSAGLGGLIVSANPVFTAALAALLLGEGMTWRKAGGLLLGVIGVTAIVWHRLSVGTDSWHGIVFTLASLASIVLGTILFKLLAPKGSLWIGNGVQNLAAGIVLTPVALTFADVHAIDVTPSLIGAFAFLVLGGSILAYWLWFHLLKVCGATAASAYHFLMPPLGMLFAFLVLGEHVEARDLLGIIPVALGIYLVTRPAKSLSSKLLPSKAAS

SEQ ID NO: 19726 - protein, 243 aa, Bradyrhizobium japonicum USDA 110
MANDLKGRTALVTGGSRGIGAAVCRLLAEAGAAVAINCRERIGQAEQLAGEINKRGGRAIAVAADVSQREAVAAMVARVTAELGPIDILVNNAGIAITRGVDDLTEDDFDRTILVNLKSVFLCTQAVLPAMRSKKWGRIVNISSGAARGAGSIGPHYNASKAGMEGLTRGYAARLVKDGINVNAVAPSLIETDMMSGQPQLVSRIPLGRFGTADEVAKAVMLLVDNAYMTGQTIALSGGMAFN

SEQ ID NO: 19727 - protein, 268 aa, Bradyrhizobium japonicum USDA 110
MDRLKGKVAMVVGAGSIGPGWGNGKATAVTFAREGAQVFCVDRNGTAAEETAKIINDEGGKATAFTADVSRSAEIEAMVAACLKAYGRIDVLDNNVGIAEMGSVVEVTEESWDRVFSVNLKSAYFAMKHVIPVMVEQGGGSIINISSIASIRHMGISYVTYGTSKAAMNQMTRTTAIEFARHHVRVNAILPGLMKTPMVEHSAGLAASYAKGDVEAMWRARDAQVPMGHMGDAFDVANAALFLASDESKYVTGIELVVDGGITCKAGA

SEQ ID NO: 19728 - protein, 525 aa, Bradyrhizobium japonicum USDA 110
MAPLKSVSGIIVSTFEWIIALLLGAVALSALARRIKVPYPTFLAIGGALIAFVPNSPTWTLEPDLALALFVAPVLLDAAFDTSLRDLRNNWVPVSTLVVAAVGLTTVGVAYVAHRLMPDMPWAAAIALGAIVAPPDAAAAVAILSQVKLPHRMVKVLEGESLLNDATSLLIYRIAVGAVVMQHLKWSEVAPTIALALVGSVLAGLLAGRIIPLFLQRVKEAPSAIILQFATTFMVWIAAEHLGLSGILTIVVYAITMARTAGAHMPARLRVPSYAVWETMVFVLNVLAFMLIGMQMRPIWTRLDADVRWEYCVAAAWILLTVVLVRLLWVTFYRTTLRALIAHGLYHPKDPKQVASPKGGLIISWCGMRGLVTLATAFALPENFPYRDFIVFIAFAVVLGSLVIQGLTLRPLILAFGLKDDDPVGIEVARGRAVAYRAALDAIESDPSEEAEILRLEYRAILMQADDDPNGGIASGELPADPLRRRAIEAARKSIFDLRATEVIGDDAFHRLEEELDRAELSAGG

SEQ ID NO: 19729 - protein, 421 aa, Bradyrhizobium japonicum USDA 110
MNHFDYRNGVLHAEAVNLSELAATVGTPFYCYSTATLERHYRVFADAFAGEKVLVCYAMKANSNQSVLRTLARLGAGADVVSGGELKRALAAGIPARKILFSGVGKTEDELRAALAADILCLNVESEPELELLSRLATEMGKTARISVRVNPDVDAGTHAKISTGKSENKFGIPIAHAREVYARAAKLPGIQVTGTDVHIGSQITDLSKMETAFRILSEFVQTLRADGHDISHVDFGGGLGIPYYMDREAPPAPDAYAAMVKRVSHNLGCTLMFEPGRMIVGNAGILVAKVIYVKHGDGKNFVIIDAAMNDLIRPTLYEAHHDILPVTQPARDAATMVADVVGPVCETGDYLALDRTLPTPKAGDLLAIMTAGAYGAVQAGTYNTRPLVPEVLVKDDQYAVVRPRIDVEQLIAMDTPAPWL

SEQ ID NO: 19730 - protein, 266 aa, Bradyrhizobium japonicum USDA 110
MNRRRLGGTMKNTPFDLTGKVAIVTGSSRGIGRSSAELLARLGAKVVVSSRKADACKEVADGINAAGGDAIVIPCNIARKAEVEALIAGATTHYGKIDILVCNAAVNPYYGPLLDITDEAFDKIMGSNVKSNIWLSALAIPQMAERGNGSVIIISSIGGLRGSTVIGAYGISKAADFALCRSLAGEWGPKGVRVNCIAPGLVKTDFARALWEDEALLKRRTATTPLRRIGEPDEIAGAVAYLASDASSFMTGQTIVIDGGVTTAAV

SEQ ID NO: 19731 - protein, 1285 aa, Bradyrhizobium japonicum USDA 110
MTVPTSPKRTALLNAAHERILVLDGAMGTMIQNLQLDEAAFRGERFKNFHRDLRGNNDLLILTQPQAIEDIHAAYLRAGADIVATNTFSTTSIAQADYDLTDIVYEMAREGARLAGNAARRVEAEDGKPRFVAGAIGPTNRTASISPDVSNPGYRAVTFDDLRKSYGEQINGMLDGGVDLLLVETIFDTLNAKAALYAIAEITEARGIDVPVMVSGTITDKSGRLLSGQMPEAFWNSVRHAKPVTIGFNCALGAEDLRAHIADIGRVADTLVCAYPNAGLPNEFGQYDETPEYMARLVGEFARDGLVNIVGGCCGTTPDHIAAIAAAVAPHKPRIVPEIEPRLRLSGLEPFILTDAIPFVNVGERTNVTGSARFRKLITAGDYTAALQVARDQVENGAQIIDVNMDEGLLDSEAAMVTFLNLVAAEPDIARVPVMVDSSKFSVIEAGLKCVQGKPVVNSISMKEGEEKFIHEAKIARRHGAAVVVMAFDEVGQADTFARKTEICKRAYDILVNRVGFPPEDIIFDPNIFAIATGIEEHNNYGVDFIEATRWIRQNLPGAHISGGVSNLSFSFRGNEPVREAMHSVFLYHAIKAGMDMGIVNAGQMIVYDDIDPELRQVCEDVILNRDPGASERLLALAEKFRGNKTQTKEADLAWREWPVAKRLSHSLVHGITEFIEVDTEEARKASSRPLDVIEGPLMAGMNVVGDLFGDGKMFLPQVVKSARVMKQAVAWLMPFMEEEKARNLANGIGTEGSSSAGKIVLATVKGDVHDIGKNIVGIVLQCNNFEVIDLGVMVPAARIVETVKAEKADIVGLSGLITPSLDEMAFFAGELQREGLKLPLLIGGATTSRVHTAVKIDPSYRAGPVVHVNDASRAVGVASALLSPEKRVAYAAEVRAEYAKISDAHLRAQADKKRLKLADARKNRVPVDFAANKPVKPTFLGTKSFDAYDLAELVPYIDWTPFFQTWELAGRFPAILDDAKVGEVARSLYDDARKMLDLIVKEKWFRARATVGFWPANAVGDDIALYADESRTKQIATLHTLRQQLEKREGRFNAALADFIAPVDTGVPDYVGGFVVTAGIGEDAVADRFKMANDDYSSILCKALADRLAEAFAERMHARVRREFWAYAPDEALSCDDLILEKYQGIRPAPGYPAQPDHTEKATLFELLDAEATAGVKLTESFAMWPGSSVSGLYFANPASYYFGVGKIERDQVEDYAARKGMSITEAERWLAPVLNYIPAREGTDKAFAATPANDETSKDLASHPPGCTCAVHLVWQKKRAGAG

SEQ ID NO: 19732 - protein, 249 aa, Bradyrhizobium japonicum USDA 110
MKGLTVLVTGAASGMGRATARVFAAEGANVAVTDYDEQGAISVAKEIAASGGSAKAWKLDVADGGEIKRVVHDVAAHFGGLDIVVNNAGISVRVAIDDETYEDAWARGIAVMLTAHPRIIRAALPHLRKSKSPRIVNIASTEALGATALHSPYSAAKGGVASLTRSLAVELGREGITVNCICPGPIRTAITDRISEEHKTIYAKRRTALGRYGDPEEVAHMTLSLCLPAASFLTGAVIPVDGGLMARNA

SEQ ID NO: 19733 - protein, 245 aa, Bradyrhizobium japonicum USDA 110
MANELDFSGKQVLVVGGSSGIGNGIAQAFRARGAHVAVCGTRAQPAEYSAEDGSDLTGLAYAQLDVSNPAAIEAFKPSFDRLDILVLAQGAVIYRRGEFEMTGFRKVVEVNLMSLMACATRFHSMLRDAKGALIMVSSTAAYHSTMGNPAYNASKTGAVGLTRTLGEAWAEDGIRVNGIAPGLVDTKMTKVTTDNPKRLEGALSRIPLRRLGTPADMAGAALFLASPLSSYIIGQTLVVDGGLIL

SEQ ID NO: 19734 - protein, 313 aa, Bradyrhizobium japonicum USDA 110
MSPRPLMFFGTTNLDLCFNVERLPTPGESLMGSLKQNAGGKGANQAVAAARLGLRPSFYTRLGDDDAGRSLLQALREAGVRLDAIEVCPGEISGSALVLVGDDGSNMIVIDPGANANVTPSMVEKAAEFIERDAIVVAEMGMPVPALNHLFALKSVKEFDLIFNPAPVRAGLSPAAWRSVDFVTPNQTEAFELTGVEVHDFDGAAHAAGKLLDLGPKAALITLGAQGAYYADASATFALRAFPVKVVDTTAAGDAFNGAFAASLAHRLPIREAIKKALAVAALYVTRRGAQRSMPSSWAVDEFLNSQSILELE

SEQ ID NO: 19735 - protein, 256 aa, Bradyrhizobium japonicum USDA 110
MTEQFSVADRTVLVTGAGGGIGSAIANAFRQGGANVLATDANLENLRVILTRLPHGNGILPMSMDVSREDDVGRVLDEIAKRFGRLDVLINNAGIKSAQALLTGNADRIEKTIQINSVAVLRCAKLAIERFMKSKGGRIVNVGSSLSSQGAVFNYQAGGADYCLSKAIVHDVTKLLAYECAPFKINVNAIAPGIIDTPLHGRPREETEARHSGRIPLGRVGLPEDIAGLAVFLASPAASYMTGQIVHVNGGMLMNG

SEQ ID NO: 19736 - protein, 278 aa, Bradyrhizobium japonicum USDA 110
MGLDLPNDNLIRGPLPEAHLDRLVDAVNARVDRGEPKVMLLTGASRGIGHATAKLFSEAGWRIISCARQPFDGERCPWEAGNDDHFQVDLGDHRMLPRAITEVKKRLAGAPLHALVNNAGVSPKTPTGDRMTSLTTSTDTWMRVFHLNLVAPILLAQGLFDELRAASGSIVNVTSIAGSRVHPFAGSAYATSKAALASLTRELAHDYAPHGIRVNAIAPGEIRTDMLSPDAEARVVASIPLRRVGTPDEVAKVIFFLCSDAASYVTGAEVPINGGQHL

SEQ ID NO: 19737 - protein, 281 aa, Bradyrhizobium japonicum USDA 110
MGRFEGKVAVVTGAGAGIGKACALAIAREGGRVVVADIDGSAAIACTAQIAAEAGHALALAIDIADAQAVAALFETAERHFGGVDLLVNNASAMHLTPRDRAILELELAVWDQTMATNLRGTLLCCRQAIPRMIARGGGAIVNMSSCQGLSGDTALTSYAASKAAMNMLSSSLATQYGHAQIRCNAVAPGLIMTERLLAKLDACMQTHLRRHQLLPRVGRPEDVAALVAFLLSDDAAFITGQVVCIDGGMLAHVPTYADGGNSRAARPAGETAEADAAPRC

SEQ ID NO: 19738 - protein, 249 aa, Bradyrhizobium japonicum USDA 110
MLLSGKTAIISGAASPRGIGLATARRFAAEGARVAILDIDAGAATDAAASLGNSHIGLGCDVADKSSCEQAVARVIESFGGTDVLINNAGITQPVKFLEISAADWDRIQDVNLKGILFLSQAVIPHMRGRKAGSIACMSSVSAQRGGGIFGGPHYSAAKAGVLGLAKAMAREFGPDGIRVNCVTPGLIGTDITAGKLTDEMRAKILEGIPLNRLGTAEDVAGIYTFLASDLSAYVTGAVIDVNGGMLIH

SEQ ID NO: 19739 - protein, 350 aa, Bradyrhizobium japonicum USDA 110
MAARACRAGSREAGMKTVRSAPQPGKPRLTTSAMIASIAAEGQKTRPGPFGHALVELARHRPEVVGMTADLGKYTDMYIFAKEFPDRYYQMGMAEQLLFGAASGLAAEGFMPFATTYAVFASRRAYDFIHQTIAEEDRNVKIVCALPGLTSGYGPSHQAAEDLALFRAMPNMTVIDPCDAHEIEQLVPAIAAHQGPVYTRLLRGQVPVVLDEYDYKFELGKAKLIRDGKDALVISSGIMTMRALEAVQTLKDDSIDIAVLHVPTIKPLDTETILREAGKSGRLVVVAENHTTIGGLGEAAAALLMRSGVHPPFRQIALPDEFLDAGALPTLHDRYGISTAEVARQIKRWL

SEQ ID NO: 19740 - protein, 445 aa, Bradyrhizobium japonicum USDA 110
MYSRRGFLGTAALASASAISGRVQAASIPEAPTMDKVVMQPPLHPISGPDYRPVVTLNGWSLPFRMNGDWKEFHLVAEPVVREFAEGMKVNLWGYNGQSPGPTIEAVEGDKVRIFVTNKLPEYTTVHWHGMIVPSGMDGVGGLNQPHIDPGKTFVYEFEMKKSGTFMYHPHSDEMVQMAMGMMGMVVVHPRDPNFRPVDRDYVFVMSTYRVDPGSYLPRVNEMTDFNMWTWNSRVFPGIDPLPVRLGDKVRVRIGNLSMTNHPIHLHGHSFAVTCTDGGWIPESAQIPETTTDVPVGAVRVFDVLADNPGDWAFHCHKSHHTMNAMGHEVRTLIGVSRKDLAKAVGKLAPDSMAMGSTGMAMGNMEMPAPDNTLPMMTGTGQFGPIEMGGMFTVMKIREDLARDDYRDPGPYKFPQGTVAYEVTPPAAEPARQQGGTPPMKNMKM

SEQ ID NO: 19741 - protein, 833 aa, Bradyrhizobium japonicum USDA 110
MHRLLRRQLRKHLGVEGEVPAALQSFVAAVDSAYTDFDSDRAMVERSQELSSKELSEARDKATEAQRRLVDAIESISEGFSLYDADDKLVIYNRRYRDMHGTASINVVNQGVSFETILRNATASGEIRDAEGRVEAWIEQRLAQHRDPKGTHVQRRSDGRWIQINERKTDDGGTVATYTDITDVKKAEQAIQESEQRLRVIAEAAPMAVAIVTFDDGIIRYANRRFSEMFELEGSSALGLQAKTLYADPQHRERFIGALTEHGHVEGMEMLLKRVGGEEFWALIASQRVEFEGRPAMINGLADISDRKRMEGELHKAIWASEQATRAKSDFVANMSHELRTPLNAIIGYSEILFEDAQSAGRESEMADLRKIQDAGKHLLGLIDNILDLSKIEAGKMTLYLETFELRPMIDSVAATVTPLAKKTGNALVANCADEIGTIHSDLTKVRQTLFNLLSNACKFTRNGTITLTALRDTNAAGEWIEFQVRDTGIGMTPDQQAKVFEAFTQADDSTTRVYGGTGLGLAITKSFCRLMGGDVTLTSEAGKGTAFVVRLPAVTRAASDTTVSAADKRSEGPQAAEPEHAPIVLVVDDDPNARELLRRHLQRGGYAVRLAANGEEAMQLARTLHPDVVTLDALMPQMDGWAVLSAMKEDAVLAEIPVIMVTIVDNQGIGFSLGAADYLVKPIDRDRLVSAVEKCCPRGAPRHVLIVEDDASASELMGRALRQIDCMVTQAENGRIGLERLNEASPDAILLDLMMPEMDGFEFIARVRAESRWRSIPVIVVTAKTLTVEDRSRLNGQVQHLVHKGEYSGKAVLAALDELVPLHARRARADRP

SEQ ID NO: 19742 - protein, 183 aa, Bradyrhizobium japonicum USDA 110
MDDKSQPGIPWREDLMANTGRSGVGAAIVALLTSPGFAVITTWRIAKMLRFRTRWGHQITWLLVRALMRRGCYISVLAEIGPGLILPHPTGVVVGEGARIGRSVMLYHNVTLGRRAWDEPGCPTIGDDAVIYTGAVIVGPISIGAGANVAANAVVTRDVPPRSVAAGAPARVVRSEAPDRMRA

SEQ ID NO: 19743 - protein, 354 aa, Bradyrhizobium japonicum USDA 110
MGVRPMTKPFPMNAWYAAAWDAEVKPALLPRTICGKHVVMYRKADGAVAALEDACWHRLVPLSKGRLEGDTVVCGYHGLKYNAQGRCTFMPSQETINPSACVRAYPVVERHRYIWLWMGDPALADPALVPDMHWNHDPAWAGDGKTIRVNCDYRLVLDNLMDLTHETFVHGSSIGNDAVAEAPFDVTHGEKTVTVTRWMRNIEPPPFWAKQLGKPGLVDRWQIIRFEAPCTIAIDVGVAPTGTGAPEGDRSQGVNGFVLNTITPETEKTCHYFWAFVRNYQIGEQRITTEIREGVSGIFHEDELILEAQQRAMDENPDRVFYNLNIDAGAMWTRKLIDKMVAKENAPQHLQAAE

SEQ ID NO: 19744 - protein, 538 aa, Bradyrhizobium japonicum USDA 110
MHIVRIGAEATELRPAEEIGAKAANLARMAALGLPVPPAFVLPVKLCADIIAGHAHAERHLSDGLKEGIAFLESATGRRFGDRRLPLLVSVRSGAARSMPGMLDTVLNVGCTSDAVHGLIRATGRPRLAWDCRRRFLESFGETVLGLDAAAFAARISELVEAEGAENDRALDSEALERLAGDEQALVEDHADGWLEDAVAQLEAAAQAVYRSWTSERAKTYRKLQQLEGLQGTAVTVQAMVFGNGGLASGAGVAFSRDPSTGAPRPMIDLVLDAQGEDVVSGRRSPDAEDAIVRALPRTEAELGDILKRLEREFCDVQDVEFTVEDGRLWILQTRAAKRTPRAAVRIAIDLVHEGLITQDEALERIAGIDLASLAATALVCAGEPAAIGIGASGGIGVGRAVFDAESAQRLSATGDPVILLRPDTSTADVAGFAVAAGIVTAVGARTSHAALVARQMGKPCVVGCHALKIDPVSRQAQLADATLSEGDWITIEGDAGQLYLGRCRTVETRPDAELAEIAKWQSQAGDLDPPARAAAAQ

SEQ ID NO: 19745 - protein, 981 aa, Bradyrhizobium japonicum USDA 110
MQAMAKAASKPKKIPAKSKSSVKAKAAPAARKALSKSAPKPIAKPAAKSAAKSAVKAVSKAATKPVAPKAAAKVALKPTPSKPAPAAAKAGKWVFTFGDGKAEGRTEMRDLLGGKGANLAEMANLGLPVPPGFTIPTSVCTYFYAHGKTYPKELQSQVEKALDHVGKLTGKVFGDTKNPLLVSVRSGARASMPGMMDTVLNLGLNDETVEALSELSGDRRFAYDSYRRFITMYSDVVLGFEHHHFEEILDTFKDSQGYTLDTDLSAEDWVELVGKYKDAVARETGKNFPQDPHDQLWGAIGAVFSSWMNARAVTYRKLHDIPESWGTAVNVQAMVFGNMGETSATGVAFTRNPSTGESKLYGEFLINAQGEDVVAGIRTPQDITEEARKESGSDKASMEAAMPEAFKELTRIYTLLEKHYRDMQDMEFTVEQGKLWMLQTRGGKRTAKAALRIAVELANEGLITKKEAVTRIDPASLDQLLHPTIDPNAKRDVIATGLPASPGAASGEIVFSSDEAAKLQADGRKVILVRIETSPEDIHGMHAAEGILTTRGGMTSHAAVVARGMGKPCVSGCGTIRVDYGRGTMSIGSRTFKTGDVITIDGSLGQVLAGRMPMIEPELSGEFGTLMKWADQVRKIGVRVNGDTPDDARTAIKFGAEGIGLCRTEHMFFEETRIRTVREMILSEDEQSRRAALAKLLPMQRADFVELFEIMKGLPVTIRLLDPPLHEFLPHTHAEVEEVARAMNTDPRRLADRARELSEFNPMLGFRGCRIAIAYPEIAEMQARAIFEAAVEAEKRTGKAVGLEVMVPLIATKMELDLVKARIDATAQAVMRDTNTKLAYQVGTMIELPRACLLAAEIAESAEFFSFGTNDLTQTTYGISRDDAASFLGTYVSKGILPIDPFVALDQEGVGELVKIGVARGRKTRPKLKVGICGEHGGDPASVAFCHNIGLDYVSCSPYRVPIARLAAAQAALGKAVASQA

SEQ ID NO: 19746 - protein, 345 aa, Bradyrhizobium japonicum USDA 110
MTGQLRLDDHLQRYSETAPHALAVATAVDAIAAAAIEIADLIGAGDLADASGLTTGRNSDGDVQRDLDVQADAILRRCLGKLSIAALASEEMREPQIGDRAARICVAIDPLDGSSNIDINMTVGTIFSILPAPDDLALAFHQRGSAQFAAGFVTYGPQTSLVLTLGDGVDIFTLDRKAGCFRLARSAIQISEAGEEFAINASNRRHWDPPVRAFIDECLAGVEGPANHDFNMRWVGSLVAEAYRILTRGGVFLYPSDARPGYGDGRLRLTYEAHPMAYIIEQAGGSASTGRERILDLSAQSLHQRVPLIMGSSNEVRRVEELHCDPLLVASISAPLFARRGFFRL

SEQ ID NO: 19747 - protein, 2095 aa, Bradyrhizobium japonicum USDA 110
MSDLDPGSASRSGRRVPKPKINGTSEPDSRPELLLALQAMRSGDFSVRMSGDYLGIDGKIADTFNEIIAANQRMAQQLELVGQVVGREGKTRQRVKFGLASGSWADMEGSVNTLIDDLLWPTREVTRAVAAVAQGDLLQTVKLDVDGRPLRGEFLQSANIVNTMIKQLGVFTSEVTRVAREVGTEGKLGGQAQVPEVTGVWKDLTESVNSMANNLTNQVRNIAEVTIAVANGDLSKKITVDVRGEILQLKEAINTMVDQLRSFASEVTRVAREVGTDGKLGGQAIVPGVAGTWKDLTDSVNAMCGNLTAQVRNIANVTTAVARGDLSRKITVDVRGEILELKDTINTMVDQLNSFASEVTRVAREVGTEGKLGGQAQVPGVAGTWKDLTDNVNFMASNLTAQVRNIADVATAIAGGDLSKKITVNVSGEILQLKETLNTMVDQLNAFAGEVTRVAREVGTEGRLGGQANVLGVAGTWKDLTESVNSMASNLTAQVRNIAEVTTAVAGGDLSKKITVDVRGEILELKDTINTMVDQLNAFAGEVTRVAREVGTEGKLGGQAQVRGVAGTWKDLTDSVNSMASNLTGQVRNIAEVATAVAKGDLSKKITVNVSGEILQLKETLNTMVDQLNAFAGEVTRVAREVGTEGKLGGQAEVPGVAGTWKDLTDSVNSMAGNLTAQVRNIAEVATAIAGGDLSRKITVDVRGEILQLKDTLNTMVDQLNRFAGEVTRVAREVGTEGRLGGQANVPGVAGTWKDLTDSVNSMAGNLTAQVRNIAEVTTAVARGDLSRKITVDVRGEILELKNTINTMVDQLNGFAGEVTRVAREVGTEGKLGGQAEVPGVAGTWKDLTDNVNFMASNLTAQVRNIAEVATAIAGGDLSKKITVDVRGEILLLKDTLNTMVEQLRSFAAEVTRVAREVGTEGRLGGQAVVPGVGGTWKDLTDNVNLLAANLTTQVRNIAEVTTAVARGDLSRKITVDVKGEILELKNTINTMVDQLNAFAGEVTRVAREVGTEGKLGGQAAVPGVAGTWKDLTDTVNLMAANLTEQVRGIVKVVTAVANGDLKQNLTMKSRGEVAALADTINNMTETLATFADQVTSVAREVGVEGRLGGQANVPGAAGTWKDLTGNVNLLAANLTSQVRAIAEVATAVTKGDLTRSIQVDARGEVAELKDNINTMITNLRLTTDVNTEQDWLKTNLAKFTNMLQGQRDLATVGRLLLTELSPLVNAHTGVIYQVENEENPQLLLLASYAGDGIYPYQRVLPFGDGLIGQCALDRRPRVVADIPSDVVPINSALFRVAPKNLVVLPVLFEGQVKAVIELASLTSFTTSQMTFLEQLTDSIGIVLNSIEATMQTEGLLKQSQQLAGELQTQQRELQQTNDQLEQKAQQLAERNVEVERKNQEIEQARRALEEKATELALTSKYKSEFLANMSHELRTPLNSILILGQQLTDNPDGNLSAKQVEFARTIHGAGTDLLNLISDILDLSKIESGTVTVDAEEILTANLLETVGRPFRHEAENRNLSFKIDVDPNLARSIVTDSKRLQQVLKNLLSNAFKFTAEGEVRLKVGGALGGWGTDHPVLNSAPAVISFEVSDTGIGIPLEKQKLIFEAFQQADAGTSRKYGGTGLGLAISRELASLLGGEIHLRSAPGKGSSFTLYLPLKYSGPTLAPRATPQQYSQPPALQPTAPEQRVIEQLPDDRLNLEPGDSILLIVEDDPHYARVLVDLARDKGFKVLVAARGAEALELAKQYQPRAVSLDVFLPDMLGWTVLSQLKHNPLTRHIPVQIITLDEDRQHALARGALSFVNKPTTTEGVSAALTQIKEYARPRRKRLLIVEDNEAEQLSIRELLHHDDIEIVTTDTGAGALSTLREAPCDCVVLDLRLPDMSGFEVLDQIRHDEALSNIPVVVFTGRELSAEEDAELHTMARSIVVKGVESPERLLDETALFLHRVITELPVEKQRMLEKLNSSDEDLIGKTALLVDDDARNIFALSSVLERRGMKVLTATTGREAVTLVESNPEIAIVLMDIMMPQMDGYQTIGVIRENPAFLRLPIIALTAKAMKGDREKCLEAGASDYLAKPVNTDQLLLAIRMWLHR

SEQ ID NO: 19748 - protein, 272 aa, Bradyrhizobium japonicum USDA 110
MDNLKTQGISMPKLGLGTFRMQGDACRAAVESALSIGYRHIDTAEMYANEEPIGAALAAARLPRGELHVTTKVWHENLAPDAIRRAFDASLKKLRLDHVDLYLVHWPSRSANWGAVFETLMKLKEEGRTRAIGVANFTTALLKIAVEDIKAPIACNQIEYHAMLDQSKVLAYLNARSIPLVAYCPLAQGRVASDPVLAEIGARHNATAAQVALKWLLDQGGVAAIPKASRRESQQANLDALKIMLDDADRNKIAALPKDRRCVNPGFAPAWD

SEQ ID NO: 19749 - protein, 250 aa, Bradyrhizobium japonicum USDA 110
MPHSSNAPRRTLLLTGASRGIGHATVIRFSSAGWRVITCSRHPFPEDCPWDAGPEDHIQVDLADPKDTTRAISEIRNRLEGGMLHALVNNAAISPKGPGGSRLGSVDTDLDTWTHVFHVNFFAPIMMARGLIEELKAARGSVVNVTSIAGSRVHPFAGAAYATSKAALASLTREMASDFGRVGVRVNAIAPGEIDTSILSPGTEKIVEQQIPMHRLGTPDEVAKIVYVLCTDTSSYVNGAEIHINGGQHV

SEQ ID NO: 19750 - protein, 661 aa, Bradyrhizobium japonicum USDA 110
MQTHRAPERPSGADKLEIAVNAYSKTPLLDTIRTPDDLRKLKIEQVRQVADELRQETIDAVSVTGGHFGAGLGVVELTTAIHYVFDTPRDRLIWDVGHQAYPHKILTGRRDRIRTLRTGGGLSGFTKRSESDYDPFGAAHSSTSISAGLGMAVARDLSGGKNNVIAVIGDGAMSAGMAYEAMNNAGAMNSRLIVILNDNDMSIAPPVGAMSAYLSRLYSGKTYRTLREAAKQINKRLPKIIANRANRVEEYSRGFMMDGGTLFEELGFYYVGPIDGHNLDHLLPVLKNVRDMEEGPILVHVVTQKGKGYGPAEASADKYHAVVKFDVATGTQAKAKPNAPAYQNVFGQSLVKEAQKDEKIVAITAAMPSGTGVDIFNKAFPDRTFDVGIAEQHAVTFAAGLASEGYKPFCAIYSTFLQRGYDQIVHDVAIQNLPVRFAIDRAGLVGADGATHAGSFDNAYLGCLPNMVIMAAADEAELVHMVATQVAIDDRPSSLRYPRGEGRGIEMPEVGIPLEIGKGRMIRQGSKIALLSFGTRLAECEKAADELAAHGLSTTIADARFMKPLDTELVLKLARDHEILITIEEGSVGGFGSHVAQFLTDQGALDSGMVKFRTMVLPDVFQDHDTPAAMYARAGLDAKGIVAKVFEALGKDVKTETVKLA

SEQ ID NO: 19751 - protein, 247 aa, Bradyrhizobium japonicum USDA 110
MDLGLKSKTAVVTGASIGIGRAIAKGLAAEGVRVVGVARRTDLLAELVSEVGGGLITPFEQDVMAKDAAEKIAAFAVSELGHVDILVNNAGGSRPLPVDAPDSKWDEAIALNFTSYRRIAHALLPQMIERKWGRIVNITGKSEPEGLNAAFAAKAAVHAWAKGLSREIGEHGITINCIPPGRIMSEQIRRNYPPDYRERFAEEEIPVGYWGEPEDLAALAVFLASPVARYITGTVIPVDGGLRRYQF

SEQ ID NO: 19752 - protein, 286 aa, Bradyrhizobium japonicum USDA 110
MTKIGPHMNTNPFGKTGANVSVIGQGTWYLDHGDRKRAIAALQRGLDLGMTHIDTAEMYGDAELVIADAIAGRRDEVFLVSKVLPSNASRRGTITACERSLKRLKTDRLDCYLLHWRGSYPLEDTGAAFEELVKAGKIKSWGVSNFDADDLEEMLDVAGEGRIACNQVLYHLKERAIEHAVIPWCERHGVAVVAYSPFGHDDFPASNSKGGAVLARIAEARRVTPRQIALSFLTRAITVFAIPKASSAEHAGENAAAGDLVLTKEEIAALDAAFPRGPKPRGLPML

SEQ ID NO: 19753 - protein, 304 aa, Bradyrhizobium japonicum USDA 110
MNSLSPRAAVGLFLIVVLAWGVNWSVTKQLVQFLSPLWTSAIRSWIALAALFVILGLSNNLVIPERRDIPVVLSVALLHMTVFSVLVAAGVRFLPAGKAVVLGYTTPLWVAIAAPLIGNDTLTAPKVAGALLGLIGLAVILNPTSIDWTNGNVMLGAGMVILAAIAWAANIIYIRAHRWLASPLQLLIWQVLVATVVLSITAAIVDGIPHVNWSWRLVLLFLYSGLIGTALAYWAMSMVNKSISALTTSLGTTATPLVGIASAAVLLGEPIDLSLAVAAGLIVAGIGLATLGDRLLRSQAIARG

SEQ ID NO: 19754 - protein, 274 aa, Bradyrhizobium japonicum USDA 110
MRVMPESLAKNGKRAMNLFDLSGRVAVITGGNGGIGLGIAQALAGQGCNVSIWGRNPDKNRSAAASLAGLAGKVDTRVCDVTDPASVNAAMKATLDTFGRVDGCFANAGIGGGGRRSFIERTEEEWRTMFTTNLDGVFHAFQAAARHMTDRANAGDPFGRLVATSSLASIFGTARNEHYAATKAAINALVRALGVELARHGVTANAILPGWIKSDMTAGLMANDKFVANVMPRIPQRRFGEASDFGGIAVYLMSRASSYHTADTFVIDGGYTAF

SEQ ID NO: 19755 - protein, 289 aa, Bradyrhizobium japonicum USDA 110
MVMGPGFRQDDIGGGTALRSRRRRATNNKEDKTMDLGLKGKNAIVLGGTRGIGRAIAATLAGEGANVAVCARNADQVAATVTELKTSGIRATGSPVDVTDGAALKSWVEGAAKELGGIDMLFSNAGAMAQGQDAASWEQNFRLDVLGAVHAFDAARPFLEASGETSGDAAFVIIASISAAQADLASSYGPIKAALIHMAKGLARQYAKKKIRVNVVSPGTVYFKGGVWNTIEQNMPERYKDAMKRNPTGRMATPQEIASAAVFLASPVSGFTTGSNLVVDGAISNRVNF

SEQ ID NO: 19756 - protein, 634 aa, Bradyrhizobium japonicum USDA 110
MSRSARPVTVLSIIRDCLDALLHPSARYDALTRARHRAFMAPRLLGSLAAFAAFPIYLAMRGAPSAVEVAAFAWLIAPIMLSWFLSRTGRYEGAHVLSSLALAGLIMAVAITTGGIESFAAVWLIVVPLEAALSASRRVAAFASLLALSCAGILIFVGQLGWLPLDAPGAAERSLLMAFGVASATLYAAGLAFGAESLARTGVALLSREEERYRLLARNMSDVISRHRRNGAVQFISPAAEAMLGMPVAQLHGHGLFDRVHVADRPAYLTALSDAARGNVRSVEFRLRREPTGSERGQVDFIWVEMRCRPLDQDLGRQDIDRDVARETEVVAVMRDVTDRKLSEQALDQARSAAEAADAAKTRFLATMSHELRTPLNAIIGFSDMIAQEQALMLGAAQRKEYAQVINDSGQHLLSVVNGILDMSKMESGNFEIASEPFAPRASLMHCCNLLALKARENGIDLITDAPQDLPVMTGDPRAFKQIVLNLVANAIKFTERGGQVSVSAAVSGSHLTLRISDTGVGIAPDDLKRIGAPFFQAGKTYQRRHEGTGLGLSIVKSLVALHLGDLTVQSRLGEGTAVTVKLPLVYTSPQAKPADRMPAESKIATLTPVPRQEHHDQHHDQLQDQPALVKKSA

SEQ ID NO: 19757 - protein, 292 aa, Bradyrhizobium japonicum USDA 110
MDRTMTRTPCSQRARSSMKIHHLNTGTMCPMGRRLVNGTGGLFQRARMVCHCLLVETGDGLALVDTGIGLGDIAAPDRLGRRWLRQTAPRLDPSETALEQVKALGYSPADVRHVLLTHLDRDHAGGVPDFPHAAIHVHRAEYDMAVQSRPAPPEGRYVTGQWSHGPSWTFYGEAGEDWFGFKGVRALGDKEADILMIPLAGHTLGHCGIAVRSGDTWLLHAGDSYFHHGQLAASPRMPLVLGYFQRRADMDRTQRIANQARLRALKLAHGDRVRIVNSHDPVDYENCRCGTH

SEQ ID NO: 19758 - protein, 776 aa, Bradyrhizobium japonicum USDA 110
MSRADAANACVQSDSIKGLAQSIAKPAYHRLLIAEPALRRAVPTLIIAFLITICLGAFVQVVDQTRQKRLVIRHDISALADLLAERIDRLTSSRQERLKNIESLPALLPDLIPSWGTATGRHVIVTSAGVDRRILARIPVDSDPSGNDRLLDSITTAQLLAAPPRDGNISDMTLPNGNAAMAISRQIKSLPGFVTVIQERNEPIWGSDAALSVTLSATTGFVVLILGFAFHWQSTRAREGDLINDAVRGRIDTALNRGRCGLWDWDLSRGRIFWSQSMFSMLGLDGRNELLTFGEVNALVKSDDIDLFEIADQLISEKIDHIDQTFRMQHVDGHWIWLRVRCEKTSGATDSSVHLIGIAVDITEQKSLAERTVEADLRLRDAIETIPEAFVLWDASDRLVLCNSHFQRLHKLPDSAVIPGTSYETVLEVGRMPEVRTRHNETAAQGPGARTFEAQLDDGSWLHISERRTKDGGYVSVGTDITRIKEHEQKLVDNDLRLRATVIDLKRSQAALERQTNELADLAEKYQREKTRAEEANQTKSKFLANMSHELRTPLNAIIGFSEIMGSGLFGELGSEKYQEYCQDILTSGHYLLEVINDILDMSKIEAGRMKLDMEELDLARTLAESLRVVSGRAQDKHLTLDADIEKSISVVADRRATKQIIVNLLSNAVKFTPDGGRIVVRSRQLDDRIVLMIADTGIGIAPHSLARLGRPFEQVESQLTKTYHGSGLGLAIARSLAQLHGGSMRLRSKIDVGTVVRVTLPRDAVKAASGISAAA

SEQ ID NO: 19759 - protein, 220 aa, Bradyrhizobium japonicum USDA 110
MDQGRPKPDLIIFDCDGVLVDSELLSCRCLSEVLAEFGLALSEEQALELFLGRSTRAIEQHYRDLGQVVPDGFLPRLKSRVLETFSASLEPIPGVGAVISGLAAPFCVASSSDIDRVSLSLDVTGLRAHFGARLYTAQMVRHGKPAPDLFLHAAAQMGAEPARTLVIEDSVSGVQAGRAAGMTVWGFVGGSHYRARDGRAILSAAGTDRVFARMSDFWEM

SEQ ID NO: 19760 - protein, 257 aa, Bradyrhizobium japonicum USDA 110
MYLEKFKLDGKTAFITGGGQGIGLACAEALAEAGARVVIGDRDSKVADSAKASLKAKGFDAETAIMDVTDTRRVAEVANDLVARHGKVDILVNNAGIARSETPAETVTDEHWLNVIDVNLNGTFWCCREFGKHMLKAQSGAIVNVGSMSGFIVNKPQEQCFYNASKAGVHHLTKSLAAEWGARGIRVNAVAPTYIETPLNAFVKSNPKMYDAWIGGTPMARMGQVEEIASVVLFLSSEAASLMTGSIVLVDGGYTCW

SEQ ID NO: 19761 - protein, 897 aa, Bradyrhizobium japonicum USDA 110
MNEQVDQGHLRTPPGRLFRKYLYSIVALAFAALAINTGFDVWFSYREQKQLLAATQREQAASAAIQIGQFIGQIENQIRWLSRLPPELSTNEDERLNAIRLLRLSPAIAEIAELDAQGREQVRVSRRVADRVGSKIDLSASPAFRGANESRTYYGPVYFIGDTEPFMTLAARGVGRGPNVIVAEVNLRFIWDLVAGIRVGNTGKAYVVDRMGLLIAHPDLWPALRRSDLSGHADVRAALDGAGPPSGGLVKEDLSGQRVLSTYATVPSLGWLVFVELPLTEAYAPIYASIGRSTFLLVALLACAVLVSLFLSRRMTVPIQILTQGARRIGSGDLGLRLAIKTGDELEALGDQFNRMAAHLRESYATLERKVIERTSELEKARDHALAEHDAAERARSIAVQANETKSRFLAVVSHELRTPLNGVMGVLQLLDDGSLGEAQRRHLATAAASGETLIALVDAILEYARLEASAETLEMRDFRLDQLIEAAADLMRPQAFGKGLTFDLASDVTVNTSVHGDPVRLNRILLNLIGNAIKFTPRGGIGLKASAEQHEDHILLSITVRDTGIGIAPDMHERIFEDFVQADDSIARRFGGTGLGLAIARRLTRLMRGELTVESTPGAGSTFALEVPLGLAASGIAQGALPPPSRRLRVLLVDDDPVNCQVGEAILNRLGHHPTIARNGASAVALARDQAFDIILMDLHMPDMDGVEAASQIGKLGLPRMPRIIAVTADVSRSARERLASAGIAKVVSKPILINALREAIEDDPPDQPAEVRLAAGALIDRHFLDDQKELLGATQIAKLHQLLRQTSQQRIEDIAEAAAIDDHLQLARSAHQLGSAASALGLVRLFERCREVELAVATMSASECHGAARELAALQKASMSALDELLLPVEQRSVS

SEQ ID NO: 19762 - protein, 259 aa, Bradyrhizobium japonicum USDA 110
MDLKLTNKTALITGASKGIGLAVAELFAAEGCHLHLAARNGEAMLQAKRDLEARFGVKITIHALDLSSTAAMEKLAAEVGDIDILVNNAGDIPAGSLEILDDAAWRRGFDLKVFGYITLSRLYYPRMKGKDGVIINIIGNSGENWDASYIAGSTGNAALMSFTKALGGRSLDHGVRVVAVNPGPVATDRMLKIMKRKAIDMLGDESRWEELFDKYPGKRPATSEEVADLVAFLSSPRSGYITGTVVTIDGGIAARGSVI

SEQ ID NO: 19763 - protein, 249 aa, Bradyrhizobium japonicum USDA 110
MRLQGRTAIITGAGSGIGRASAKLFAAEGARLALVDRDAAGLQETLGLVREATVHVGDVGDAALAETVAGDVVARHGRLDILMTAAGFSCGGTVLTTSPDDWDAVFRANVGGTWLWARAAVPHMQRQQSGSIITLASQLAIAGGKGNSAYIAAKGAIVSLTRTMAVDFATDGIRVNAIAPGAIDTPMLRRSFARHANSDEVREASRNRHAMKRFGTAEEIAQTALHLASDASSFTTGTVMVVDGGWLAA

SEQ ID NO: 19764 - protein, 293 aa, Bradyrhizobium japonicum USDA 110
MTKAKTRLAYMGAGVAVVIWGATPAATAIVARELSPGLIGLARLLLSATILIPIAVSLKPELPSDRGGWIALLISALVGFAGSFVLQGVGIARTSTSHAALVLALAPIFTATVHFLLSRCWPRPLWWLGSAIALMGVAILIPGRNPAGSVAAPTLFGDLLVLAGTVTVSVGYVAGARLSARIGLFAATCWSLLLAGLITLPAFPALASALGQLSFAVWGALGFLAVFCTLIGFAVWFWALEHGGVTSIAPLQFGQPLVSLVIAVAFLSEDIFPATLLALSLVILGVHLSRRAA

SEQ ID NO: 19765 - protein, 256 aa, Bradyrhizobium japonicum USDA 110
MSDGRGQAGLLKDRLVVVTGAGQGIGRAIALGAAAAGARVVVTDLGQDRADSVAREIRDGGKEAIGCSLDVTDALACGEVARRVDEELGLADVVVNNAGIIIREPIDSPRAHENWRQVFDVNVNGTFNVVHAFIPALRKSPGTIINVASVAAFGSMGGTVGYSSSKGAVRLFTQALARDLAPDGIRVNAVAPGIIATEMSESTRGNPARLSGLMARTPLKRVGQPEEIAAPVIFLASAMASYVNGVILPVDGGYLA

SEQ ID NO: 19766 - protein, 539 aa, Bradyrhizobium japonicum USDA 110
MQGSATGLAYRGRTASIGFAHGPLVRVGADTNGERVAGNLAEEALALRAAIDAASGQIADLAGIAGGEAAQILEFQVALLEDEDFIQAIFASIGDGDPADVAWRSALDAQIADYNSAADEYLKARSSDLADLRDRVINILRGDGGPALEIPSGAVVCADDLPPSRFLEIDWSGGGGLALLRGSPTSHVAMLARARGIPMVVQLGAIPDVRANALLDGEGATLELDPSAEQVRLFEKRRESHRKSRASARAILRRPTASWRGERIKLFINIQRVDDLEHPDAQYADGIGLMRTEFLLTERGSLPDEETQFQAYDAVLRWADQRPVTIRTFDAGGDKPVAGFTLDGEANPFLGVRGLRLCLARPEIFAIQLRALARAAVRGNLKVMFPMVTSAAELEAGRKLFADVVQRLQADGIAAMLPELGIMVEVPAAALAITSFKTSFFSIGSNDLAQYVLACDRSNGALAPLMDPLHPAVLELIARTAEHGRRAAISVSLCGDMASDPRCLPALLNCGLRELSVNASALAQIKQTIDRLSSGGGLD

SEQ ID NO: 19767 - protein, 599 aa, Bradyrhizobium japonicum USDA 110
MSRWITMRMPRELDCGIKRLCATIGLAALIGLISPHAHATGGLSISNPDGAAVRALVIGIDDYQHVRKLKGAVADATDIVTSLKSMGVGDVVVLTNAQADRASILREISSLVERTKNNDLIFLSIAGHGTQEPERVKGSEPDGMENVFLLPGFETTPTGSIERVLGSEFNHFIRQFELRGAKVIFVADTCHGGGMVRDIDPRAAEMSFRQVPRYTLLVDELKPVSDSNDPKSELDLDHTAFLAAVDRYTKAPEVRIPGIDGLRGALSYAVARAVEGSADINHDGKVTLKELFSNVRQVVYQLSDQRQNIVTISSPPQTPDTDIAFELTRGVVLIQGPAARAASGPAGSGAPVEGQAPAPPAVTAKAPNIPTLAAAATKELPTGDAPAPLRLAAPIRLAALDGKTNYFASVAPKDVPVQAVQPTDNPDLIWDPVSHDVIAWGDVVAYGIDVASLPTVVDRTAAIRELKRIATRSPQIMRIWPDDRQQRAGQTVEVDLSDVGSRAVLLFNVSGDGTIQLLYPVGSDAALARSASLRLPLRVGEPFGAEQIVAVTSQQRMVDLETVLMQLNRRRASGQVIKSLERYLPADARIASVGFFSAP

SEQ ID NO: 19768 - protein, 264 aa, Bradyrhizobium japonicum USDA 110
MAWINLSAKVAVVTGGGAGIGRGIALGLSAVGATVVVLDRDEAGAAVAAEISASGGRAEFLACDVTRDDSVARAAGEVAAKVGEATILVNNAGTMLPGGLDTTSMADWDRILSLNLTGYLRCARAFGEPMLARGAGAIVHVASISASFPQSYSGAYSVSKAGVAVLSRQLAVEWGPRGVRSNVVSPGMIRTPMTEAIYQTQGVYEARRALVPARRIGRPEDIADAVVFLASERASYITGEEIVVDGGFTRTLMGTIPRPGFEKS

SEQ ID NO: 19769 - protein, 546 aa, Bradyrhizobium japonicum USDA 110
MQKARVRRGQESCCLMSNPAEKPEVVQLPAEPVSAPSASSRRAAAQRVREARDKLTSTSGTRPAFDAEMLRQYAQTRLSASYVVMLLVVATGVLFGLWMQPIPAAAWTAGMLCIHGAMIRSCRRFLTEPASPAATRAWRTRFVVLDLLYGLCWMAILIHPVLDMVTETLMMFLMLLVIAVSSMLAANLPIAALAATAPVAVAMALSFAVTGSLDNYILAALALAAEGYFVLLAHRLHSSTFATLEARAEKDALIGELEQAKAISDEARHRAESANVAKSRFLAQMSHELRTPLNAILGFSEVMKSEIFGAHAVPVYKEYSADIHNSGVHLLNLINEILDLSRIEAGRYELNEEAVSLVGIVADCHHLMKLRASSRGITIHEVFEQAMPRLWADERAIRQVVLNLLSNSIKFTPQGGEIWLKAGWTASGGQYLSVRDTGSGIPEDEIPVVLASFGQGSNSIKSAEQGAGLGLPIAKNLIDLHGGTFTLKSKLRIGTEVIVTFPPERVMSALAPLSDDSPPLQPEGSLAPDEKRRPRHKPIMSAGTGS

SEQ ID NO: 19770 - protein, 389 aa, Bradyrhizobium japonicum USDA 110
MGHILDSRRCALSVTQQQVLDSLARIKSPRGVALPNANVLSAISASDGKVFFSINVDAAEARAWEAVRAEAEAAVRAIPGATTVMVALTAERKPGSAPPPPPTPSRGTPGVQPVHAHKPPQGGGSPMARQSEIPGVAAVIAVASGKGGVGKSTTALNLALGLRDLGLKVGLLDADIYGPSVPRLTGLRDKPELDGERKMIPLRRFGLAIMSIGFLVEEETAMIWRGPMVMSAVTQMLRDVAWGSLDVLVVDMPPGTGDAQLTLAQNVPLKGAVIVSTPQDLSLIDARRGLAMFRKVNVPVLGIVENMSYFQCPHCGTKSDIFGHGGARHEAEKLGVPFLGEIPLHMAIRATSDAGNPVVDSEPDGPHAAIYRAIAGQVRDQLKGAIAAA

SEQ ID NO: 19771 - protein, 587 aa, Bradyrhizobium japonicum USDA 110
MMARLLSVNVGLPRDVAWQGKTVHTGIWKAPVEGPRRVRRLNIDGDGQGDTAGHGGEQRAVFVYQDESYRYWQEHLGRPDLVHGQFGENFTVEGLADTNVCIGDRYRIGSALFEVTQPRVTCYRLGIRMDEPDMPALLVRHGRPGFYFRVIEEGDVEAGDEITLLANGPESMSVFEINALLYLPPHPRDRLERALRIPALSRGWNRSFASLLEQQRTSKIAAGNAGLGPAASPPPAWRGFRPFRVSRKIAESGTVTSLILEPTDGHRAAPALPGQFVVVRLGPSEAQAMTRSYSLSSRSDAPPYRISIKREAHGAASLYIADSLRVGDVVEVGAPRGSFTLRQDARPVVLLSAGIGVTPVLAMLHALVAEGSTRDVWWLHGARNGREHAFAAETRGLLAGLAHYHSHVCFSAPDPADRPGADFDSAGHLDQHLIERLNMPRDGDFYLCGPAAFMSDLTAGLAALGVAPDRIHTELFGARPSLTPGIAASPRTPAHAPVGAPGPGPMVSFARSGLNVRWGPSYASLLELAEACDVPVRWSCRTGVCHNCESGLVAGEVSYAPDPLDPPADGNVLICCSQPKADVVIDL

SEQ ID NO: 19772 - protein, 518 aa, Bradyrhizobium japonicum USDA 110
MRHRKLQRPFQHQERDGRDPRAAVRLVSRHGQSEATELAKLQAADRPEKVGRINGDNSQGRASMSTSVNAGGRLDRLPVGPFHRRIMLLIGIGMFFDGFDIYIAGTVLSVTLKTGFSTLAQNAAFISATFVGMMLGSFGTGFLGDRYGRRFTYQFNLLLFGIASLAAAFSPNMAFLIACRFVMGVGLGAENVVGYSTMTEFVPARTRGKWLGFTAVCVVTGLPVALLVASVLVPQFGWRSMFVLGGVGALVVWYMRKSLPESPRWLEAVGRTAEAETLMQAIEKEAAQGQPLPPPAATAPAPVSPDLGTLFTAPLLSRMIVGAVCLITINTLLYGFVTWLPVFFVKQGLSIATSFGYSLLMAIGAPVGAAIGALTADRWGRKPTIIGASLIAVALGVLYPMISDPILLPAVGFALTVPIYVLVALLFGIYIPELFPTEVRLRASGIVNTLGRGATIVTPFLVVSLFETRGVAGVMALMIGLLVVQIITVWALGIEPRHRSLEELKAEESASPVLKEAS

SEQ ID NO: 19773 - protein, 497 aa, Bradyrhizobium japonicum USDA 110
MATVQVQGIREALTFDDVLLKPGLSDVMPGEVDIRSRVTRAIPLNIPIMASAMDTVTEARMAIAMAQAGGLGVIHRNFDPEGQAAQVRQVKRYESGMVVNPLTISPEATLDDALKLMSDHGISGIPVVTGAGKSTPGKLVGILTNRDVRFATDRRQKVSELMTHEGLVTVRENVSQDEARRMLHQHRIEKLLVVDEQYRCVGLVTVKDMEKAVAHPLACKDAQGRLRVAAATTVGDTGFERTERLIDAGVDLVVVDTAHGHSRHVLHAVNRIKRLSNSVQVVAGNVATSEGAQALIDAGADCIKVGIGPGSICTTRIVAGVGVPQLTAIMDAVEAAKKADIPVIADGGIKFSGDLAKALAAGADIAMVGSLLAGTDETPGEVFLWQGRSYKAYRGMGSVGAMARGSADRYFQQDIKDTLKLVPEGIEGQVPYKGAVGHVMHQLAGGLRAAMGYVGAKDMKELHDKAQFVRITGAGLRESHVHDVTITRESPNYPGGG

SEQ ID NO: 19774 - protein, 245 aa, Bradyrhizobium japonicum USDA 110
MFDLTGKKALVTGATGGIGGAIAQALHAQGATVAISGTRKEVLDELAGKLGERTFVLPCNLSKADEVEALVPAAEAAMGQVDILVANAGITRDNLFVQLRDEDWDEVINVNLTSTFRLARAATKLMMRKRFGRIIAITSVVGVTGNPGQGNYTASKAGLIGMIKTLGAEYAKRGVTANCIAPGFIKTPMTDALNDKQRETILTKVPAARLGTPEDIAAAAVYLSSNEAAYVTGQTIHVNGGMAMI

SEQ ID NO: 19775 - protein, 303 aa, Bradyrhizobium japonicum USDA 110
MPPNDNRIDARDWSLLAVLSILWGGSFFFNSAGLRELPPLTLVFLRVALGAAVLLPLLHVQGISFPKGTLGWKPFFVIGLLNNVIPFSLIVIGQTIIPSGLASILNATTPLFTVTVMAMAGEEALQMRRVAGVVLGVVGVVILRGWGIETRPGQGFGILLCLGGACSYGFAALAARRLLKDSAPLGTATFQLMASTVMMAVVAAVMEQPWHLPAPGLTTWLAVLGLAGLSTALAYIVFFQILRRSGATNVMLVTLLIPVTAILLGWLVLGEPISMREIAGAIVIGSALLVIDGRALRMLQRVA

SEQ ID NO: 19776 - protein, 256 aa, Bradyrhizobium japonicum USDA 110
MTSSRFDLRGKVAIVTGGNGGIGLGLAHGLADAGADIAVVGRNETKSAAAVADLRQRGVKAIAVTTDVTDQAAVAAMIDRVVKEFGRIDILINNAGMSIRKPPHELELDEWNKVIDTNLTSAFVCSKLAYPALKASGNGKVINIGSMMSIFGASFATAYAASKGGIVQYTRACANAWAPDNIQVNAILPGWIDTDLTRGARQQVSGLHERVLARTPAGRWGEIDDFAGIAVFLASPASNFVTGTAIPVDGGFSVMA

SEQ ID NO: 19777 - protein, 333 aa, Bradyrhizobium japonicum USDA 110
MSTHISVPPHALLERILTLEIVRVTERAAVSSARLRGHGNEKAADQAAVDAMRRELNKLPIEGTIVIGEGERDEAPMLFIGEKVGMNAGPQVDIAVDPLEGTTLCAKNMPGSIATMAMADGGTLLHAPDVYMQKLAIGPGYDKGVVDLDASPADNVRRLAKAKGVQPDGITVLVLDRPRHASIIESVRSTGAAVRLITDGDVAGVIHCADPDNTGVDMYLGTGGAPEGVLAAVALRCIGGQMQCRLILDSDEKRERAAKMGVNDPKMIYGIEDMARGDCLFAATGVTTGSLLSGVKFRKDGVIETETVVMRSVTGTVRYIKAEHRELAKFHLD

SEQ ID NO: 19778 - protein, 212 aa, Bradyrhizobium japonicum USDA 110
MPDTKLTIWGRANSVNVQKVLWCLTELGLRYERIDAGMQYGKTREAEYLAMNPNARIPTLVEGDFVLWESNSIMRYLCLAHGRGTPIYPDAPKQRASVDRWLDWTLSTVQPVDRPVFWGIVRTAPAERDMIQVQRDADAAVEVWAIADRLLSTRRFMEGDQFTLADIAVGSYARRWLGVEGITRPAQPNLTRWLAELGNRPGFAQFVAPPMS

SEQ ID NO: 19779 - protein, 254 aa, Bradyrhizobium japonicum USDA 110
MNISFEGQVALVTGAASGLGLATAKAFAESGASVALADWNEDAVRAAAGELVTRGHKAVAIRCDVSNDAQVEAMVAQTVSVFGRLDAAYNNAGVQNVLAETADTTREDYDRVMGINLRGEWSCMKFELQQMRKQGSGAIVNCSSLGGLVGGAERGIYHAAKHGVLGFTKSAALEYAARGVRINAICPGLIWTPMADQMVAAGQGDALRALEKSVPMGRVGRPEEIASAVLWLCSDAASYVTGQSISVDGGFIMR

SEQ ID NO: 19780 - protein, 809 aa, Bradyrhizobium japonicum USDA 110
MSGYIRSFLEIGLGDVGLVGGKTASLGELYSALASQGVAVPDGFAVTADAYREALSRDGVADKLHRLLDGIDKSKIRQLAGKAAKAREVIYKAMDTPLLREQIVEAYRHLEREAGIGVAVAVRSSATAEDLPTASFAGQHESFLNVRGPKDLFEACRRCFASIFTDRAISYRIDNGFDHFKVALSVAVMKMIRSDLAASGVVFTLDTETGFRDVVFVTGCYGLGETIVQGQVDPDEFYVHKPTLSQGFRRVLRRRLGAKQIRMIYGKLGSSHATSTRNVPDAERQKFCISDPEVLSLAEIAVRIEAHYSKHAGVSMPMDIEWAKDGVDGKLYIIQARPETVASQRSSDFYETYNLKGHGPVIVNGRAVGEKIASGRTRRISTARDLAAFRPGEILVAPATSPDWEPVMKIAAGIITDKGGRTCHAAIVARELGIPAVVGATHATEKIKSGTDVTICCAEGDIGSVYQGAVAFDVTRTPVSELRQPRTAIMVNVGTPEMAFRTAMQPQAGVGLARMEFIISEHIGVHPMALLKPEKVTSTKARTAIARLTKGFKSPADFFIQRLAEGVGTIAAAFYPKPVIVRLSDFKTNEYASLIGGEGFEPREENPMLGFRGASRYSHPAYTEGFALECAALRLVRKEMGLSNLRVMVPFCRTVEEGRRVIATMAANGLRRGEDGLEIYVMCEIPNNVIQIDAFSRLFDGFSIGSNDLTQLTLGVDRDSDIVAFDFDERDPGILELFRQAVVGAKRNGRHIGICGEAPANYPEIARYLTGLGIDSISVNPSSVFRTMAVVSDAETNQPESETRGLLSL

SEQ ID NO: 19781 - protein, 775 aa, Bradyrhizobium japonicum USDA 110
MGWRVETSQQAEPRDGLVGAFLYWLGGFEIEDGLTADLSERELGRIRAKQIDAVTRLIPVTMAVTMLNVAIVLILFWGRGWNDFLAIWGLTLAATASLAVRSWRRSYRNPPQEASPRAARHMLRQAFFLAAIWGTLPLALFSHIEPTSQLILACLMVGMMSGGAFTLSTFPRAGLVYLATMTVGCAGALLLCGAGPYLVTAGFLLLFAFFMARNIVSQGNLFLGNLKAQLELERQTEIISLLLKDFQENASDWLWQTDAEGHLVDVPERFADVAQLPLPLLKGSHFADVLDMLCPEDKSAAYNIVGLMEHAEPLHEMNLKVVAGGEARLWSFTAKPAYDRDGQFLGYRGFGRDVTERWRAEKAEAESRAKSDFLAVMSHEIRTPMNGVLGLASMLLETRLDPEQREAVATIRESGDNLQRILNDILDLSKLEAGRFAFEAIDFAPHALVETVATVVRASAKSKGLTVKVELDPNLPPTLRGDVARIRQVLLNLASNAVKFTDEGEVTISATCQTRRDLLATVEWTVKDSGIGIAPEKLGLLFSDFAQADASISRRFGGTGLGLAISRRIIEQMGGTIGVTSTPGEGSTFRFTLVLPWSQAPASDQAAGRDEADELKAHIAELDRPLKVLVAEDDAVNRLVVSKMLGAFDVELRVVTDGVEAVAAASEGDYDVVLMDVRMPDMDGLAATRAIRAQGGRFEALPIIALTANAFPEDVKICREAGMSDFLAKPLRKPALVAALLRALNHVASDDAPLQPELMPVEVEWTEEERQITGA

SEQ ID NO: 19782 - protein, 463 aa, Bradyrhizobium japonicum USDA 110
MPIQVLMPALSPTMEKGNLAKWLKKEGEAIKSGDVIAEIETDKATMEVEATDEGTLGKILIPEGTADVAVNTPIATILADGESAADLAKAPAPAPQPKAAESAAPAAAKAEAPAPRAAPSAPQAAAEPDPEVPAGTEMVTQTIREALRDAMAEEMRRDADVFVMGEEVAEYQGAYKVTQGLLQEFGAKRVIDTPITEHGFAGIGVGAAMTGLKPVVEFMTFNFAMQAIDQIINSAAKTLYMSGGQMGCSIVFRGPNGAAARVAAQHSQDYSSWYSNVPGLKVVAPFSAADYKGLLKAAIRDPNPVIFLENEVLYGHTGEVPKLDDFVIPIGKARIVRSGSHVTIISWSNGMTYALKAADELAKDGIEAEVIDLRTLRPMDTETIVNSVKKTGRAVTVEEGWAQSGVGAEIAARIMENAFDYLDAPVARVSGKDVPMPYAANLEKLALPSAAEVVEAAKAVCYR

SEQ ID NO: 19783 - protein, 427 aa, Bradyrhizobium japonicum USDA 110
MTAIIDIIGREILDSRGNPTVEVDVVLEDGALGRAAVPSGASTGAHEAVELRDGDKARYLGKGVTKAVGAVNGEIFEALSGLDVEQQAQIDQIMIDLDGTPNKSRLGANAILGVSLACAKAAANSLDMPLYRYVGGTSARLLPVPMMNIINGGVHADNPIDFQEFMILPVGASSFAEGLRYGAEVFHTLKSELKKAGHNTNVGDEGGFAPNLPSADAALEFVMNAIGKAGFKAGSDIVIGLDCASTEFFKDGKYVYEGEGKTRSISEQAKYLADLVARYPIVTIEDGMSEDDMDGWKELTDLIGKKCQLVGDDLFVTNVKRLAEGIKAGRANSILIKVNQIGTLTETLAAVEMAHKAGYTSVMSHRSGETEDSTIADLAVATNCGQIKTGSLARSDRTAKYNQLLRIEQQLGKQALYGGKAALKALA

SEQ ID NO: 19784 - protein, 407 aa, Bradyrhizobium japonicum USDA 110
MSAVPLRNNKAAASAVRSVTVLGATGSIGDSTMDLLRASPERYRVEALTANGNVEALAKLAKEFSARFVAIADTSKFAELKAALAGTSTECGAGESAVIEAGARPADWVMAAVSGAAGLKPALAAVDRGAHVALANKECLVCAGDFFMQRAAKAGACILPADSEHNALFQALGSGNRDELVRVIITASGGPFRTWKPADIEQATLAQALKHPNWSMGQKITIDSASMMNKGLEVIEASYLFALSPDEIDVLVHPQSIIHGMVEFSDRSVVAQLGSPDMRTPIAHCLGWPDRIKGPAAKLDLAKIGQLTFEAPDFERFPGLRLAYDSLRTGKGATTVYNAANEVAVAAFIAGKIRFGAIARLVEATLEDWIRGGNQTPLTSADDAISVDHVARNRAAALLPQIALKAS

SEQ ID NO: 19785 - protein, 396 aa, Bradyrhizobium japonicum USDA 110
MTITQRDRDLGTAYAMKPAQTRTELTSVVRGTPMGELLRRYWHPVGLIGDATDTPKKVRALGEDLVLFRDKHGRAGLLHARCCHRGTTLYYGKVEEDGIRCCYHGWKFDTEGHCLEQPCEPDGGQFKDKVRQPWYPVEERYGLIFAYMGPAEKRPVLPRYECLENMDDGEFVEADDSSIGGGGPAVIPCNWLQHFENVVDPYHVPVLHGSFSGPQFTDMMASMPEVKFDKTPRGIAVRSIRRQDDGKVFYRVTEAALPTLRVVPNPRVAQFARVESIGWTLPIDDTSFRIYVAGRVRTSGDIGRMRSKFNGKFWWDMTEAEHQQFPGDYEAQVGQGPLTVHSEEHFGQSDRGILMIRRMLSEQLEAMEADRDPIGVSFDVGAAPVEFEAGNYIRDA

SEQ ID NO: 19786 - protein, 112 aa, Bradyrhizobium japonicum USDA 110
MKKIEAIIKPFKLDEVKEALQEVGLQGITVTEAKGFGRQKGHAELYRGAEYIVDFLPKVKIEIVIGDDLVERAIDAIRRAAQTGRIGDGKIFVSNIEEAIRIRTGESGLDAI

SEQ ID NO: 19787 - protein, 276 aa, Bradyrhizobium japonicum USDA 110
MTSRIKLAFAAAALALFSHAAMAQSEKPGVERLYVLNCGEGTAGDISRWTPGLNEGKSMDFVDSCYLVKHAKGWFLWDTGIADSVAAMPNGLVPADPKAVTWRRPKTLAAQLEQLGVKPDDVKAMAVSHTHPDHSGNVELFPQAVLYVQKAEYDWPGANNEPRFKPSHPVEQLAGDKDVFGDGSVTILSTPGHTPGHQSLLVKLPKTGAVILSGDAVHFRDNWDNRRVPSMNVNKDQSAASMQKIADTLSREKAQLWINHDKAQRDSQKMAPEFYD

SEQ ID NO: 19788 - protein, 308 aa, Bradyrhizobium japonicum USDA 110
MFNNAALPAPSVDAGLSKYLVEIRKFPLLTPEQELAYARRWREHRDRDAAYHLVTSHLRLVAKIAMRYRGYGLPIAEIVSEGNIGLMQAVRRFDPDRGVRLATYAMWWIRASIQEYILRSWSLVKIAASASQKKLFFKLRRAKSAISALQDGDLRPEQVRLIAERLKVAERDVVAMDRRLRGDASLNVPIHDEDEGGQTLDWLVDPAPTCEITLAEEQEAKQRRLALANALANLNARERNIFTARWLNEESTTLEELAAEYGVSRERVRQIEERAFQKVKAAMLTSRHEANGPPSSRAKEMKQGVARA

SEQ ID NO: 19789 - protein, 272 aa, Bradyrhizobium japonicum USDA 110
MLFVEANGARIPAIGLGTWELSGRPCARVVEQALRLGYRHIDTAQVYDNEREVGDGVRASGVRRDDVFLTTKVWTNHFAPNDLERSVKESLARLRLPSVDLLLLHWPNSHVPLAETLGALSHARQMGLTRHIGVSNFTVALIEQAVALSPEPLVCNQVEFHPYLDQAKVRAACDQHGLALVAYSPIARGRIKTDQTLAGIGRAHRKTPAQVCLRWLVQQNVAAIPRTSRIERLSENIEIFDFELSDDEMARIAALANPKGRLTDFGFAPKWD

SEQ ID NO: 19790 - protein, 255 aa, Bradyrhizobium japonicum USDA 110
MSTALFDLSGHTALVTGSSRGLGRAIAEGMAKAGARLIINGVDPKRVEQAVAEFRAAGYLAEGAAFNVTDEPAIVAAFNDFDKKGIEVDILVNNAGIQHRKPLVEFTTDEWRKVIETDLTSAFVIGREAGKRMIPRKRGKIINIGSLGSELARPTIAPYTAAKGGIKNLTRSMAVEWAQHGIQANAIGPGYMLTDMNEALVNNTDFNNWLMGRIPSKRWGRPDELVGAAIFLASDASTYVNGQIIYVDGGMIAAM

SEQ ID NO: 19791 - protein, 290 aa, Bradyrhizobium japonicum USDA 110
MNHNQEALTARAAPILFVLLWSTGFIGTKYVISNADPLTYLAIRMAIVVGLMAIIAGIARPKWPNRIGIAHSAVAGILVHGFYLGGTAIAIAHSIPAGLSALIPGLQPILTSTIANRWLGEKVTPVQWAGLVLGLGGVVLILHNRPTTGEAGLGWLASVVSLISITLGTLYQRRYCNHIDWRAGNFVQYVAVTIFFAIGAFLFEDRVVHWTREFVLALAWLTVALSIGSIGLLYWLIRHAAATSVASLFYLVPAVTALMAYALFDEKLDALAIAGMAMCAAAVFVVNRRV

SEQ ID NO: 19792 - protein, 319 aa, Bradyrhizobium japonicum USDA 110
MRNTAMNMVHKLAARDERVLYIGSDPGAGTLRAMSKEFPKRHLIEGISEAHIIGMSAGLAMEGFVPYVNTIATFLTRRCYEQVAVDLCLHNLPVRLIANGGGLVYAPLGPTHQAIEDIAIMRALPNMTVVCPCDADEAARMMEQTLDWKGPIYIRLGKGGDAIVSKAEHGFEIGKAILMRPPGDVLMVTTGIMLQRALAAADLLAAQGVRAGILHMHTVKPLDTEALLQAIRGIKLVATLEEHVPSGGLGSAVAETLIDKLGAGLPAMLRLSLPDSFMHNYGSQDSLLKKHGLSAGAIAASIERALAASHTASPQLHST

SEQ ID NO: 19793 - protein, 255 aa, Bradyrhizobium japonicum USDA 110
MTLFDMKGKVAVITGSTRGIGLAIAERMAEHGAKVVISSRKADVCDQVAKGINDRFDKGTAVAIAANISSKENLQNLIDESNRAFGKIDVLVCNAASNPYYGPLAGISDDQFRKILDNNIVANNWLISMVVPQMIERKDGSIIIVSSIGGLKGSTILGAYAISKAADMQLARNLACEYGKHNIRVNCIAPGLIKTDFAKALWDNPENLKASTSRSPLLRIGIPDEIAGAAVFLGSKAGDFMTGQTMVIDGGATIS

SEQ ID NO: 19794 - protein, 261 aa, Bradyrhizobium japonicum USDA 110
MGRLQGKSVIITGAGSGIGRAAALLFTREGARLIAVDRTEAMKETVEEVKKAGGVAEAMVADAGSEKDVIAVIDRAVKTHGRLDVIWANAGVSGGLIPLGEQTVEHWQEVLRVNLIGPFLAVKHAMPHMVKQQSGAIVLTASVAGLKAGASGHPYAASKAGVISLVQTTAYSLSGTGVRINAVCPGLIETGMTKPIFDRAKERGTADKIGQLNPLKRPGQPHELAAMGLFLASDEASYVNGQAFPVDGGLTASMPYAGKPV

SEQ ID NO: 19795 - protein, 489 aa, Bradyrhizobium japonicum USDA 110
MGALLPRGQASRPRTRHGRSPQNDRRQEARDVTGRHLAMVQRPGKMARWVLCCECLRRPMDLTLRLATALLTASLLLPLRPAQAQLAGHGGPVRAIAVSSDGKTVLSGSFDTAAIRWSLATESAEQVLRFHSGAVNAAAFLGDGRMATAGADGQIAIWTAGGLQPDQVLEGHTGPIVGLVVSPDTSKLASASWDHTVRISSLSDGGTRVLQGHSQSVNGVAFAPDGKSLVSVGYDLTVRIWPLAGGSPEIVVMPAPLNAVAISPDGEIVTGAADGKLRMMTADGKENGEVMAGARPIVALAISQDGALIATGAIDGTVAIVDRKARSVMRTLAGLGAPVWSVAFLPDGATLLTGGADGKIRRWNALTGAAIGSNVLGTPADPLAAYVGDHGAEMFRACVACHTLSENEVQRAGPTLAGLFGRKIASLPGYRFTDALKAMDIVWTPETVSKLFEIGPNAYTPGTKMPEQRIGSAEDRRALTDFLARATSK

SEQ ID NO: 19796 - protein, 317 aa, Bradyrhizobium japonicum USDA 110
MFQRVGGFRGARCCSLSGKPVRTLSPRLCYRTNKTSPFERADPMAVHQVNPGGKLASLDPIWDRIRSEAEDIVHREPELATFIYSTVLHHSRLEDSVIHRLADRLDHSALSGDLVRQTYDEALRDDPDLGNAFRADLVAVYDRDPATSRFIDPLLYFKGFHAIQTHRLAHWLWLKGRKDFAYYLQSRASAVFQTDINPAARIGRGIFLDHATGFVCGETAVIEDDVSILHGVTLGGTGKENEDRHPKIRHGVLIGAGAKILGNIEIGHCARIAAGSVVVKPVPHNVTVAGVPAKIVGEAGCAEPSRTMDQMINAMGL

SEQ ID NO: 19797 - protein, 465 aa, Bradyrhizobium japonicum USDA 110
MQHDAIAERRNNIAPIPFEADAPFLKIIGELPRELNGTLYRNGPNPQFDASGAHWFVGDGMLHAFHLENGRASYRNRWVRTPKWLAEHDAGRALFGGFGRKLPDAPADLTDGGVANTNIIFHAGKLLALEEAHLPTEIEPGTLATRGYHNYQGRIASSFTAHPKIDPVTGEMLFFGYNAAGPLTPALSFGSIDACGKATRFERFEAPYASMVHDFIVTANHVLFPILPIAGSMERAMSGRPPYAWEPDKGAYVGVMKRNGTAKDIVWFRGEACYVFHIMNAWEEGNRIVADVMQFEEAPLFPHPDGRPTDPEKSRARHCRWTFDLSGNTDRFQQTYLDDLTGEFPRIDDRRAGLKSRHGWYACANPKLPMFGALSGIVHVDGNGKRLGHYLLPAGDTISEPVFVERSSDAAEGDGWLLAVVWRARENRSDLAVFNATDIEAGPAALVQLGHRVPDGFHGNWVGAA

SEQ ID NO: 19798 - protein, 256 aa, Bradyrhizobium japonicum USDA 110
MLSRFKDKVVIVTGAGSGIGAAAARRFHGEGAIVVLNGRRESKLAEVGAELGTDRCMIRPADVTIAADVESLVADAVRRFGRIDILVNNAGTGALIDFLGSPIQQWRDLFAVNVDGVLYMTRAALPHLIESGGSIVNVSSLSGLGGDRGLSFYNATKGAVSNLTRSLALEFGPRGVRINAVCPSLTLTHLTMPILEQYPELLAKLVGRIPLGRAAQSEEVASVIAFLASDDASFVNGVNLPVDGGVDASTGQASFV

SEQ ID NO: 19799 - protein, 473 aa, Bradyrhizobium japonicum USDA 110
MNAKPGFTDYIVKDISLADFGRKELSLAETEMPGLMATREEFGPKQPLKGARIAGSLHMTIQTGVLIETLAALGADIRWVSCNIYSTQDHAAAAIAAAGIPVFAVKGETLTEYWDYTAKLFDWHGGGHPNMILDDGGDATMYVHLGLRAENGDTAFLDKPGSEEEEVFFALLKKQLKEKPKGYFAEIAKSIKGVSEETTTGVHRLYDMQKAGTLLWPAINVNDSVTKSKFDNLYGCRESLVDGIRRGTDVMMSGKVAMVAGFGDVGKGSAASLRQAGCRVMVSEVDPICALQAAMEGYEVVTMEDAAPRADIFVTATGNKDIITIEHMRAMKDRAIVCNIGHFDNEIQIAGLRNLKWTNIKPQVDEIEFPDKHRIIMLSEGRLVNLGNAMGHPSFVMSASFTNQTLAQIELFANNKDGKYKKEVYVLPKTLDEKVARLHLAKIGVKLTELRKDQADYIGVKQEGPYKSDHYRY

SEQ ID NO: 19800 - protein, 263 aa, Bradyrhizobium japonicum USDA 110
MGPSCAVTAMPDLSAFSLAGKIAVVTGASRGIGAAIASGLKEAGATVFGLSRSGTAPQGVTAIACDLSDDAAIGRAFNAIAAQGGRIDALVNAAGISLPPQSAESELARFRATVATDLTGVYATILAAYPLLKTTGSAAIVNVTSINSIRGFPGNPGYVAAKAGLAGLTRALAADYAPDGVRVNALAPGYVATEMTAKSYADPAMHEDRRRHTMLGRWGQPADMVGAAIFLASDASAYVTGQEIFVDGGWTAKGLAISSDSKS

SEQ ID NO: 19801 - protein, 253 aa, Bradyrhizobium japonicum USDA 110
MKLELDDRVALVTGASRGIGLAIAVALAAEGAKVALAARGSDALNAARATVGGDSSIHIADVTDPAAAAALVQDVDKQWGRLDILVCNVGSGASMPPGKETAAEWSRVMDLNFFATTNTIDAARPLMARGSGDRSIICISSIAGMAALGAPVTYYAAKAALNATVRGLARPLALEGIRINAVAPGNILAAEGTWARKLAENKAAVEDMLAREVALRRLGRPEEIADLVAFLASPRAAFITGSVMVADGGQLRS

SEQ ID NO: 19802 - protein, 369 aa, Bradyrhizobium japonicum USDA 110
MKTRAAVAFEAKKPLEIVEVDLEGPKAGEVLVEIKATGICHTDAYTLDGFDSEGIFPSILGHEGAGIIREIGPGVTSVKPGDHVIPLYTPECRQCKSCLSQKTNLCTAIRATQGKGVMPDGTSRFSYKGKPIYHYMGCSTFSNFTVLPEIAVAKIREDAPFDKSCYIGCGVTTGVGAVVNTAKVEPGANVVVFGLGGIGLNVIQGAKMAGADKIIGVDVNDSKEDWGRRFGMTHFVNPKKITGDIVPHLVNLTDGGADYTFDCTGNTTVMRQALEACHRGWGTSIIIGVAEAGKEIATRPFQLVTGRNWRGTAFGGARGRTDVPKIVDWYMNGKIQIDPMITHVLKLEEINKGFDLMHEGKSIRSVVVY

SEQ ID NO: 19803 - protein, 312 aa, Bradyrhizobium japonicum USDA 110
MTTSDSLRDTRIPTHESVTIPAVGFGTLIPDPLVTRQAIRAALEAGFRHLDCAERYRNEAAVGDAMQDAFKAGKLRREELFVTTKLWNTNHRPERVKPAFDASRRRLQLDEIDCYIIHTPFAFQPGDEQDPRDASGRVIYDSGVTLVETWHALERLVDEGHCKSIGLSDITLEKLREIVAVARIRPAMVQVESHPYLPEWDLLDFCREHGIVLQAFAALGHAMEPRVLEDPVITAIARRVQKTPAQVCLAWAVQRGTAFLTTSTNPARIRENFDISALPEDAMREIRDGITTNVRFNAVVETGVPGFIPRAR

SEQ ID NO: 19804 - protein, 244 aa, Bradyrhizobium japonicum USDA 110
MKSNFSLALGFHAIVIGGAGDIGAAISNQFCDLGATVTATGANEADLARTLLKPRAGLALATLDVTDDAAVTSFAGKYQRVDALINCGGILARDKEFEIETFMKVLDVNLTGTFRTCMAFQPRLAETKGSIVNIASMNATLALPRIPAYCASKGGVVMLTKALALKWAEQGIRVNSVAPGYVETAINAGGRADRAHYQRIADRTAFKRWGQPEDIAGAVAFLCMPASQYATGTVVVVDGGFLAG

SEQ ID NO: 19805 - protein, 248 aa, Bradyrhizobium japonicum USDA 110
MFAGRFQGRTAIVTGAASGIGRGVADRLRAEGAVVSLWDSNEEALLRRTDELGGTDIQVVNIASEQAVDLAMTRSVAALGGRLDILIAGAGISGPNRTTKDYSGDDWRRVIDINLNGTFYCNRAAVREMAQTGYGRIVNIASVAGKEGNPNASAYSASKAAVIGLTKSLGKELASTDVRINCVTPAAIRTPIFDQMAPEHIDFMLSKIPIGRFGRVEEVTALVLWLASDECSFSTGAAFDLSGGRATY

SEQ ID NO: 19806 - protein, 291 aa, Bradyrhizobium japonicum USDA 110
MKPADILIALLVAIIWGLAFVASRIALDEFSPELMTAMRFIIAAVPCLFIPKPKVAWSLLIAISFTLFLGQFLSQAYGIAHGVPVGLTSVVVQSQALFTIGFAAIAFGERPTQVQTLGIVIAAAGLLMICGTVGYDFSVAAFAVLMISPISFAIGNLLLRGARGVPMFDLFAWLCVASAVPLFVLALIANGPASTWTSLTHMSLTSALCMLMLGGISTSIAYWLWGRLLRDYPAAQVVPFALLVPFVGSAASSIVFGERFGPLRLAGMLTVIGGIAVMVLARRPQILPKTA

SEQ ID NO: 19807 - protein, 221 aa, Bradyrhizobium japonicum USDA 110
MTPEPPMPTITAFESSPDRGRGQARDMRVRWALEEVGQPYDVRLVSFAAMKQPAHLALHPFGQIPTFEDGDLALFESGAIVLHLAERYAGLLPLEVNARGRAIAWMFAALNTLEPPIVELGMALLFERDKSWYEARLPMLQDRVRTRLGELSARLGDADWLDGAFSAGDLMMVTVLRRLDTSGLLDEYPDIAAYVARGEARPAFRRAFEAQLAVFTAASRS

SEQ ID NO: 19808 - protein, 255 aa, Bradyrhizobium japonicum USDA 110
MALLANHIAVVTGAGSGIGRAIAAGYAREGAQVVLLDVNADTVAEGAQEIRKAGGRAESFALDVTRRDDCFALAKQVADKVGQVSILVNNAGITRRNAFTAETETVAKDWNDIISLNLNGVFNMTQAFLAPLRAAKGRIVNIGSIQSFVHLRTPSSAAYTTSKHGVLGFTKALAAELGKEGVRVNAIGPGFIETNINANVRATNPALVQAFVDHTPLARTGKPEDIVGPAIFLASDMSAYVTGTIVMVDGGYRTV

SEQ ID NO: 19809 - protein, 259 aa, Bradyrhizobium japonicum USDA 110
MKLSGKVAAITGAARGIGKACAKRFLDDGVKVVISDVDAEGLAATAVELGRPDALRTVVGNVGKRADVDQLVATAVKEFGRLDIMVNNAGVARNRDILEISEEEFDEIIGINLKGAFFGVQAAARQMIAQGGGGVIINMSSVNALLAIPALATYAMSKGGMKQLTSVAAVALAPHNIRVVAVGPGTILTDMVASAIYTSEDARKTVLSRTPIGRGGEPSEVASVVAFLASDDASYITGQTIYPDGGRLILNYTVPVKEK

SEQ ID NO: 19810 - protein, 255 aa, Bradyrhizobium japonicum USDA 110
MAEAAIMASDGLWQRVRGEAQRAADADPVFGKALAGTILAHDDFAAALSDLIGRRLGGSAAERARFSAFSFDAFRGSPDLIEVAGRDLQAIAIHDPAIADLLPPLLHFKGYVALQAWRVSNWLWHHDHRDAALLFQNEASNALQVSIHPAASIGSSVYLDHATGIVIGANVVIGDEVTILQNVSIGRGSELPTRSPRIGRGIYIGGGATILGDIRVGDFAKIGADALVTSDVPAGCTAVGNPARLTNCPEPASAA

SEQ ID NO: 19811 - protein, 262 aa, Bradyrhizobium japonicum USDA 110
MPQAPQKVALVTGAARGIGLATAKKFLGESWRVALLDIEGELLGRAVAEIGQSEATLALTCDVSDAAAVGAAMTTIERRFGRLDALVNNAGIAVFAPLMETPDADWRRVLEVNLTGPFLCTKAAVPLMRDSDGGAIVNITSISAVRASTLRSAYGTSKAGLAHLTKQLAVELASLNIRVNAVAPGPVDTAMAKQVHTKEIRADYHDAIPLNRYGLEEELAEAIYFLCSERASYITGQILAVDGGFDAAGIGLPTLRGQRRNG

SEQ ID NO: 19812 - protein, 278 aa, Bradyrhizobium japonicum USDA 110
MPQTDRSIPFPTRLVGQYALVTGASQGIGRAVAVRLAQEGATVAINYFDHPGKAEETLALARTASGDRGHGRLDHVIVQADIGSEQDIAAMFETILARWKRLDCLVNNAGFQRESPSDALDVETYRRIIDVNLNGAVLCAQKALAHFVARGGGGSIINCSSVHQIIPKPGYLAYSISKGGLANLTRTLALEFARHGIRVNAVGPGAIDTPINAAWTGDPEKRGVVTSHIPLGRVGTPEEIAAVFAFLASDDASYITGQTIYACGGLTMFPEFRENWAS

SEQ ID NO: 19813 - protein, 258 aa, Bradyrhizobium japonicum USDA 110
MSGTLPAGQRMRGRVCLVTGGGSGIGRATALRMASEGAEALIIAGRREAEIEATAAACREIGAAAIALKTDITREDDVARLVGIAVERCGRLDVAFNNAGFQERRAPLEEQGTEIYDSVFDTNVRALFLCLRHQLPAMLAQGRGSIVVNASVSGVRNPNPGFSLYSASKAAAISLTRSAAMENAPRGIRINAIAPGRVVTDMMLRAGVGDVATVAAGLPLRRMGSPEEVAEAVVWLSSDAASYVVGHVLAADGGFLAS

SEQ ID NO: 19814 - protein, 299 aa, Bradyrhizobium japonicum USDA 110
MARTAALPVLNGESGLSRYLAEIRKFPMLEPQQEYMLAKRWREHDDRDAAHQLVTSHLRLVAKIAMGYRGYGLPISEVVSEGNVGLMQAVKRFEPEKGFRLATYAMWWIKASIQEYILRSWSLVKMGTTANQKKLFFNLRKAKSKINALDEGDLRPDQVATIAKRLGVTDQDVIDMNRRLGGDASLNAPIRDDGEAGEWQDWLVDNTPNQEAMMAEHEEYDHRRDALNGAMGVLNPRERRIFEARRLADEPMTLEDLAAEFGVSRERVRQIEVRAFEKVQSAVKGTIARAEQAALEAAH

SEQ ID NO: 19815 - protein, 719 aa, Bradyrhizobium japonicum USDA 110
MATKAKTLQAKDKEKDDKAADAPEKDSQDAPSPLLDLSDAAVKKMIKQAKKRGFVTFDQLNEVLPSDQTSPEQIEDIMSMLSDMGINVTEADDSEGEEDKDEGGEDETDNELVEVTQKAVTEVKKSEPGERTDDPVRMYLREMGTVELLSREGEIAIAKRIEAGREAMIAGLCESPLSFQAIIIWRDELNEGKIFLRDIIDLEATYAGPEAKGGMNTAMIGGPTGENGEATAEGGEAVAVTGAAPAHVAPPAAPPAPTPFRAAPAAGNGAEAEKDPGEAAAEADMDEDDEFENQMSLAAIEAELKPKVVEIFDKIAESYKKLRKLQEQDIQNQLESTSHGPSLSPHQERKYRKLKDEIIVEVKSLRLNQARIDSLVEQLYDINKRLVSHEGRLMRLADSHGVAREDFLRNYTGSELDPRWLNRVSKLSAKGWKNFVHHEKDRIKDLRHEVHQLAALTGLEIVEFRKIVHSVQKGEREARQAKKEMVEANLRLVISIAKKYTNRGLQFLDLIQEGNIGLMKAVDKFEYRRGYKFSTYATWWIRQAITRSIADQARTIRIPVHMIETINKIVRTSRQMLNEIGREPTPEELAEKLGMPLEKVRKVLKIAKEPLSLETPVGDEEDSHLGDFIEDKNAILPIDAAIQSNLRETTTRVLASLTPREERVLRMRFGIGMNTDHTLEEVGQQFSVTRERIRQIEAKALRKLKHPSRSRKLRSFLDN

SEQ ID NO: 19816 - protein, 380 aa, Bradyrhizobium japonicum USDA 110
MTERIQEFLRNRRSEGRDTEPCLVVDLEVVRDNYQTFSKALPDSRVFYAVKANPAPEVLALLASMGSCFDTATVAEIEMALAAGATPDRISFGNTIKKERDIARAFALGIRLFAVDCAAEVEKIARAAPGAKVFCRILYDCAGAEWPLSRKFGCDPEMAVDVLDVAKRLGLEPCGISFHVGSQQRKVKAWDRALAMASQVFRDCAERGINLSMVNMGGGFPTKYLKDVPPVVTYGRSIFRALRKHFGNQIPETIIEPGRGMVGNAGIIESEVVLISKKSDEDEVRWVYLDIGKFGGLAETMDESIRYAIRTAHDGADMTPCVLAGPTCDSADVLYEKNPYPLPVTLEIGDKVLIEGTGAYTSTYSSVAFNGIPPLKTYHI

SEQ ID NO: 19817 - protein, 240 aa, Bradyrhizobium japonicum USDA 110
MHNVLVTGGSRGIGLAIGKRLAGAGYNVIAAARRESDELRAAIGESEGRLHFRACDLAVIDAIPAFAKLVRDEFGPIYGLVNNAGLGTEGLLATMHNSEIEALVQLNVLSPIILTKYVARQMMADGAGRIINISSIIATTGYNGLSVYGATKAAATGFTRSLAREVGKLGITVNAIAPGFIDTELTHNLSDEGRKRIAGRSALRRLPETEDVARMVEYLLGDGGRNVTGTVFTVDAGNTA

SEQ ID NO: 19818 - protein, 253 aa, Bradyrhizobium japonicum USDA 110
MSGLFDVSKETILVTGASQGLGRQFARLLAAHGAAVALAARQTDKLKNLEQEIRGNGGRAAAVALDVTDIASIAKAVDATEAALGPVTVLINNAGIAIEKLATEQTEADWDTVIGANLKGAYFLATEVARRMIARKQEGNIVNIASVLGTGVLKAVSPYAISKAGIIQATKAMALELAGQNIRINALAPGYIDTEMNHAFWSTPAGERLAKRIPQRRVGAESDLDGAILLLASKASRYMTGSVVTVDGGFLLN

SEQ ID NO: 19819 - protein, 362 aa, Bradyrhizobium japonicum USDA 110
MKAAVLYEVNKPLVIEDVSLPKPGPREVLIRTSVAGLCHSDLHFMEGLYPHPLPAVLGHESAGVVEQVGSDVTYVKPGDHVVTCLSVFCGTCDNCTTGRTVLCTDTTVKLLPGVSDRMQWSRSEKLHQFLNLSSFAEQMLVHENAIVKIRKEMPLDLAALIGCGVITGYGAVVNTAKVTAGETVAVIGCGGVGMAAINGAQIAGAGRIIAIDTNPAKLQLATKLGATDIINPADGDVVKQVRDLTNGGVHHSFEVLGRKETAEQAFAMLASGGTATIVGMIPFGQKIELHGFDFLRERKIQGSSMGSNHFRVDMPRLVDFYLRGRLHLEDWISAKLKLSEINEGFANMKAGKTLRSVIVFDS

SEQ ID NO: 19820 - protein, 466 aa, Bradyrhizobium japonicum USDA 110
MTMRPDPTFHASPKLAMEAPAENFAYTLLLSPDFSKPDALAVIDVKPGSPTYGQIVHTVTMPNKGDEFHHFGWNACSSALSPLAGHAFIERRYLIIPGLRSSRIYIIDTKPDPTKAKIHKIIEPEEVFKKTGYSRPHTIHCGPDGIYVSTLGGGGKDGTNGPPGVFIMDCETFEVLGRWEIDRGPQTLHYDFWWNLPRDYMVTSEWALPPQFENGIVPEDLLSNKYGHRLHFWDLRARRNVQTIDLGANHQMALEVRPAHDPVREYGFVGVVVDTTNLEASIWTWWREGGKFHAEKTATIPPEPAPKEKLPPLLQGFGAVPPLVTDIDLSMDDRFLYVSCWGTGEMRQYDVSDPRKPKLAGSVHIGGIARRTPHPNGKAFAAGPQMVEISRDGRRVYWTNSLYSTWDDQFYPDGVPGVEVMANVGGNGGLELDKDYFVSFPDGYRAHQIRLEGGDCSTDSFCYPSV

SEQ ID NO: 19821 - protein, 347 aa, Bradyrhizobium japonicum USDA 110
MDIKTAKAAILVESGKPLIVDEFTLPDTLEHGQVLAHVHTSSICGAQINEIDAVKGADKFLPHLLGHEALATIVETGPGVVSCKQGDTVVMHWRPGKGIQSNTPVYSWHGKRLNAGWVTTFNEYAVVSENRVTPVPPSIDRSSAPLLGCAVTTALGVVNNDAQVAIGEAVLVFGVGGVGLNIVQFAAMVGAHPVVAIDRLDNKLEMARQFGATHTINSDAVKDLAAEVRSITGPDGPDKVVETTGVSRLIELAYEVTAKKGRCILVGVPRDKVEIYTLPLHFEKVLKGSEGGQCQPARDIPRLVRLDEAGKVSYRGIVTHEFALDDINDALDLMRSGTSGRILLNIS

SEQ ID NO: 19822 - protein, 316 aa, Bradyrhizobium japonicum USDA 110
MMAGIAPRILCIGIPVRDLTFRVEAVPARGSKANATHLAEICGGNALNAAIAMARLGGRVSFAGPMGDARETSSGFILERMAQEGIDTGHIVRMPDVTTPVSAIMIEPSGERTLTIYRDPGLWSVKLPDADVLLADCRAVLVESRCAGFATSLCAEARRRGIPVIVGVDRAMSLQDGLLTAASHLLFASEQVQETAGIAADGEALRHLAKLTPAFLAATRGPLGTIWLNDAGELEETPAFPVHAVDTLGAGDVFHGAFTLRLAEGAVVREALRFAAAAAALKCTRHGGGLAAPQRVEVERLLDGPPARAPGGSPRL

SEQ ID NO: 19823 - protein, 404 aa, Thermotoga maritima
MNTGEMKINWVSRYMPLLNKIAEEYSREKPLSGFTVGMSIHLERKTAYLAVTLSKLGAKVVITGSNPLSTQDDVAEALRSKGITVYARRTHDESIYRENLMKVLDERPDFIIDDGGDLTVISHTEREEVLENLKGVSEETTTGVRRLKALEETGKLRVPVIAVNDSKMKYLFDNRYGTGQSTWDAIMRNTNLLVAGKNVVVAGYGWCGRGIALRAAGLGARVIVTEVDPVKAVEAIMDGFTVMPMKEAVKIADFVITASGNTDVLSKEDILSLKDGAVLANAGHFNVEIPVRVLEEIAVEKFEARPNVTGYTLENGKTVFLLAEGRLVNLAAGDGHPVEIMDLSFALQIFAVLYLLENHRKMSPKVYMLPDEIDERVARMKLDSLGVKIDELTEKQRRYLRSWQ

SEQ ID NO: 19824 - protein, 396 aa, Salmonella typhimurium
MLDAQTIATVKATIPLLVETGPKLTAHFYDRMFTHNPELKEIFNMSNQRNGDQREALFNAIAAYASNIENLPALLPAVEKIAQKHTSFQIKPEQYNIVGTHLLATLDEMFNPGQEVLDAWGKAYGVLANVFIHREAEIYHENASKDGGWEGTRPFRIVAKTPRSALITSFEFEPVDGGTVAEYRPGQYLGVWLKPEGFAHQVFRQYSLTRKPDGKGYRIAVKREDGGQVSNWLHHHASVGDVVHLAAPAGDFFMNVAADTPVSLISAGVGQTPMLAMLDTLAKEQHTAQVNWFHAAENGDVHAFADEVSELGRTLPRFTAHTWYREPTEADRAQRLFDSEGLMDLSKLEAAISDPAMQFYLCGPVGFMQFAAKQLVSLGVNNENIHYECFGPHKVL

SEQ ID NO: 19825 - protein, 761 aa, Streptomyces granaticolor
MERLRADDPREAGPYALVARLGAGGMGAVYLGRSSGGRTVAVKMVGPDLAVDGAFRDRSRHEVAAARRVSGAFTAPVVDADPDARTPWMATAFVVGVSLHRAVGTHGPLPEDALRMLTAGLAEALVGIHSAQVIHRDLKPANVLLALDGPHVIDFGIARATDGTALTSTGSVIGSAPYMSPEQALGQHLTPASDVFSLGTTIAFAACGESPFGDGASAAVLFRVVHTEPDLSAVPASVRPLIERCLDKDPARRPSPREVIAYVEGLGRRPDPRLGYGQGPRRDRPAEAAGWLPDRVAAEVLALRAALAAPPEPEPTVPFTGPLEDLVPPPGGPRPAPGRRTLLFGLAGGALAVAGAGTVWALNRKGSGTEGGASAGAAGGTPGPSRSSRPSPESVPDAKLTWQTKLPAAAVQVLPGDGVVACVTLEQIVGLDRRGRTAWTVKSADHDMYFSVMGTAALTVAATDGKRLYVSGAGLKPQAGGSGLNSRVLSVRMADGKDPWTAALTEHRSGGGIGFPGVRGGRAYLLPLLTDESSTNGLGVWAVDLATHRTAWLHTARAMPVFWSLPRSGGGLLYADTERIVAVDAKGKAAWSKEFKAGLVGAAGTYYLLVDYQGTLTAMDVTTGKRAWTVPDVIGASRLGDGVATDERGTVAFVLVRDADGFTLTALDAATGKARWRSPVPSEPAGSSPGTRLLYADGNVYRIGADGMVWAFDAANGAPRWKYGGFKGISPANLAWAAGDRRLCIADTGATTVAALDANGA

SEQ ID NO: 19826 - protein, 264 aa, Lycopersicon esculentum
MNSQIFSTGFSGYGMEQQGSIGLNQLTPIQIQQIQAQINFQNQQQQQQQQMMLQTAHHASTMNFLAPKPVPMKQSGSPPKPTKLYRGVRQRHWGKWVAEIRLPKNRTRLWLGTFDTAEEAALAYDKAAYMLRGDFARLNFPQLRHNGNLIGGDFGEYNPLHSSVDAKLKDICQSLAQGKSIDSKKKKTKGLSAEKAAVVKMEEEESKTAEVGSESDGSHSGSGGSSPVTELIFPEFTEEEPTWDMSENFLLQKYPSHEIDWASL

SEQ ID NO: 19827 - protein, 316 aa, Homo sapiens [sequence omitted]

SEQ ID NO: 19828 - protein, 404 aa, Emericella nidulans
MHHHHQQPSYGSGYPGQAYRQQQNPYPQYGHPSPQPYPPQNGYSHPSSGYPPSPAPPNGGQMYHGRQPSYPPNQYPPAHGGPTAPPTNPQAFGHGAPQGYNFQYSRCTGKRKALLIGINYFGQKGQLRGCINDVKNMSTYLNQNFGYAREDMVILTDDQQNPMSQPTKANILRAMHWLVKDAQPNDSLFFHYSGHGGQTPDLDGDEDDGYDEVIYPVDFRVAGHIVDDEMHRIMVKPLQPGVRLTAIFDSCHSGSALDLPYIYSTQGILKEPNLAKEAGQGLLGVISSYARGDMGGMMSTAVGFLKKAAKGDEAYQRTKQTKTSPADVIMWSGSKDDQTSQDAQIAGQATGAMSWAFITAMRKNPQQSYVQLLNSIRDELSTRYTQKPQLSSSHPLDVNLLYVM

SEQ ID NO: 19829 - protein, 131 aa, Brassica oleracea
ILDRYGKKHADDLNALDLLSKSLNYSSHHEPLELVESKLVESIVDVSVDSLVELEDHLETALSVTRARKAELMLKLVESLKEKVSLLKEENQVLASQIEKKKLGGGEADNIEMSSGQISNIKLPVTLPLLN

SEQ ID NO: 19830 - protein, 132 aa, Brassica oleracea
ILDRYGKQHADDLKALDLQSKALSYGSHNELLELVDSKLVESNVGGVSVDTLVQLEGVLENALSLTRARKTELMLKLVDSLKEKEKLLKEENQALASQKEKKNLAGAEADNMEMSPGQISDINLPVTLPLLN

SEQ ID NO: 19831 - protein, 132 aa, Brassica oleracea
ILDRYGKQHGDDLKALDRQSKALDCGSHHELLELVESKLEESNVDNVSVGSLVQLEEHLENALSVTRARKTELMLKLVENLKEKEKLLEEENHVLASQMEKSNLVRAEADYMEVSPGQISDINLPVTLPLLN

SEQ ID NO: 19832 - protein, 2068 aa, Cryptosporidium parvum
MSDREELELDKNVNRMRLELEEALDILTCHENEEISSNREGECCILDSYPLSMTLIRCENDKEKLGLIFQLNEFSRMVKGSYWMVLEDNKDPRNLCMLEFFNYSDGVFRNKMFEVIVDKNEREILQNYFSHSNSILNMNGGNKSEISNEKWMMTTLKRRRDIRIRNNLGLAFCNTFLKESNEKIRSFDLSSLAFMVKFSEVSNISELINNVETLYEDFRLNKMEESFLTVFSFSIENRLDGQARFEDELKKLSLSNSKKDAYMIHIFTNPTDYAMVTSTYNWSSYISTLKDLALGEARTEFMTQKLIYNSLENFEDLNIFRTEDSERDLEIKENMMGGENLDGKSTIATTLNYYSTDSCKLVDSANGFSSTDLDSVTTSINSSTENLTLSKKGSTLEGLDENKELEVIDDIEIFEDEEVIGFEEDPLLVSEWSNLRFWESAVVGASDSVAISNIRKKNLLYSNSTINSNNNQNEKLTDNQEIPVIQESVKEEEFYECREMMFDTHTLKAKLAKSVWGGATCSDRNCMQCFALLHAHAQTNTDKDEKTMENERIWCREGFTKFCEVYKSMGVVELKRKSELGNGNRAWLIREFIGDELTDQVFCYGLNRRRRSIKGGLRTMNIYLVGDFNDWNKTSHPMQLETENICSMNQEIYENYPSIPHFMKSRVYSIILDENKLESFLSCSPKANSISFKIRIVTSKADGFTEGHMAEVNNSMGAVSSQELETYRLLSYSRSLTTSGIKDSTENALMNCNFYLESQKEHDGLRNRDLKYPLPRCVLKPRLGGNLKQNKDNIFDSNGKEYQIPVTSIVKGLVTNFRQSPLYIYEANIAFSSKGEFGTFASFKEKVLPRISRGGYNCLLLTGLLEHYQSFSNSQYPFNYFTPYSKYGTLEEFKDLMDDCHSRGIAVIVDFNLTFADITNSNSMLQPCDREVNNNLSNLQDIIDIDEINMCSGSEASNGNMSREGSFIFGNGNSGTNIVRIDELFLDDSVVDLYESFMLTNLNTFNPSFFKHTPDVISPLFAYNKSYSRLNLGYIPMLAQIFSSLHYLLTHLGIDGFRFTVPDLSEEQEKYSYISSVLALINDTIHTIKPFAITIANELLLRENKDKACSELAVPLEYGGMGFDYIWNTSICSSLQDIILKSPSSLNIKKDIIDELLPHEDKMRNSNKKIRILYKNREKQNISSRGDNDNGNNNSYSDMGESDLHTVEFVSRNLYGIESLEMKTVTQNPLRIAMFSWESLYTHSVGGVSPHVSQLSASLVRLGHEVHLFTRATTSAYIIKVHDGVLYHECPFQLNSDFVTEIINMCNSFVYYMQRWEDGLTKVPDHPMLNNVKNGYRFNICHCHDWLAAPVLTSLRRIGNNNRTTILTLHSTEYGRCGNQSYGGQSGRISDIEREGSHTADRLICVSGVFAEEVCRLFGINRNKIKVIFNGINCKTFDSVAMDDVGEVKRQYGIGPLEPTFLCVARMALQKGVDLLIEAVLGILKYRNDTKFIIVGDGHQKDEIVRRSHQLGIYNSIRFVGKKSGDDVIRLYKACDAVVVPSRNEPFGIVVLEGWTAGKPVVATTSGGPRDFLTPNVDGYLVEPCKDSIAWGCCEILKNFDHSRWMGSRGRVKAAYSFSWDSIARATSFLYFEQCNVLDVTPSLILKPNSPIILQAFGENALHHHMMVFDGFDKSVFALKQLKLLILTTMAFAKNGVFQSMGSEFGNPDSFDLPRPNNNMDNSKMCCKWDLADNKNLKFKHLEFFNTLLIRLEKFLSWIAKNNIQDYGVNYNYLSPLTCGSEGELGKNGLTSACYSKSISPLTKGTSTSLIPSEISPASTFSKRVLAKKEAIIKKLEESSGDNTSPVDNESVIYLDSTPQSNGKEGSKSIQNIYSRAKSLGKHSKDSLKILTTDSFYNSSSNINVVLCHELDKVMVIERNNCVFVFNFSEKYYNDYGFGISSELPQSLIIDTQDERFGGDKKYHITGSFCSTSIKSEQGFKIFSPNSEPSNINSIVNNKFPNNFQHESPYRFVNTKSLKQTVFLNMSPFSAYILAPSNLVQDFPCETVGDKLFSQNIDSFVDSIGLFC

SEQ ID NO: 19833 - protein, 720 aa, Mus musculus
MAEKFESLMNIHGFDLGSTYMDLKPLGCGGNGLVFSAVDKYCDKRVAIKKIVLTDPQSVKHALREIKIIRRLDHDNIVKVFEILGPSGSQLTDDVGSLTELNSVYIVQEYMETDLANVLEQGPLLEEHARLFMYQLLRGLKYIHSANVLHRDLKPANLFINTEDLVLKIGDFGLARIMDPHYSHKGHLSEGLVTKWYRSPRLLLSPNNYTKAIDMWAAGCIFAEMLTGKTLFAGAHELEQMQLILDSIPVVHEEDRQELLSVIPVYIRNDMTEPHRPLTQLLPGISREALDFLEQILTFSPMDRLTAEEALSHPYMSIYSFPTDEPISSHPFHIEDEVDDILLMDETHSHIYNWERYHDCQFSEHDWPIHNNFDIDEVQLDPRALSDVTDEEEVQVDPRKYLDGDREKYLEDPAFDTSYSAEPCWQYPDHHENKYCDLECSHTCNYKTRSSPYLDNLVWRESEVNHYYEPKLIIDLSNWKEQSKEKSDKRGKSKCERNGLVKAQIALEEASQQLAERERGQGFDFDSFIAGTIQLSAQHQSADVVDKLNDLNSSVSQLELKSLISKSVSREKQKKGRANLAQLGALYQSSWDSQFVSGGEECFLISQFCCEVRKDEHAEKENTYTSYLDKFFSRKEDSEMLETEPVEEGKRGERGREAGLLSGGGEFLLSKQLESIGTPQFHSPVGSPLKSIQATLTPSAMKSSPQIPHKTYSSILKHLN

SEQ ID NO: 19834 - protein, 228 aa, Emericella nidulans
MLAQNNIQNQQQQQMMQQQQQQQQQQQQQQNHQNQQQKFANPQAYQAQMMRAQLMQMQLAQQQQQQRQQQSQQQQQAQPQGQQQPQHQQGQMLQNSPQLNAQQQQMLMAAAQANGGQLPQNMQGMGMQPRMSTPARYNQLYQQRLLRLRQDMATRLMPQYGPPTQYPPQVAQEYSVGLENAAKGFVQDLIRRERVEFAAAQQRQAQAAAHAQAVQQQQHNMMQNGMGK

SEQ ID NO: 19835 - protein, 385 aa, Pyrocystis lunula
MSKPDHVLAEVRPFDGGKGSNHGASGEASNKKTSFTYNAERVLGSGSFGIVYQAQVVETGESVAIKKVFQDKRYKNRELQIMRELKHPNVVELKHAFYTSGDKPGESYLNVVMEYCSDTVYKMMKHYIKMKTPVPHIFVQLYSYQMNRACAYIHSVGICHRDIKPQNLLVDGTTHALKLCDFGSAKRLVKGEPNVAYICSRYYRAPELIFGATDYSTIIDIWSTACVTAELILAQPIFPGESGVDQLVEIIKVLGTPTREELMAMNPNYTEFKFPQIKPHPWHKVFLLQDHAGGRRLHLEAPRVRPEGAALGARVLCTPAVCDLRDRNTLISNAKGQALPSSIFAFSQEERALMDSDLRRKLIPDWVATRDKEQGPGAHDVGGSL

SEQ ID NO: 19836 - protein, 650 aa, Oryza sativa (japonica cultivar-group)
MAPVSLPPGFRFHPTDEELIIYYLKRKINGRQIELEIIPEVDLYKCEPWDLPEKSFLPSKDLEWYFFSPRDRKYPNGSRTNRATKAGYWKATGKDRKVNSQRRAVGMKKTLVYYRGRAPHGSRTDWVMHEYRLDERECETDTGLQDAYALCRVFKKTAPGPKIIEHYGVVHHHVEQPQWMTSSIDRSPTLDVSCDGRGDDFESSSFSFPTETPMDSMHGGFGMQMSAPHEDGKWMQFLSEDAFNATNPFLTNPVSANFSCLPSKVDVALECARLQHRLTLPPLEVEDFPQDVSLDTKIGILRSNPNEVDILQEFLSVATASQELINGSTSSYPEMWLGASTSSASYVNELSSLVEMGGVGTSNHHESARLQVEIADMEVFKDEKKRVENLRGVKLVNNDLGEIVVEGDESNPTEDIIAQYPIKVTADNSGEAGHRMTDPTDVGGIDTAPIFSQSQPDDFAAGFDDVNPNASFDLYEKVDVNHRLFVSRVAAAKTFFHRIEPSKKVSFHSNPAATAVSKATEKFHFPVTTKVSGRVSIFSKFKALIRDKFLMMRPSHSYQRLGSKETTVNELLQIVSLLLAPKQINGCPTEQELVKKKAKEVMKPGWGREGSNKLWLPLSKGKGISSMFLSGKWTFLTSALAISTPAECDH

SEQ ID NO: 19837 - protein, 426 aa, Oryza sativa (japonica cultivar-group)
MLLGLEKNQHNGEDTSPEANDSGELDDQSKSTTPEMVLHSSIILIYGFTKSLIASTGSMECSTSTEMSSNSGHRSRNRAQDDDSFDSESSSSGPPTVKRPAAVTALLPPFSRPTPSKWDDAEKWISSPTANRGGRVGSAAGAAPKKSALAFPEHVSRPPAVAKVVAEVPINTGTLVKNSVALAQPISFNPAQSASIVDEPAPAVRSVSMRDMGTEMTPIASQEPSRTGTPIIASSPTSSRTPTPQRNAEISIGEFGPNKMEMSEEELQMNTRKEIMDLGQRLGKTTIAAWASKEEKSTTSFANVITDKAVEIDREARAADWEEAEKAKYLARFQREEVKIQAWENHQKAKIEAEMKRMEAKIEIKRAREQDRLSSKLAAARHKAEARREAAESRKNQEAARTEEQAAQIRKTGHIPSSISCWCWCL

SEQ ID NO: 19838 - protein, 635 aa, Pisum sativum
MMESCECIDTPYPPDELLVKYQYISDVLIALAYFSIPVELIYFVQKSAFFPYRWVLMQFGAFIVLCGATHFINLWTFSAHSKAVAVVMTIAKVSCAIVSCATALMLVHIIPDLLSVKTRELFLKNKAEELDREMGLILTQEETGRHVRMLTHEIRSTLDRHTILKTTLVELGRTLGLEECALWMPSRSGLNLQLSHTLTYHVQVGSTVPTNLPIVNEVFNSPRATRIPHTCPLARIRPLVGRYVPPEVVAVRVPLLHLSNFQINDWPDLSAKSFAIMVLILPTDSARKWRDHELELVDVVADQVAVALSHAAILEESMRARDQLMEQNVALDLARREAEMAIHARNDFLAVMNHEMRTPMHAIIALSSLLLETELTPEQRVMIETVLKSSNVLAALINDVLDLSRLEDGSLELEMGKINFHGVLEEVIELIKPIASVKKLPITLILAPDLPDNAIGDEKRLMQTLLNVVGNAVKYTKEGYVSIRASVAKPESLQDWRPPEFYPASSDGHFYIRVQVKDSGCGILPQDIPHLFTKFTQSQSGAGRSSSGSGLGLAICKRFVNLMGGHIWMESEGPDKGSTATFVVKLGICGNPDSSDHQATTRGQAYSGSGGLARFKHLVNDGDIGFSNRRNQRSF

SEQ ID NO: 19839 - protein, 125 aa, Methanosarcina mazei
MKEITAIIRMNRVQKTKDVLLECGFPSFTVRRVMGRGKQKGLCFEFNPPLPEPEKEAETCIHFIPKRMFTIVVDDENVNEVVRKIIEVNQTGHPGDGKIFVSSISEAYRIRTGESGEATVNKEMV

SEQ ID NO: 19840 - protein, 530 aa, Aspergillus niger
MAEGFVDASRVEAPVTLKTYLMCAFAAFGGIFFGYDSGYISGVMGMRYFIEEFEGLDYNTTPTDSFVLPSWKKSLITSILSAGTFFGALIAGDLADWFGRRTTIVSGCVVFIVGVILQTASTSLGLLVAGRLVAGFGVGFVSAIIILYMSEIAPRKVRGAIVSGYQFCITIGLMLASCVDYGTENRLDSGSYRIPIGLQLAWALILGGGLLCLPESPRYFVKKGDLAKAAEVLARVRGQPQDSDYIKDELAEIVANHEYEMQVIPEGGYFVSWMNCFRGSIFSPNSNLRRTVLGTSLQMMQQWTGVNFVFYFGTTFFQSLGTIDDPFLISMITTIVNVCSTPVSFYTIEKFGRRSLLLWGALGMVICQFIVAIVGTVDGSNKHAVSAEISFICIYIFFFASTWGPGAWVVIGEIFPLPIRSRGVALSTASNWLWNCIIAVITPYMVDKDKGDLKAKVFFIWGSLCACAFVYTYFLIPETKGLTLEQVDKMMEETTPRTSAKWTPHGTFTAEMGLTANAVAEKATAVHQEV

SEQ ID NO: 19841 - protein, 524 aa, Aspergillus niger
MAPPKYAGMSGRPLSLFLSGIATMGFLLFGYDQGVMSGIISDAAFNNVFTATRNDNVMQATVTAVYEGCLVGAIFALIFGETLGRRLMVISGAWVMIIGVIIQVTAMPGHIPLLQFIFGRVITGIGNGMNTSTIPTYQAECSKSTNRGLLICIEGGIIAIGTAIAYWIDFGAHYGPPDLVWRFPIAFQIFFGILIIVGMMYLPDSPRYLIAHGKVEEGTRVLAALAGSEIDDPHVQLEKQLTLDSIRAFRDLLTGGPSQHFRRMIVGSSSQFFQQISGCNAVIYYLPVLLEQSIGQSHDFALLIGGVNMICYAIFATFSWFFIEKIGRRKLFLGGSYGQCAAMIIVFGCLIPGDSESAKGAVFGFFLYMCVFGATWLPLPWLYPAEISPLKTRSKANAVSTCSNWLFNFTVVMITPVMVQHIGWGTYLFFAAWNGLFIPVIWFFYPETAGRSLEEIDLIFAKGYVENMSYVRASKELPKLTDEEIEAKAAEYGILGDEEKAEERIAEKDPPASAEFSQFQPTQL

SEQ ID NO: 19842 - protein, 583 aa, Aspergillus niger
MGVSNMMSRFKPQADHSESSTEAPTPARSNSAVEKDNVLLDDSPVKYLTWRSFILGIVVSMGGFIFGYSTGQISGFETMDDFLQRFGQEQADGSYAFSNVRSGLIVGLLCIGTMIGALVAAPIADRMGRKLSICLWSVIHIVGIIIQIATDSNWVQVAMGRWVAGLGVGALSSIVPMYQSESAPRQVRGAMVSAFQLFVAFGIFISYIINFGTERIQSTASWRITMGIGFAWPLILAVGSLFLPESPRFAYRQGRIDEAREVMCKLYGVSPNHRVIAQEMKDMKDKLDEEKAAGQAAWHELFTGPRMLYRTLLGIALQSLQQLTGANFIFYYGNSIFTSTGLSNSYVTQIILGAVNFGMTLPGLYVVEHFGRRNSLMVGAAWMFICFMIWASVGHFALDLADPQATPAAGKAMIIFTCFFIVGFATTWGPIVWAICGEMYPARYRALCIGIATAANWTWNFLISFFTPFISSSIDFAYGYVFAGCCFAAIFVVFFFVNETQGRTLEEVDTMYVLHVKPWQSASWVPPEGIVQDMPAPLPLPSRRVRLRWLSTPSPLSSASKPLALARTHFASCSCTLNLHLKL

SEQ ID NO: 19843 - protein, 514 aa, Aspergillus niger
MRLPKIKMPRKRPQDELNGDVLQQEAQATGPNGQKSEEGIVDTPIPLLTWRSFLMGIFVSMGGFLFGYDTGQISGFLEMPNFLQRYGQQQADGTYYFSNARSGLIVALLSIGTLIGALIAAPIADRVGRKWSISGWSAMVCVGITIQISSPFGKWYQVAMGRWVAGLGVGALSLLVPMYQAETGPRHIRGSLVSTYQLFITLGIFVANCINFGTEARNDTGSWRIPMGITYIWAMILGFGIALFPESARYDYRHGREAKAARTLSRISSWKEQERGEITWSHLFHAPRMKYRVAVGVALQALQQLTGANYFFYYGTTIFRGAGISNSYVTQMILGGVNFGTTFLGLYLIENYGRRRSLITGALWMFVCFMVFASVGHFSLDHENPERTHTAGVVMVVFACLFILGFASTWGPMVWTIIAELYPSEFRARAMSLATASNWLWNFLLAFFTPFITSAIDFRLGYVFAGCLFLAAGLVYVAVIEGRGRTLEEIDTMYVMKVPPWKELQVCISGHRSI

SEQ ID NO: 19844 - protein, 103 aa, Eremothecium gossypii
MSGKGGKAGSAAKASQSRSAKAGLTFPVGRVHRLLRKGNYAQRIGSGAPVYLTAVLEYLAAEILELAGNAARDNKKTRIIPRHLQLAIRNDDELNKLLGNVTI

SEQ ID NO: 19845 - protein, 347 aa, Musa acuminata
HVHELEPVEVVADQVAVALSHAAILEESMRARDLLMEQNVALDYARQEAELAIRARNDFLAVMNHEMRTPLHAIITLSSLLLETELNPEQRSMVETVLKSSSLLATLINDILDLSKLEDGSLELEIGIFNLHSVFREVVNFIKPIAAVKKLSVSLTLSPDLPLCAIGDEKRLMQILLNIVGNAVKFTKEGHISLTASVARADYLRDFRASEFYPVSSDGHFYLRVQVKDTGCGISSQDLPHLFTKFAHGRNVASRGFSGSGLGLAICKRYVSLVQGHIWLESEGIGKGCMATFVVKLGICENPDGSQQKIVLLPWTKHGQEDTSSSRGMPKDPKAFIPLKPRYQRSV

SEQ ID NO: 19846 - protein, 480 aa, Musa acuminata
RSTLDRHTILKTTLVELGRTLDLAECALWMPSRSGLNLQLSHTLHHQMPLGSVVSINLPVVNQVFSSNRAVRIPHTCPLARIRPQTGRYVPPEVVAVRVPLLHLSNFQINDWPELSAKSYAIMVLMLPSDSARKWHIHELELVEVVADQVAVALSHAAILEESMRARDLLMEQNVALDSARREAEMAIRARNDFLAVMNHEMRTPMHAVIALSSLLLETELTPEKRLMIETVLKSSNLLAALINDVLDLSKLEDGSFELEIANFNLHAVFREVINLIKPIAAIKKLSVSVTLAPDLPLCAIGDEKRLMQTILNVAGNAVKFTKEGHISITASVARSDSSRDPRAPEFSPVTSDRHFDLRVQIKDTGCGISPQDLPHIFTKFAHSRNSANKASNGSGLGLAICRRFVSLMEGQIWLESEGIGKGCTATFIVKLGICDPSGNLQQILQTTPSHGDANLPGPRAKFDDENGKFTPMMRYQRSV

SEQ ID NO: 19847 - protein, 166 aa, Leavenworthia crassa
NTDRVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFEC

SEQ ID NO: 19848 - protein, 169 aa, Leavenworthia crassa
NTDRVRMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHD

SEQ ID NO: 19849 - protein, 169 aa, Leavenworthia crassa
NTDRVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHD

SEQ ID NO: 19850 - protein, 169 aa, Leavenworthia stylosa
NTERVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHD

SEQ ID NO: 19851 - protein, 169 aa, Leavenworthia stylosa
NTERVGMIHDGESRFSIKGKPIHHFLGTSTFSEYTVVHSGQVAKINREAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHD

SEQ ID NO: 19852 - protein, 169 aa, Leavenworthia stylosa
NTEIVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVSEFVNPKEHDKPVQQVIAEMTNGGVDRSVECTGSVQAMIQAFECVHD

SEQ ID NO: 19853 - protein, 169 aa, Leavenworthia uniflora
NTERVGMIHDGESRFSINGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHD

SEQ ID NO: 19854 - protein, 169 aa, Leavenworthia stylosa
NTDRVGMIHDGESRFSIKGKPINHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIADMTNGGVDRSVECTGSVQAMIQAFECVHD

SEQ ID NO: 19855 - protein, 169 aa, Leavenworthia stylosa
NTERVGMIHDGESRFSIKGKPINHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHD

SEQ ID NO: 19856 - protein, 169 aa, Leavenworthia stylosa
NTERVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPLQQVIAEMTNGGVDRSVKCTGSVQAMIQAFECVHD

SEQ ID NO: 19857 - protein, 169 aa, Leavenworthia stylosa
NTEIVGMIHDGESRFSINGKPINHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIDEMTNGGVDRSVECTGSVQAMIQAFECVHD

SEQ ID NO: 19858 - protein, 117 aa, Leavenworthia crassa
GMIHDGESRFSINGKPIHHFLGTSTFSEYTVVHSGQVAKINPKAPLDKVCIVSCGLSTGLGATLNVAKPKKGQSVAVFGLGAVGLAAAEGARIAGASRIIGVDLNSKRFEEAKKFGV

SEQ ID NO: 19859 - protein, 117 aa, Leavenworthia crassa
GMIHDGESRFSINGKPIHHFLGTSTFSEYTVVHSGQVAKINPEAPLDKVCIVSCGLSTGLGATLNVAKPKKGQSVAVFGLGAVGLAAAEGARIAGASRIIGVDLNSKRFEEARKFGV

SEQ ID NO: 19860 - protein, 117 aa, Leavenworthia crassa
GMIHDGESRFSINGKPIHHFLGTSTFSEYTVVHSGQVAKINPKAPLDKVCIVSCGLSTGLGATLNVAKPKKGQSVAVFGLGAVGLAAAEGARIAGASRIIGVDLNSKRFEEARKFGV

SEQ ID NO: 19861 - protein, 117 aa, Leavenworthia crassa
GMIHDGESRFSINGKPIHHFLGTSTFSEYTVVHSGQVAKINPEAPLDKVCIVSCGLSTGLGATLNVAKPKKGQSVAVFGLGAVGLAAAEGARIAGASRIIGVDLNSNRFEEAKKFGV

SEQ ID NO: 19862 - protein, 117 aa, Leavenworthia uniflora
GMIHDGESRFSINGKPIHHFLGTSTFSEYTVVHSGQVAKINPKAPLDKVCIVSCGLSTGLGATLNVAKPKKGQSVAVFGLGAVGLAAAEGARISGASRVIGVDLNSKRFEEAKKFGV

SEQ ID NO: 19863 - protein, 117 aa, Leavenworthia stylosa
GMIHDGESRFSINGKPIHHFLGTSTFSEYTVVHSGQVAKINPEAPLDKVCIVSCGLSTGLGATLNVAKPKKGQSVAVFGLGAVGLAAAEGARIAGASRIIGVDLNSKRFEEAKKFGV

SEQ ID NO: 19864 - protein, 199 aa, Leavenworthia crassa
SVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLSSKGFEEAKKFGVTEFVNPKEHNKPVQQVIAEMTNGGVDRSVECTGSV

SEQ ID NO: 19865 - protein, 199 aa, Leavenworthia crassa
SVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSNRFEEAKKFGVTEFVNPKEHNKPVQQVIAEMTNGGVDRSVECTGSV

SEQ ID NO: 19866 - protein, 199 aa, Leavenworthia crassa
SVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSNRFEEAKKFGVTEFVNPKEHNKPVQKVIAEMTNGGVDRSVECTGSV

SEQ ID NO: 19867 - protein, 199 aa, Leavenworthia crassa
SVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGTAEGARIAGASRIIGVDLNSNRFEEAKKFGVTEFVNPKEHNKPVQQVIAEMTNGGVDRSVECTGSV

SEQ ID NO: 19868 - protein, 199 aa, Leavenworthia crassa
SVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 19869 - protein, 199 aa, Leavenworthia crassa
SVGEGVTDLQPGDHVLPIFTGECGECPHCHSEESNMCELLRINTERGGMILDGESRFSINGKPIHHFLGTSTFSEYTVVHSGQVAKINPKAPLDKVCIVSCGLTTGLGATLNVAKPKKGQSVAVFGLGAVGLGAAEGARIAGASRIIGVDLNSNRFEEAKKFGVTEFVNPKEHNKPVQQVIAEMTNGGVDRSVECTGSV

SEQ ID NO: 19870 - protein, 199 aa, Leavenworthia crassa
SVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSNRFEEAKKFGVTEFVNPKEHNKPVQRVIAEMTNGGVDRSVECTGSV

SEQ ID NO: 19871 - protein, 199 aa, Leavenworthia crassa
SVGEGVTDLQPGGHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSNRFEEAKKFGVTEFVNPKEHNKPVQQVIAEMTNGGVDRSVECTGSV

SEQ ID NO: 19872 - protein, 199 aa, Leavenworthia crassa
SVGEGVTDLQPGDHVLPIFTGECGECLHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSNRFEEAKKFGVTEFVNPKEHNKPVQQVIAEMTNGGVDRSVECTGSV

SEQ ID NO: 19873 - protein, 199 aa, Leavenworthia stylosa
SVGEGVTDLQPGDHVLPIFTGECGHCPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 19874 - protein, 199 aa, Leavenworthia stylosa
SVGEGVTDLQPGDHVLPIFTGECGHCPHCHSEESNMCELLRINTERGGMILDGESRFSINGKLIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 19875 - protein, 199 aa, Leavenworthia stylosa
SVGEGVTDLQPGDHVLPIFTGECGHCPHCHSEESNMCEFLRINTERGGMILDGESRFSINGKPIHHFLGTSTFSEYTVVHSGQVVKINHKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 19876 - protein, 199 aa, Leavenworthia stylosa
SVGEGVTDLQPGDHVLPIFTGECGHCPHCHSEESNMCELLRINTERGGMILDGESRFSINGKPIHHFLGTSTFSEYTVVHSGQVVKINPKAPLGKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 19877 - protein, 199 aa, Leavenworthia stylosa
SVGEGVTDLEPGDHVLPIFTGECGHCPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 19878 - protein, 199 aa, Leavenworthia stylosa
SVGEGVTDLEPGDHVLPIFTGECGHCPHCHSEESNMCELLRINTERGGMILDGESRFSISGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 19879 - protein, 199 aa, Leavenworthia stylosa
SVGEEVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSV

SEQ ID NO: 19880 - protein, 338 aa, Leavenworthia uniflora
  unsure (1)..(338): unsure at all Xaa locations
TGQIIRSKAAVAWEAGKPLVMEEVEVAPPQKHEVRIKILFTSLSHTDVYFWEAKGQTPLFPRIFGHEAGGIVESVGEEVTDLQPGDHVLPIFTGECGDCPHCHSEESNMCDLLRINTERVGMIHDGESRFSINGKPIHHFLGTSTFSEYTVVHSGQVAKINPEAPLDKVXIVSCGLSTGLGATLNVAKPKKGQSVAVFGLGPVGLGAAEGARIAGASRIIGVDLNSNRFEQAKKFGVTEFVNPKEHDKPVQQVIAEMTNGGVDRSVECTGSVQAMIQAFECVHDGWGVAVLVGVPSKDDAFKTHPMNFLNERTLKGTFFGNYKPKTDIPGVVEKYMNK

SEQ ID NO: 19881 - protein, 379 aa, Leavenworthia stylosa
  unsure (1)..(379): unsure at all Xaa locations
MTTTGRIIRSXAGVAWEAGKPLVIEEVEVAPPQKHEVRIKILFTSLWHTDVYFWEAKGQTPLFPRIFGHEAGGIVESVGEGVTDLKPGDHVLPIFTGECGDCPHCHSEESNMCDLLRINTERRGMIHDGESRFSINGKPIHHFLGTSTFSEYTVVHSGQVAKINPKAPLDKVWIVSWGLSTGLGAILNVAKPKKGQSVAVFGLGAVGLAAAEGARIAGASRIIGVDLNSKRFEEAKKFGVTEFVNPKDYDKPVQQVIAEMTNGGVDRSVECTGSVQAMIQAFECVHDGWGVAVLVGVPSKDDAFKTHPMNFLNEKTLKGTFFGNYKPKTDIPGVVEKYMNKELELEKFITHTVPFSEINKAFDYMLKGESIRCIITMGA

SEQ ID NO: 19882 - protein, 223 aa, Leavenworthia crassa
GQTPLFPRIFGHEAGGIVESVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSVQAMIQ

SEQ ID NO: 19883 - protein, 354 aa, Hypocrea virens
MCFGARNKNEDGEARSRELDKGIRQEEKRMAKEVKLLLLGAGESGKSTILKQMKLIYAQGFNKSERLDFKPVIFSNIVQSFKTISEAMAEMGFEYDSPDNEKYMAHILVDNEISPDSGMPEDYLEPIKALWQDSGVLAAVSKGNEYALHDNLTYFVTDIDRIWADGYVPNDQDLLRSRLRTTGITETVFDLGQLTYRMFDVGGQRSERKKWIHCFENVNCLLFLVAISGYDQCLVEDKDGNQMNEALMLWESIANSHWFTMTSLILFLNKIDLFKEKLPKSPISKYGFTDYHGPDDDYKAASKYFLDKFRALSRNPEKEIYGHFTNATDTNLLKITMGSVQDMIIQRNLKKLIL

SEQ ID NO: 19884 - protein, 380 aa, Leavenworthia stylosa
MTTTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGHCPHCHSEESNMCELLRINTERGGMILDGESRFSINGKPIHHFLGTSTFSEYTVVHSGQVVKINPKAPLDKICIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSVQAMIQAFECVHDGWGVAVLVGVPSKDDAFKTHPINFLNERTLKGTFFGNYKPKSDIPGVVEMYMNKELELEKFITHKVPFSEINKGFDYMLKGEGIRCIITMGA

SEQ ID NO: 19885 - protein, 281 aa, Leavenworthia uniflora
MTTTTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGECPHCHSEESNMCELLRINTERGGMILDGESRFSINGKPIHHFLGTSTFSEYTVVHSGQVVKINPKAPLDKVCIVSCGLTTGLGATLNVAKPKKGQSVAVFGLGAVGLGAAEGARIAGASRIIGVDLNSKRFEEAKKFGVTEFVNPKEHNKPVQQVIAEMTNGGVDRSVECTGSVQAMIQ

SEQ ID NO: 19886 - protein, 322 aa, Leavenworthia crassa
GQTPLFPRIFGHEAGGIVESVGEGVTDLQPGDHVLPIFTGECGDCPHCHSEESNMCDLLRINTDRVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLNGEGIRCIITMGA

SEQ ID NO: 19887 - protein, 322 aa, Leavenworthia stylosa
  unsure (1)..(322): unsure at all Xaa locations
GQTPLFPRIFGHEAGGIVESVGEEVTDLQAGDHVLPIFTGECGDCPHCHSEESNMCDLLRINTERVGMIHDGESRFSIKGKPINHFLGTSTFSEYTVVHSGQVAKINPEAPLDKVRIVSCGLSTGLGATLNVAKPKKGQSVAVFGLGAVGLGAAEGARIAGASRIIGVDLNSNRFEQAKKFGVTEFVNPKEHDKPVQQVIAEMTNGGIDRSVECTGSVQAMIQAFECVHDGWGVAVLVGVPSKDDASRTHPMXXLXERTLKGTFFGNYKPKPDIPGVVEKYMNKELELEKFITHTVPFSEINKAFDYMLNGEGIRCIITMGA

SEQ ID NO: 19888 - protein, 717 aa, Rattus norvegicus
MGPAMLRAFSSWKWLLLLMVLTCLEASSYVNESSSPTGQQTPDARFAASSSDPDERISVFELDYDYVQIPYEVTLWILLASLAKIGFHLYHRLPHLMPESCLLIIVGALVGSIIFGTHHKSPPVMDSSIYFLYLLPPIVLESGYFMPTRPFFENIGSILWWAGLGALINAFGIGLSLYFICQIKAFGLGDINLLQNLLFGSLISAVDPVAVLAVFEEARVNEQLYMMIFGEALLNDGISVVLYNILIAFTKMHKFEDIEAVDILAGCARFVIVGCGGVFFGIIFGFISAFITRFTQNISAIEPLIVFMFSYLSYLAAETLYLSGILAITACAVTMKKYVEENVSQTSYTTIKYFMKMLSSVSETLIFIFMGVSTVGKNHEWNWAFVCFTLAFCQIWRAISVFTLFYVSNQFRTFPFSIKDQLIIFYSGVRGAGSFSLAFLLPLTLFPRKKLFVTATLVVTYFTVFFQGITIGPLVRYLDVRKTNKKESINEELHIRLMDHLKAGIEDVCGQWSHYQVRDKFKKFDHRYLRKILIRRNQPKSSIVSLYKKLEMKQAIEMAETGLLSSVASPTPYQSERIQGIKRLSPEDVESMRDILTRNMYQVRQRTLSYNKYNLKPQTSEKQAKEILIRRQNTLRESLRKGQSLPWVKPAGTKNFRYLSFPYSNPQPARRGARAAESTGNPCCWLLHFLLCRAMVEKIWGPGGQETQPRLLCRNLN

SEQ ID NO: 19889 - protein, 568 aa, Rattus norvegicus
MPSTDLLKLKDFEPYLEILEAYSTKAKNYVNGYCTKYEPWQLIAGSVLCTLLVVWVYELIFQPESLWSRFKNKLFRLIRKMPFIGRKIQQQLTKAKKDLVKNMPFLKLDKDYVKTLPAQGLSTAEVLERLKEYSSMDVFWQEGKASGAVYSGEPKLTELLVQAYGEFTWSNPLHPDIFPGLRKLEAEIVRMTCSLFNGGPDSCGCVTSGGTESILMACKAYRDLALEKGIKTPEIVAPESAHAAFDKAAHYFGMKIVRVAQKKNMEVDVRAMKRAISRNTAMLVCSAPQFPHGVIDPIPEVAKLAVKYKIPFHVDACLGGFLIVFMEKAGYPLEKPFDFRVKGVTSISADTHKYGYAPKGSSVVMYSNEKYRKYQFFVDADWQGGIYASPSIAGSRPGGIIAACWAALMHFGENGYVEATKQIIKTARFLKSELENIKNIFILGDPQLSVIALGSNDFDIYRLSNMMSAKGWNFNYLQFPRSIHFCITLVHTRKRVAIQFLKDIRESVTQIMKNPKAKTTGMGAIYGMAQATIDRKMVAEISSVFLDSLYSTDPVTQGNQMNGSPKPR

SEQ ID NO: 19890 - protein, 354 aa, Rattus norvegicus
MGSGISSESKESAKRSKELEKKLQEDAERDARTVKLLLLGAGESGKSTIVKQMKIIHKNGYSKQECMEFKAVVYSNTLQSILAIVKAMTTLGIDYVNPRSREDQQLLLSMANTLEDGDMTPQLAEIIKRLWGDPGIQACFERASEYQLNDSAAYYLNDLDRLTAPGYVPNEQDVLHSRVKTTGIIETQFSFKDLNFRMFDVGGQRSERKKWIHCFEGVTCIIFCAALSAYDMVLVEDEEVNRMHESLHLFNSICNHKYFATTSIVLFLNKKDLFQEKVTKVHLSICFPEYTGPNTFEDAGNYIKNQFLDLNLKKEDKEIYSHMTCATDTQNVKFVFDAVTDIIIKENLKDCGLF

SEQ ID NO: 19891 - protein, 164 aa, Branchiostoma belcheri tsingtaunese
MPKDKNKPKGKMSAYACFVQECRREHEKKYPNKQVVFTEFSQKCASRWKTMNDDEKKRFQVLAEADKRRYEQNMAKYVPPKGAEGGRRKRKKKDPNAPKRAMSAFFMYCADARPKVRAAHPDFQVGDIAKILGKQWKEISDSDKAKYEKKAQTERARYQKELAE

SEQ ID NO: 19892 - protein, 458 aa, Staphylococcus epidermidis ATCC 12228
MGEIGMNDTDRTHKENKLEQDITLPYLKKAVIFSITFGFFGVNMAFALQSAMMGRIFQTLGANPNNLGWFFILPPLVGMIVQPLIGYYSDRTWTRFGRRMPYLLIAGPIGAIVLVLLPNAGSFGFGYASLMALSFGAVMTLLMDLTSNACMQPYKMIIGDMVNEKQRDMAWSWQQIFSNLGGIIATVLPFLLTMLGISNVAPKGEVPMTVKLAYYIAAAVLLIASIWTVISVREYEPKTYNYYHGINENNRNNKLNLLQLLKKAPKQFWQISVVQFFNWFALMYLWTYSTGAIAKNVWNVTDPSSAGYQAAGNWYGVLYCIQFLSSVIFGFVIARSKPSQRKFWYSFGLVFGGIGLISIFFIHNQWLLIFSFVLIGINNLTMNTQPFTLLTEAIDGENSGAYLGLFNTSICLPQIVASIVSFGLYPLLGSSMPAMLLLAGIMMLLGAVSVKFINAKFE

SEQ ID NO: 19893 - protein, 255 aa, Staphylococcus epidermidis ATCC 12228
MVNIMEKFKLTGKVAMVIGGATGIGKAMAEALAQAGANIVIADLQSNIGQETATTISTQSGVKTTSLKLDITHSDEVNQIVDYVVREYGKIDILVNNASISIQDDTENISYEEWLKEINLSLNGAFSVAQTVGRQMIEKGSGSIINVSSVLGLIANKTQDQSSYETSKAGVTMLTKSLAREWSRYGIKVNAIAPGYMRTIETEKILNDNTETNTTPMERVGEPEELAGITVYLASDASSFTQGSVFNIDGGYSAL

SEQ ID NO: 19894 - protein, 251 aa, Staphylococcus epidermidis ATCC 12228
MFKVVICDDERIIRQGLKQMIPWKEYHFTTIYTATDGVEALSLIRQHQPELVITDIRMPRKNGVDLLDDIKDLDCQVIILSSYDDFEYMKAGIQHHVLDYLLKPVDHTQLEHILDILVQRLLERPHSTNDDAAYYTAFQPLLKIDYDDYYVNQILSQIKQHYHKKVTVLDLINPIVVSESYAMRTFKEHVGITIVDYLNRYRILKSLHLLDQHYKHYEIAEKVGFSEYKMFCYHFKKYLHMSPSDYNKLSK

SEQ ID NO: 19895 - protein, 257 aa, Staphylococcus epidermidis ATCC 12228
MSKTAIITGAAGGLGKGIAERLANDGFNIVLQDINEALLLETEKEFKEKGYQAVAYKSDVSKKKEQEELVQFAVTEFGQLDVMVNNAGVDAVTPILEIGEEELSKLFNINVFGTLFGIQAAANQFIKQKSKGKIINACSIAGHESYEVLGTYSATKHSVRSFTQTAAKELADKGITVNAYCPGVAKTEMWDRIDEEMVKLDDSLEIGDAFEAFSSEIKLGRYQEPSDVANLVSFLASNDSDYITGQSILTDGGLVYR

SEQ ID NO: 19896 - protein, 530 aa, Staphylococcus epidermidis ATCC 12228
MKNKRKINNTLVYTISVLIIVVITLIAGIFPKAFGMYAQSVYDWITNWFGWLFLIIVFILDVFLIFLAFSRYGRFKLGSDEEEPEFSMLSWIGMLFSAGLGVGIVFWGVAEPLTHYLHSPFPGKIADHSEESARVAMGYTFFHWGISQWSIFAISGLIVAYFQFRKQRNGLISTAMEPVFGEAYKRPFRNIIDILAIIATVMGIATSIGLGIMQIGGGLNHLFDVPNNNFTKILITILMVAIFLGSSLTGLNHGVKWLSNLNILLGAILLIFILIFGDLKFILESYTLAISDYLQHFIEYSLRVNPYSGDDSWIQQWTVFYWAWVISWSPFIGGFVARVSRGRTIREFVVGVLIIPPLISFTWIAGFGGTAIKLALNHNDKLVHIVDKDYTVALFELLSHFPLSEVTSSLAIVLIFIFIVTSADSTTHIVAGMATGGSINPTLKHKVLWGLLIGAISVAMTIAGGLKSLQTASVITGLPFSIILLLMIFSLMRALKREPIHHFKMTSIDDEKDYSISLEEREKQDEQDNK

SEQ ID NO: 19897 - protein, 213 aa, Staphylococcus epidermidis ATCC 12228
MLKRMRDDIKMVFEQDPAARSTLEVITTYAGLHAVWSHLIAHKLYKNRRYVAARMISQLSRFFTGIEIHPGAKIGKRLFIDHGMGVVIGETCTIGDNVTIYQGVTLGGTGKEKGKRHPDIGDNVLIAAGSKILGNIKIESNVNIGANSVVLQSVPSYTTVVGIPGHIVKQEGRRIGKTFDHRNLPDPLYEQIKHLERQLEKAKNGEIQDDYII

SEQ ID NO: 19898 - protein, 168 aa, Staphylococcus epidermidis ATCC 12228
MKKNHDYMRLAINEAHKAKALGEVPIGAVIVKEGQVIARAHNLRETLQQPTAHAEHIAIERASEVVGSWRLEECTLYVTLEPCVMCAGTIIMSRIPKVVYGATDPKGGCSGSLMNLLEQPQFNHRATVEKGILEEECAELLRSFFKEIREKKKAEKQGKIQKDINLLK

SEQ ID NO: 19899 - protein, 679 aa, Staphylococcus epidermidis ATCC 12228
MEIFETLLIFVALVIVSSFVHTFIPKVPLAFIQIFLGMILYLTPIPVEFNFDSELFMVTLIAPLLFVEGVNVSRVHLRKYIKPVMMMALGLVITTVIGVGLFIHWIWPELPIGAAFAIAAILCPTDAVAVQAITKGKVLPKGSMTILEGESLLNDAAGIISFKIAVGVLITGTFSIFDAIQQFLIASIGGAIVGLIIGMALVRFRLTLMRRGIENINMFTFIQLLTPFVTYLIAELFHASGIIAAVVAGLVHGFERDRIAQTRTQLQMSYNHTWSILGYVLNGFVFSILGFLVPEVIVKIIKTEPHNLLFLIVITLLVALAVYLFRFVWVYVLYPYFYLSVSPFQKMISKNDEDKVTESKPKRSLYALIMTLCGVHGTISLAIALTLPYLLANHETFAYRNDLLFIASGMVILSLIIAQVILPLVTPDSPEVKIGNMSFKEARIYILEHVIDYLNQKSTFETSYRYGNVIKDYHDKLTFLKTVEKEDENSKELERLQKIAFNVETKTLEKLVDDGEITESVLENYMRYAERTEVYKQASLLRRIIVGLRGMLLKRRVKTKINSASSLSVTDNLLELGKINKLVHYNVVSRLAKEATTDNKLEVGMICDGYLMRIDNLTPNNFFNSRHEDTLTKIKLNALREQRRILRELIENDEITEGTALKLRESINYDEMVIVDSMT

SEQ ID NO: 19900 - protein, 381 aa, Staphylococcus epidermidis ATCC 12228
MLTEKEQDIIKQTVPLLQDKGTEITSIFYPKMFEANPELLNMFNQTNQKKGMQSAALAQAVLAAAMNINNLGAIKPAIMPVAHKHCALQVYPEHYPIVGENLLAAIQDVTGLESDDPVIQTWAKAYGEIADVFIKLEQEIYNHMLWKGFKPFKITNITQETSDIKSFTVESEEYDLSQFEPGQYITVDVSSEKLPYRAKRHYSIIDGDENHLVFGVKRDVTTEHEGEVSTILHDEISEGDMINLSAPVGGFSIENTERPQLFIGSGVGMTPLVSMFKKAASLNVPTQMIQAVVTEDERPFAQKLDSITDNYEQAQLHLHVKDKEGYLEAKELEQYLSEQPEIYICGGTKFLHSIINSLKELNYDMNHVHFETFIPRLSVQV

SEQ ID NO: 19901 - protein, 279 aa, Staphylococcus epidermidis ATCC 12228
MTNDVQILNNGYPMPAVGLGVYKIADEQMEEVVRTALDAGYRAFDTAYFYGNEKALGSALKHSNVERDELFITSKLWNDYQGYDQTIEYFNKSLDNLGLDYLDLFLIHWPCENDQLYIESYKALEHLYEEGKIKAIGVCNFKIHHLEKLMKETKITPQVNQIELHPYFNQQDVQDFCDEHDIKVTAWMPLMRNKGLLDDPVITDIAHRYDKTPAQIVLRWHLAHNRIIIPKSQTPKRIKENFDIFDFNLELTDVAEIDSLNKNARQGKDPDDVSIGDLK

SEQ ID NO: 19902 - protein, 434 aa, Staphylococcus epidermidis ATCC 12228
MPIITDVYAREVLDSRGNPTVEVEVLTESGAFGRALVPSGASTGEHEAVELRDGDKSRYLGKGVTKAVENVNEMIAPEIVEGEFSVLDQVSIDKMMIQLDGTHNKGKLGANAILGVSIAVARAAADLLGQPLYKYLGGFNGKQLPVPMMNIVNGGSHSDAPIAFQEFMILPVGAESFKESLRWGAEIFHNLKSILSERGLETAVGDEGGFAPRFEGTEDAVETIIKAIEKAGYKPGEDVFLGFDCASSEFYENGVYDYTKFEGEHGAKRSAAEQVDYLEELIGKYPIITIEDGMDENDWEGWKQLTDRIGDKVQLVGDDLFVTNTEILSKGIEQGIGNSILIKVNQIGTLTETFDAIEMAQKAGYTAVVSHRSGETEDTTIADIAVATNAGQIKTGSLSRTDRIAKYNQLLRIEDELYETAKFEGIKSFYNLDK

SEQ ID NO: 19903 - protein, 572 aa, Staphylococcus epidermidis ATCC 12228
MSKLIKGIAASDGVAIAKAYLIVEPDLSYDSNEKVTDIESEVEKFNDAIEASKIELTKIRNNAEAQLGADKAAIFDAHLLVLDDPELIQPIQDKIRNDKVNAATGLDEVTTQFISIFESMDNEYMKERAADIRDVSKRVLAHILGVDLPNPSLINESAVIVGNDLTPSDTAQLNKEFVQGFVTNIGGRTSHSAIMSRSLEIAAVVGTKSITEEVKQGDMIIVDGMSGDVIIDPTEDELIAYQNKRERFFEDKKELQKLRDADTVTVDGVHAELAANIGTPDDLSGVIDNGAQGIGLYRTEFLYMGRDQMPTEEEQFEAYKKVLETMDGKRVVVRTLDIGGDKELPYLDLPKEMNPFLGYRAIRLCLAQPEIFRPQLRALLRASVYGKLNIMFPMVATIKEFRDAKSMLLEEKENLLREGYEVSDDIELGIMVEIPATAALADVFAKEVDFFSIGTNDLIQYTLAADRMSERVSYLYQPYNPSILRLVKQVIEASHKEGKWTGMCGEMAGDQTAVPLLLGLGLDEFSMSATSILKARRQINGLSKNEMAELANRAVECSTQEEVVDLVNQLAK

SEQ ID NO: 19904 - protein, 325 aa, Staphylococcus epidermidis ATCC 12228
MAQMTMVQAINDALKSELKRDEDVLVFGEDVGVNGGVFRVTEGLQKEFGEDRVFDTPLAESGIGGLALGLAVTGFRPVMEIQFLGFVYEVFDEVAGQIARTRFRSGGTKPAPVTIRTPFGGGVHTPELHADNLEGILAQSPGLKVVIPSGPYDAKGLLISSIQSNDPVVYLEHMKLYRSFREEVPEEEYKIDIGKANVKKEGNDITLISYGAMVQESLKAAEELEKDGYSVEVIDLRTVQPIDIDTLVASVEKTGRAVVVQEAQRQAGVGAQVAAELAERAILSLEAPIARVAASDTIYPFTQAENVWLPNKKDIIEQAKATLEF

SEQ ID NO: 19905 - protein, 399 aa, Staphylococcus epidermidis ATCC 12228
MKHILLAVTGGIAAYKAIDLTSKLIQSGYDVRVMLSDHAQEFVTPLAFQAISRNPVYTNTFKEENPEEIQHVSLGDWADAIIVAPATANTIAKLSVGIADDLITSTLLATTTPKFVAPAMNVNMYNNPRTKHNMKVLSQDGYYFIEPGSGYLACGYVAKGRMEEPMQILSVINKFFTQQKNVVKSSFSGKRALVTAGPTVEVIDPVRYVSNRSSGKMGYAIAEALRDKGAIVTLISGPTHLSLPEGINVVKVESADDMFQAVTERFAKQDIVIKAAAVSDYTPMDILEHKLKKQEGGLSVQFKRTKDILKYLGENKTHQYLVGFAAETQNIEQYALDKLKRKNADVIISNNVGDTSIGFSSDDNELTMHFKNNEKVNIKKGKKSALAHQIIEILETRWQ

SEQ ID NO: 19906 - protein, 244 aa, Staphylococcus epidermidis ATCC 12228
MNKSALVTGASRGIGRSIALQLAEEGYNVAVNYAGSKDKAEAVVEEIKAKGVESFAIQANVAKGDEVKEMIKEVVSQFGSVDVLVNNAGITKDNLLMRMKEQEWDDVIDTNLKGVFNCIQKVTPQMLRQRSGAIINLTSIVGAMGNPGQANYVATKAGVIGLTKTAARELASRGITVNAVAPGFIVSDMTNALSDDLKDQMLEQIPLKRFGEDTDIANTVAFLASDKAKYITGQTIHVNGGMYM

SEQ ID NO: 19907 - protein, 325 aa, Staphylococcus epidermidis ATCC 12228
MKIFDYEDIQLIPNKCIVESRSECNTSVKFGPRTFKLPVVPANMQTVMNEELAQWFAENDYFYIMHRFNEENRIPFIKKMHHAGLFASISVGVKENEFNFIEKLASSSLIPEYITIDIAHGHSNSVINMIKHIKKHLPNSFVIAGNVGTPEGVRELENAGADATKVGIGPGRVCITKIKTGFGTGGWQLSALNLCNKAARKPIIADGGLRTHGDIAKSIRFGATMVMIGSLFAAHEESPGETVELDGKKYKEYFGSASEYQKGEHKNVEGKKMFVEHKGSLKDTLTEMEQDLQSSISYAGGKDLKSLRTVDYVIVRNSIFNGDRD

SEQ ID NO: 19908 - protein, 546 aa, Staphylococcus epidermidis ATCC 12228
MNSSSQEKKNKKFSSVFIYSSIIAAIVVIIGAVWPEKFDSVTNTAKMWITNNLGWYYLILTTVIVFFCVFLIFSPIGKLKLGKPNDKPEFNTISWFAMLFSAGMGIGLVFYGAAEPMAHFAAPPTADPETTKAYTESLRSTFFHWGFHAWAIYGVVALALAYSQFRKGEPGLISRTLRPLLGDKVEGPIGTLIDVLSVFATLVGVAVSLGMGALQINGGLHYLFGVPNNTFVQGIIIVVVTILFIASAWSGLSKGIQYLSNLNIGLGTILMIVTLIVGPTVLILNMMTSSTGSLLNSFLFNSFDTAALNGQKRDWMSTWTLYYWGWWLSWSPFVGVFIARVSKGRSIREFISGVLLVPALVSFIWFSVFGVLGIEAGKKDSGLFKMSPETQLFGVFNHIPLGIVLSIIALLLIASFFVTSADSATFVLGMQTTFGSLNPSSLVKVTWGVAQALIAFVLLLAGGGDGSKALNAIQSAAIISAFPFSFVVIMMMISFYKDANKERKFLGLTLTPNKHRLQEYVKYQQEDYETDILEKREVRRNKEKEE

SEQ ID NO: 19909 - protein, 240 aa, Staphylococcus epidermidis ATCC 12228
MVQHLSAQEIIQYISDAKKSTPLKVYVNGHFENVTFPESFKVFGSEHSKVIFCEANEWKQFYQQNHSLITELEIEMDRRNSAIPLKDLTNTNARIEPGAFIREQAIIEDGAVVMMGATINIGAIVGEGTMIDMNATLGGRATTGKNVHVGAGAVLAGVIEPPSASPVVIEDNVLIGANAVILEGVRVGAGAIVAAGAIVTQDVPAGAVVAGTPAKVIKQTSEVQDSKREIVSALRKLNNE

SEQ ID NO: 19910 - protein, 421 aa, Staphylococcus epidermidis ATCC 12228
MVVNYNDNGELTMGGTSLKTIAQSFGTPSIVYDEDQIRNQIRRYHKAFEASGLSYNISYASKAFTCIQMVKLIDEENLQLDVVSEGELYTALEAGFDSKRIHFHGNNKTKREIQYALDNQIGYFVVDTLEEIELIDKYADSNVDVVLRVNPGVEAHTHEFIQTGQEDSKFGLSIKHGLALNAVNKVKATKHLQLKGIHFHIGSQIEGTEAMIKTAKIVLNWLASERIEVSLLNIGGGFGIKYVEGDESFPIEQGISEITEAIKETAQALQYNIPEIGIEPGRSIVGEAGITLYEVGTIKDIPGVNKYVSVDGGMSDHIRTALYGAQYEALLVNRNEKANESVTIAGKLCESGDIIVRDAPLPSSVHRGDYLAILSTGAYHYSMASNYNQMQKPPVFFLKDGKAREVIKRQSLRQLIINDTK

SEQ ID NO: 19911 - protein, 380 aa, Staphylococcus epidermidis ATCC 12228
MKIGITCYPSMGGSGIIATELGIKMAERGHEVHFITSNIPFRIRKPLPNMTFHQVEVNQYAVFQYPPYDITLSTKISDVIQEYDLDILHMHYAVPHAVCGILAKQMSGKNVKIMTTLHGTDITVLGYDHTLQNAIKFGIEQSDIVTSVSHSLAQQTYEIINTKKEIIPIYNFVRENEFPTRHNEELKDCYGISPEEKVLIHVSNFRKVKRIDTVIETFAKVHESIPSKLILLGDGPELIDMRHKARELDVETHVLFLGKQNDVSAFYQLSDLVLLLSEKESFGLTLLEAMKTGVLPIGSHAGGIKEVIRHEETGFIVDIGDSTQAAKYAIKLLSNPELYQKMQSQMLKDIEARFSSDLITDQYENYYRKMLEQGENNNES

SEQ ID NO: 19912 - protein, 368 aa, Staphylococcus epidermidis ATCC 12228
MSDNQVKIKKQTIDPTLTLEDVKKQLIDKGKKEGHLSHEEIAEKLQNFEMDSDQMDDFFDQLNDNDITLVNEKDSSDTDDKINPNDLSAPPGVKINDPVRMYLKEIGRVNLLSAQEEIELAKRIEQGDEIAKSRLAEANLRLVVSIAKRYVGRGMLFLDLIQEGNMGLIKAVEKFDFSKGFKFSTYATWWIRQAITRAIADQARTIRIPVHMVETINKLIRVQRQLLQDLGRDPAPEEIGEEMDLPPEKVREILKIAQEPVSLETPIGEEDDSHLGDFIEDQEAQSPSDHAAYELLKEQLEDVLDTLTDREENVLRLRFGLDDGRTRTLEEVGKVFGVTRERIRQIEAKALRKLRHPSRSKRLKDFMD

SEQ ID NO: 19913 - protein, 278 aa, Staphylococcus epidermidis ATCC 12228
METVQFYNGRTMPKIGLGTYRVKDGDECRESVKYAIERGYRSIDTAMIYGNEETVGQGIKEGLESTGLSREDLFITSKLWLTDFGRQNVEDAYRQSVAKLGLDYLDLYLMHWPGTNEAVMIDTWRGMEDLYKQNQVKNIGVSNFTPEHFEALLAQVSIKPVINQVEFHPYLTQNKLRKYLEAQNIIMESWSPLMNSQILHDEVINEVANEVGKTPAQVVIRWNIQHDVVVIPKSVTPHRIEENLDVWNFELSDNQMERIDQLNQDKRIGPNPLEFDGK

SEQ ID NO: 19914 - protein, 355 aa, Staphylococcus epidermidis ATCC 12228
MLTVNQVKEIVGALKDPIIDVPLRESEGIVDVSIKDNINHVSVKVAMAQLGGQPQLDLQMAIVKALKENGANTVGIRFEELPSEVVERYIGKGSEKPKTIEELLSQNNPVEFISIASGKGGVGKSTVAVNLAVALAREGKKVGLVDADIYGFSVPDMMGIDERPGIDGKEIIPVERHGVKVISMAFFVEENAPVIWRGPMLGKMLTNFFTEVQWGELDYLLLDLPPGTGDVALDVHSMLPSSKEIIVTTPHPTAAFVAARAGAMAKHTEHTILGVIENMSYFESKETGKKEYVFGKGGGKKLSDELETQLFAELPLEQPTWNPNDFSPSIYQSDDRLGELYTLIARKVIASTQKQ

SEQ ID NO: 19915 - protein, 263 aa, Staphylococcus epidermidis ATCC 12228
MFEELENKVVLITGAATEIGKSIAENFGKAKAKVVINYRSDRHHDEIEEIKQTVAKFGGQTLVVQGDVSIEEDIKRMIETTINHFGTLDIIINNAGFENSIPTHEMSIDDWQKVIDINLTGAFVGSREAINQFLKENKKGTIINISSVHDTIPWPNYVHYAASKGGLKLMMETMSMEYAQYGIRINNISPGAIVTEHTEEKFSDPTTREETIKMIPAREIGNAQDVANAVLFLSSDLASYIHGTTLYVDGGMMNYPAFMGGKG

SEQ ID NO: 19916 - protein, 387 aa, Staphylococcus epidermidis ATCC 12228
MNMKKGVSQLTLQTLSLVAGFMAWSIISPLMPFISQDVDISPGQISVILAIPVILGSVLRVPFGYLTNIVGAKWVFFWSFIVLLLPIFLLGQAQSPGMLMLSGFFLGIGGAIFSVGVTSVPKYFSKDKVGLANGIYGVGNIGTAVSSFCAPVLAGAIGWQNTVRSYLIILSIFAILMFFLGDKNEPKVKIPLMAQVKDLSKNYKLYYLSLWYFITFGAFVAFGIFLPNFLVDHFSIDKVDAGIRSGIFIALATFLRPVGGVIGDKFNAVQALIIDFVIMIIGALILSLSSHIVLFTIGCLAISICAGIGNGLIFKLVPSYFSKEAGSANGIVSMMGGLGGFFPPLVITFVTSITGSSHLAFFFLAIFGVIALITMIHLNKKEKAIRI

SEQ ID NO: 19917 - protein, 272 aa, Staphylococcus epidermidis ATCC 12228
MERLENKIAVITGASTGIGQASAVALAIEGAHVLALDISDQLEETVQSINDNGGKATAYRVDISDDKQVKQFSEKIAQEFGHVDVIFNNAGVDNGAGRIHEYPVEVFDKIMAVDMRGTFLVTKFLLPLMMKQGGSIINTASFSGQAADLYRSGYNAAKGGVINFTKSIAIEYGRENIRANAIAPGTIETPLVDNLAGTSDEEAGQTFRENQKWVTPLGRLGTPDEVGKLVAFLASDDSSFITGETIRIDGGVMAYTWPGEMLSDESWKNSTK

SEQ ID NO: 19918 - protein, 307 aa, Staphylococcus epidermidis ATCC 12228
MNKNKVIVIGSTNVDKFLNVKRFPKPGETLHINQAQKEFGGGKGANQAIAASRLAADTTFISKVGKDGNANFILEDFKKAGIHTQYILTSESEETGQAFITVDEAGQNTILVYGGANMTLSATDVEMSADAFIGADFVVAQLEVPFEAIEQAFKIARKQNITTVLNPAPAIELPKSLLELTDIIIPNETEAELLTGISINNESDMKETATYFLDLGISAVLITLGEQGTYCAYQEQYKMIPACNVKAIDTTAAGDTFIGAFLSELNKDLSNIESAIRLANQASSLTVQRKGAQASIPTRKEVEAEYN

SEQ ID NO: 19919 - protein, 875 aa, Staphylococcus epidermidis ATCC 12228
MTQFVYAFNEGNIAMKDLLGGKGANLSEMKRLGLPVPDGFTITTEACITYLKQNEELPTEVKTQLIDHLAAFSKRTGKAFSSDDNLLLVSVRSGAKISMPGMMDTILNLGLNDDNVKKLVDKTNDARFAYDCYRRLLQMFGEVVYGIPMTAFDTYFNDFKTKHRYQNDAEIPAEGLQTICEKYKEIYVEEAYKPFPQEPLKQLEEAIEAVFKSWDNDRARVYRDLNDIPHDIGTAVNIQEMVFGNSGENSGTGVAFTRNPVTGENHLFGEYLLNAQGEDVVAGIRTPKDIDTLKQQMPDVHQEFVDVTKQLEKHYKDMQDIEFTIENGKLYLLQTRNGKRTAKAAIKIAVDLVHEQLITREEAVSKVEVKSIDQLLHPNFNEESLKQATVVSKMGLPASPGAATGKVVFSAEEAKLQAENGNKVVLMRPETSPEDIEGMVASEAIVTTHGGMTSHAAVVARGMGKCCVTGCSNVEIDTVNKTVYYPEGELHEGDIVSVDGSAGDLYLGAIETVNAEHSEEFDQFMTWSEEIARLQVRMNAETPQDIKAGYNFGSKGIGLVRTEHMFFGPERLIEMRRFILASNHDERVQALEKIKTYQVEDFETIFRLSQDRPTIVRLLDPPLHEFLPSSEEDINNVSQQLNVSSEFLRKRIVDLNEVNPMLGHRGCRLAVTYPELYEMQVEAIIESVIKLQKEGITCLPEIMIPLVSTVEEFTTLKERLVNTITHLEKESQQDIQYMIGTMIETPRACLIANDLAKHCDFFSFGTNDLTQLTFGFSRDDAGKFINVYTENNILQLDPFQTLDREGVGRLIQLAVEQAKNTNPEIKIGVCGELGGDAKSIRKFNQWEIDYVSCSPFRVPGAILATAQSQAEESER

SEQ ID NO: 19920 - protein, 496 aa, Staphylococcus epidermidis ATCC 12228
MELVDKLSNRQYIDGEWVESSNKNTRDIINPYNQETIFTVAEGTKEDVERAILAARRSFEDGEWSLETSEVRGKKVRAVADKIKENREELAKLETLDTGKTLEESYADMDDIHNVFMYFAGLADKDGGEIINSPIPNAESKVVKEPVGVVTQITPWNYPLLQASWKIAPALATGCSLVMKPSEITPLTTIRVFELMEEVGFPKGTINLVLGAGSEVGDVMSGHEEVDLVSFTGGIETGKHIMKQAANHVTDVALELGGKNPNIIFDDADFELAVDQALNAGYFHAGQVCSAGSRILVHNDIKDKFEKALIDRVSKIKLGNGFDQDTEMGPVISTAHRDKIEGYMEVAKKDGATIAIGGKRPEREDLQAGLFFEPTVITDCDTSMRIVQEEVFGPVVTVEGFADEEEAIRLANDSIYGLAGAIFTKDIGKAQRVANKLKLGTVWINDFHPYFAQAPWGGYKQSGVGRELGKEGLEEYLVSKHILTNTNPEPVDWFSK

SEQ ID NO: 19921 - protein, 540 aa, Staphylococcus epidermidis ATCC 12228
MKKEKVMDWTTFIGVVIVLLFAVIPMMVFPKASEIIITDINSAISNSIGSVYLFMGLAIFCFVLYIAFGKYGNVTLGKATDKPEFNNFTWAAMLFCAGIGSDILYWGVIEWAFYYQVPPNGAKSMSDQALQYATQYGMFHWGPIAWAIYVLPALPIGYLVFVKKKPVYKISQACRPILKGHTDKLLGKIVDILFIFGLLGGAATSLALGVPMISAGIERLTGLDGSNMILRSIILLTITVIFAISSYTGLKKGIQKLSDVNVWLSFLLLAFVFIVGPTVFIMETTVTGFGNMIKDFFHMATWMEPFGGIKGRKETNFPQDWTIFYWSWWLVYAPFIGLFIARISKGRTLKEVVLGTICYGTLGCVLFFGIFGNYAVYLQITEQFNVISYLNNYGTEATIIEIMHQLPFSTITIILFLISAFLFLATTFDSGSYILAAASQKKVIGEPLRANRLFWAFALCLLPFSLMLVGGERALEVLKTASLLASVPLIVIFTLMMISFLIILGRDRIKLERRADKHKEIERRSLRIVQVKDKPEDDNL

SEQ ID NO: 19922 - protein, 488 aa, Staphylococcus epidermidis ATCC 12228
MWENKFAKESLTFDDVLLIPAASDVLPSDVDLSVKLSDKIKLNIPVISAGMDTVTESKMAIAMARQGGLGVIHKNMGVEEQADEVQKVKRSENGVISNPFFLTPEESVYEAEALMGKYRISGVPIVDNQEDRKLIGILTNRDLRFIEDFSIKISDVMTKDNLITAPVGTTLDEAEAILQKHKIEKLPLVENGRLEGLITIKDIEKVLEFPYAAKDEHGRLLAAAAIGTSKDTEIRAQKLVEAGVDALIIDTAHGHSKGVINQVKHIKETYPEITVVAGNVATAEATRALFEAGADVVKVGIGPGSICTTRVVAGVGVPQITAVYDCATEARKHGKAIIADGGIKFSGDIIKALAAGGHAVMLGSLLAGTEESPGATEVFQGRQYKVYRGMGSLGAMEKGSNDRYFQEDKTPRKFVPEGIEGRTAYKGPLQDTIYQLMGGVRAGMGYTGSENLKKLREEAQFTRMGPAGLAESHPHNVQITKESPNYSF

SEQ ID NO: 19923 - protein, 612 aa, Staphylococcus epidermidis ATCC 12228
MSHLLNQLKSNVLVADGAIGTIFYSEGLDTCPEAYNLTHPDKVERIHRSYIEAGADVIQTNTYGANFEKLKSFGLEHKVKEIHQAAVQIAKHAANEDTIILGTVGGFRGVRQEDISLSTIQYHTELQIDTLIDEGVDALLFETYYDLDELTRIVTATRQKYDIPIIAQLTASNTNYLVDGTEINAALKYVVECGANVVGLNCHHGPHHMQRSFSHIELPKHAYLSCYPNASLLDIENSEFKYSDNAQYFGDIAQELINEGVRLIGGCCGTTPEHIRYIKSAVKHLKPVKDKKVIPINKASSQKQTRVLKQNLTSKVKNGPTVIVELDTPKHLDTDTFFDNVGKLDEAGIDAVTLADNSLATVRVSNIAAASLIKQRYDIEPLVHVTCRDRNLIGLQSHLLGLSLIGVNEILAITGDPSKVGHLPGATNVYDVNSKGLTELALRFNKGINTDGDALKKHTNFNIAGAFDPNVRKLDGAIKRLEKKVASGMSYFITQPVYSKEKIIQVYEETKHLNTPFFIGIMPIASYNNALFLHNEVPGIKMSDDVLNQFKAVKDDKEKTKELSLRLSKELIDTVHEYFNGLYIITPFQKVDYSLELAAYSKSITANKEAIL

SEQ ID NO: 19924 - protein, 353 aa, Hordeum vulgare subsp. vulgare
MDFRSSNGGSSSERRPAAEGASLTRQGSIYSLTFEEFQSTLGGGAGVGGGDLGKDFSSMNMDELLRSIWTAEESQAMAASASGAGAGAPPMSLQGQGSLTLPRTLSAKTVDEVWRNLVRDDPLPVGAEGAEPQPHRQATLGEMTLEEFLVKAGVVREIPTAPAVPPPPMQPRPVPVAPKGATFYGNFPSANDVGTAALGFPPVAMGDLALGNGLMPRALGMGGAPLVVQTAVKPVDSGSKGSEDLSSPSEPMPYSFEGIVRGRRTGGGVEKVVERRQRRMIKNRESAARSRARKQAYTMELEAEVQKLKDLNEELVKKQTEILKMQKREAPEMKDQFGRKKRQCLRRTLTGPW

SEQ ID NO: 19925 - protein, 929 aa, Homo sapiens
MEPRDGSPEARSSDSESASASSSGSERDAGPEPDKAPRRLNKRRFPGLRLFGHRKAITKSGLQHLAPPPPTPGAPCSESERQIRSTVDWSESATYGEHIWFETNVSGDFCYVGEQYCVARMLQKSVSRRKCAACKIVVHTPCIEQLEKINFRCKPSFRESGSRNVREPTFVRHHWVHRRRQDGKCRHCGKGFQQKFTFHSKEIVAISCSWCKQAYHSKVSCFMLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPKCVVFLNIPRYCAGTMPWGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVSRVSMHDYEALHYDKEQLKEASVPLGTVVVPGDSDLELCRAHIERLQQEPDGAGAKSPTCQKLSPKWCFLDATTASRFYRIDRAQEHLNYVTEIAQDEIYILDPELLGASARPDLPTPTSPLPTSPCSPTPRSLQGDAAPPQGEELIEAAKRNDFCKLQELHRAGGDLMHRDEQSRTLLHHAVSTGSKDVVRYLLDHAPPEILDAVEENGETCLHQAAALGQRTICHYIVEAGASLMKTDQQGDTPRQRAEKAQDTELAAYLENRQHYQMIQREDQETAV

SEQ ID NO: 19926 - protein, 378 aa, Xenopus laevis
MPLDEDGPSWKKRAEDIRDIYEFREVLGTGAFSEVVLAEEKKTQKLVAIKCIPKKALEGKETSIENEIAVLRKIKHTNIVSLEDIYDSRSHLYLIMQLVSGGELFDRIVEKGFYTEKDASQLIKQILDAVKYLHDMGIVHRDLKPENLLYYSIDEDSKIMISDFGLSKIEGSGSVMSTACGTPGYVAPEVLAQKPYSKAVDCWSIGVIAYILLCGYPPFYDENDAKLFEQILKAEYEFDSPYWDDISDSAKDFIQHLMEKDPNKRITCDQALQHPWIAGDTALDKNIHESVSEQIRKNFAKSRWKQAFNATAVVRHMRKLQLGTSQEGPGQTTPTSPCHGNLLMPGDNHGCQDCCSPKSSENNSLAYSTQHCAQSNRV

SEQ ID NO: 19927 - protein, 322 aa, Oryza sativa (japonica cultivar-group)
MTAKGGAAPSPGGAGGLPNGRFFTVGLVTAWYSSNIGVLLLNKYLLSNYGFKYPIFLTMCHMSACALLSYAAIAWLRVVPMQLVRSRVQLAKIAALSLVFCGSVVSGNVSLRYLPVSFNQAVGATTPFFTAVFAYIMTVKRESWVTYLTLVPVVTGVMIASGGEPSFHLFGFIMCIGATAARALKTVLQGILLSSEGEKLNSMNLLLYMAPIAVILLLPATIFMEDNVVGITIELAKKDTTIVWLLLFNSCLAYFVNLTNFLVTKHTSALTLQVLGNAKGAVAVVVSILIFRNPVSVTGMLGYTLTVIGVILYSESKKRNKP

SEQ ID NO: 19928 - protein, 357 aa, Oryza sativa (japonica cultivar-group)
MTHGGRYLLYDIFGNKFEVTNKYQPPIMPIGRGAYGIVCSVMNFETREMVAIKKIANAFNNDMDAKRTLREIKLLRHLDHENIIGIRDVIPPPIPQAFNDVYIATELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQYPRRTFASMFPRVQPAALDLIERMLTFNPLQRITVEEALDHPYLERLHDIADEPICLEPFSFDFEQKALNEDQMKQLIFNEAIEMNPNIRY

SEQ ID NO: 19929 - protein, 488 aa, Photorhabdus luminescens
MTIINHWINGKNVSSKTYFETTNPATGEVLAEVAAGGQEEIDQAVAAAKEAFPKWADLPMKERARLMRRLGELIDENVPEIAAMETKDTGLPIHQTQNVLIPRASHNFNFFAEICQQMNGHTYPVDDKMLNYTLVQPVGVCALISPWNVPFMTATWKVAPCLALGNTAVLKMSELSPLTANRLGELALEAGIPAGVLNVVQGYGATAGDALVKHHDVRAVSFTGGTVTGRQIMKNAGLKKYSMELGGKSPVLIFEDADIERALDASLFTIFSINGERCTAGSRIFIQQSIYPEFIKRFAERANRLRVGDPQDPNTQIGALISKPHWEKVSGYIRLGIEEGATLLAGGPDKPIDLPAHLKEGNFLRPTVLADVDNRMRVAQEEIFGPVACLLPFKDEAEGLRLANDVEYGLASYIWTQDVSKVLRLARNIEAGMVFVNTQNVRDLRQPFGGVKASGTGREGGEYSFEVFAEMKNVCISMGDHHIPRWGI

SEQ ID NO: 19930 - protein, 490 aa, Photorhabdus luminescens
MTNDVNTELLRQQAYINGQWVDADNQATFKVTNPANGQVIAHVSNMGAAETERAIAAAQQALPAWRAMTAKQRSQILQRWFQLMMANQQALAELLSREQGKSQAEAMGEIAYGASFIEWFAEEGKRTYGETIPSPMPGRRIVTIKQPIGVVAAITPWNFPNAMITRKVGPALAAGCTVILKPASETPLSALALAALAEQAGIPAGVFNVVTGVDAKTIGGVLTQSPIVRKLSFTGSTRIGKLLMAQSADTVKKLSLELGGNAPFIVFDDANIDAAVQGALIAKFRNSGQTCVCANRILVQETIYDAFAERLAQAVNKLQVGPASDAKSQQGPLINQAAVDKVEEHINDAVSRGARILAGGKPHALGGLFFEPTVLADVNESMLISQEETFGPVAPLFKFRDEAEAIHLANDTEFGLAAYFYSRDIGRIYRVAEALESGMVGINEGLISNEVAPFGGIKQSGLGREGSRYGIEDYLEVKYLCFGGIEDTGV

SEQ ID NO: 19931 - protein, 99 aa, Homo sapiens [sequence omitted]

SEQ ID NO: 19932 - protein, 159 aa, Homo sapiens
MAAAEEEDGGPEGPNRERGGAGATFECNICLETAREAVVSVCGHLYCWPCLHQWLARPERQECPVCKAGISREKVVPLYGRGSQKPQDPRLKTPPRPQGQRPAPESRGGFQPFGDTGGFHFSFGVGAFPFGFFTIVFNAHEPFRRGTGVDLGQGHPASS

SEQ ID NO: 19933 - protein, 894 aa, Homo sapiens
MEPRDGSPEARSSDCESASASSSGSERDAGPEPDKAPRRLNKRRFPGLRLFGHRKAITKSGLQHLAPPPPTPGARCSESERQIRSTVDWSESATYGEHIWFETNVSGDFCYVGEQYCVARMLQKSVSRRKCAACKIVVHTPCIEQLEKINFRCKPSFRESGSRNVLEPTFVWHHWVHRRRQDGKCRHCGKGFQQKFTFHSKEIVAISCSWCKQAYHSKVSCFVLQQIEEPCSLGVHAAVVIPPTWILRARRPQNTLKASKKKKRASFKRKSSKKGPEEGRWRPFIIRPTPSPLMKPLLVFVNPKSGGNQGAKIIQSFLWYLNPRQVFDLSQGGPKEALEMYRKVHNLRILACGGDGTVGWILSTLDQLRLKPPPPVAILPLGTGNDLARTLNWGGGYTDEPVSKILSHVEEGNVVQLDRWDLHAEPNPEAGPEDRDEGATDRLPLDVFNNYFSLGFDAHVTLEFHESREANPEKFNSRFRNKMFYAGTAFSDFLMGSSKDLAKHIRVVCDGMDLTPKIQDLKPQCVVFLNIPRYCAGTMPCGHPGEHHDFEPQRHDDGYLEVIGFTMTSLAALQVGGHGERLTQCREVVLTTSKAIPVQVDGEPCKLAASRIRIALRNQATMVQKAKRRSAAPLHSDQQPVPEQLRIQVRRVSMHDYEALHYDKEQLKEASVPLGTVVVPGDSDLELCRAHIERLQQEPDGAGAKSPTCQKLSPKWCFLDATTASRFYRINRAQEHLNYVTEIAQDEIYILDPELLGASARPDLPTPTSPLPTSPCSPTPRSLQGDAAPPQGEELIEAAKRNDFCKLQELHRAGGDIMHRDKQSRTLLHHAVSTGSKDVVRYLLDHAPPEILDAVEENGETCLHQAAALGQRTICHYIVEAGARPAGRHSPAAG

SEQ ID NO: 19934 - protein, 170 aa, Homo sapiens
MIVHVTTAYAHELPKYGVKVGLSNYAAAYCTGLLLARRLFNMFGMDKIYEAQVEVTGDEYNVESINGQPGAFTCYLDAGLARTTSGNKVFGALKGAVDGGLSIPHGTKRFPGYDSESKEFNAEVHWKHIMGQNVADYTCYLMQEDEDAYKKQFSQYIKNSITPDMMEEMC

SEQ ID NO: 19935 - protein, 408 aa, Homo sapiens
MIPPEQPQQQLQPPSPAPPNHVVTTIENLPAEGSGGGGSLSASSRAGVRQRIRKVLNREMLISVALGQVLSLLICGIGLTSKYLSEDFHANTPVFQSFLNYILLFLVYTTTLAVRQGEENLLAILRRRWWKYMILGLIDLEANYLVVKAYQYTTLTSIQLLDCFVIPVVILLSWFFLLIRYKAVHFIGIVVCILGMGCMVGADVLVGRHQGAGENKLVGDLLVLGGATLYGISNVWEEYIIRTLSRVEFLGMIGLFGAFFSGIQLAIMEHKELLKVPWDWQIGLLYVGFSACMFGLYSFMPVVIKKTSATSVNLSLLTADLYSLFCGLFLFHYKFSGLYLLSFFTILIGLVLYSSTSTYIAQDPRVYKQFRNPSGPVVDLPTTAQVEPSVTYTSLGQETEEEPHVRVA

SEQ ID NO: 19936 - protein, 131 aa, Brassica rapa
ILDRYGKKHADDLNALDLQSKSLNYSSHHELLELVESKLVESIDDVSVDSLVELEDHLETALSVTRARKAELMLKLVESLKEKENLLKEENQVSASQIEKKNLEGAEADNIEMSSGQISDINLPVTLPLLN

SEQ ID NO: 19937 - protein, 132 aa, Brassica rapa
ILDRYGKQHADDLKALNLQSKALSYGSHNELLELVDSKLVESNVGGVSVDTLVQLEGVLENALSLTRARKTELMLKLVDSLKEKEKLLKEENQALAGQKEKKNLAGAEADNMEMSPGQISDINLPVTLPLLN

SEQ ID NO: 19938 - protein, 132 aa, Brassica rapa
ILDRYGKQHDDDLKALDRQSKALDCGSHHELLELVESKLEESNVDNVSVGSLVQLEEHLENALSVTRARKTELMLKLVENLKEKEKSLEEENHVLASQMEKSNLVRAEADNMDVSPGQISDINLPVTLPLLN

SEQ ID NO: 19939 - protein, 95 aa, Homo sapiens [sequence omitted]

SEQ ID NO: 19940 - protein, 160 aa, Homo sapiens [sequence omitted]

SEQ ID NO: 19941 - protein, 374 aa, Homo sapiens
MANQVMKCKAAVAWEAGKPLSIEEIEVAPPKAHEVRIKIIATAVCHTDAYTLRGADPEGCFPVILGHEGAGIEESVGEGVTKLKAGDTVIPLYIPQCGECKFCLYPKTNLCQKIRVTQGKGLMPDGTSRFTCKGKTILRYMGTSTFSEYTVVADISVAKIDPLAPLDKLCLLGCGISAGDGAAVNTAKVEPGSVCAVFGLGGVGLAVIKGCKVAGASRIIGVDINKDKFARAKEFGATECINPQGFSKPIQEGLIETTDGGVDYSFECIGNVKVMRAALEAYHKGWGVSVVVGVAASGEEIATRPFQLVTGRTWKGTAFGGWKSVESVPKLVSEYMSKKIKVDEFVTHNLSFGEINKAFQLMHSGKSIRTVVKI

SEQ ID NO: 19942 - protein, 2672 aa, Homo sapiens
MAADTQQVSETLKRFAGKVTTASVKERREILSELGKCVAGKDLPEGAVKGLCKLFCLTLHRYRDAASRRALQAAIQQLAEAQPEATAKNLLHSLQSSGIGSKAGVPSKSSGSAALLALTWTCLLVRIVFPSRAKRQGDIWNKLVEVQCLLLLEVLGGSHKHAVDGAVKKLTKLWKENPGLVEQYLSAILSLEPNQNYAGMLGLLVQFCTSHKEMDVVSQHKSALLDFYMKNILMSKVKPPKYLLDSCAPLLRYLSHSEFKDLILPTIQKSLLRSPENVIETISSLLASVTLDLSQYAMDIVKGLAGHLKSNSPRLMDEAVLALRNLARQCSDSSAMESLTKHLFAILGGSEGKLTVVAQKMSVLSGIGSVSHHVVSGPSSQVLNGIVAELFIPFLQQEVHEGTLVHAVSVLALWCNRFTMEVPKKLTEWFKKAFSLKTSTSAVRHAYLQCMLASYRGDTLLQALDLLPLLIQTVEKAASQSTQVPTITEGVAAALLLLKLSVADSQAEAKLSSFWQLIVDEKKQVFTSEKFLVMASEDALCTVLHLTERLFLDHPHRLTGNKVQQYHRALVAVLLSRTWHVRRQAQQTVRKLLSSLGGFKLAHGLLEELKTVLSSHKVLPLEALVTDAGEVTEAGKAYVPPRVLQEALCVISGVPGLKGDVTDTEQLAQEMLIISHHPSLVAVQSGLWPALLARMKIDPEAFITRHLDQIIPRMTTQSPLNQSSMNAMGSLSVLSPDRVLPQLISTITASVQNPALRLVTREEFAIMQTPAGELYDKSIIQSAQQDSIKKANMKRENKAYSFKEQIIELELKEEIKKKKGIKEEVQLTSKQKEMLQAQLDREAQVRRRLQELDGELEAALGLLDIILAKNPSGLTQYIPVLVDSFLPLLKSPLAAPRIKNPFLSLAACVMPSRLKALGTLVSHVTLRLLKPECVLDKSWCQEELSVAVKRAVMLLHTHTITSRVGKGEPGAAPLSAPAFSLVFPFLKMVLTEMPHHSEEEEEWMAQILQILTVQAQLRASPNTPPGRVDENGPELLPRVAMLRLLTWVIGTGSPRLQVLASDTLTTLCASSSGDDGCAFAEQEEVDVLLCALQSPCASVRETVLRGLMELHMVLPAPDTDEKNGLNLLRRLWVVKFDKEEEIRKLAERLWSMMGLDLQPDLCSLLIDDVIYHEAAVRQAGAEALSQAVARYQRQAAEVMGRLMEIYQEKLYRPPPVLDALGRVISESPPDQWEARCGLALALNKLSQYLDSSQVKPLFQFFVPDALNDRHPDVRKCMLDAALATLNTHGKENVNSLLPVFEEFLKNAPNDASYDAVRQSVVVLMGSLAKHLDKSDPKVKPIVAKLIAALSTPSQQVQESVASCLPPLVPAIKEDAGGMIQRLMQQLLESDKYAERKGAAYGLAGLVKGLGILSLKQQEMMAALTDAIQDKKNFRRREGALFAFEMLCTMLGKLFEPYVVHVLPHLLLCFGDGNQYVREAADDCAKAVMSNLSAHGVKLVLPSLLAALEEESWRTKAGSVELLGAMAYCAPKQLSSCLPNIVPKLTEVLTDSHVKVQKAGQQALRQIGSVIRNPEILAIAPVLLDALTDPSRKTQKCLQTLLDTKFVHFIDAPSLALIMPIVQRAFQDRSTDTRKMAAQIIGNMYSLTDQKDLAPYLPSVTPGLKASLLDPVPEVRTVSAKALGAMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDLWRIRFSSVQLLGDLLFHISGVTGKMTTETASEDDNFGTAQSNKAIITALGVERRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLYFSESLVPTARKALCDPLEEVREAAAKTFEQLHSTIGHQALEDILPFLLKQLDDEEVSEFALDGLKQVMAIKSRVVLPYLVPKLTTPPVNTRVLAFLSSVAGDALTRHLGVILPAVMLALKEKLGTPDEQLEMANCQAVILSVEDDTGHRIIIEYLLEATRSPEVGMRQAAAIILNIYCSRSKADYTSHLRSLVSGLIRLFNDSSPVVLEESWDALNAITKKLDAGNQLALIEELHKEIRLIGNESKGEHVPGFCLPKKGVTSILPVLREGVLTGSPEQKEEAAKALGLVIRLTSADALRPSVVSITGPLIRILGDRFSWNVKAALLETLSLLLAKVGIALKPFLPQLQTTFTKALQDSNRGVRLKAADALGKLISIHIKVDPLFTELLNGIRAMEDPGVRDTMLQALRFVIQGAGAKVDAVIRKNIVSLLLSMLGHDEDNTRISSAGCLGELCAFLTEEELSAVLQQCLLADVSGIDWMVRHGRSLALSVAVNVAPGRLCAGRYSSDVQEMILSSATADRIPIAVSGVRGMGFLMRHHIETGGGQLPAKLSSLFVKCLQNPSSDIRLVAEKMIWWANKDPLPPLDPQAIKPILKALLDNTKDKNTVVRAYSDQAIVNLLKMRQGEEVFQSLSKILDVASLEVLNEVNRRSLKKLASQADSTEQVDDTILT

SEQ ID NO: 19943 - protein, 179 aa, Homo sapiens
MLKTLPHSCVERTFLFFSPAPQRWELCPHKDGALKRTDNGGWAHEVCALYIPEVQFANDSTMEPIVLQSVPHDHCNKVETELKLICGDVLDALDKHLIPAATTGKSKVFYYEMKGVYHRYLAEFATGNDRKEVAENSLVAYKAASDIATGFSMLARLGSNSWFQVNLPTWLPKVLRLQA

SEQ ID NO: 19944 - protein, 252 aa, Homo sapiens
MYANKSTVNQVFLSERSSKIQCAWLLVFLAGSSVLLYYTFHSQSLYYSLIFLYPILDHLSFWEVLWIIGITDFILKFFFMSLKCLILLVPSFIMPFKSKGYWYMLLEELYQYYRTFVPILVWFHYLISYGEFGNVTRRSLRILLALLYLVLKLLEFFGHLRTFRQVLRIFFTQPSYGVAASKRQCSDVDGTCSICQAEFQKPILLICQHIFCEECITLWFNREKTCPLCRAVISDHINKWKDGATSSHLQNY

SEQ ID NO: 19945 - protein, 178 aa, Homo sapiens [sequence omitted]

SEQ ID NO: 19946 - protein, 274 aa, Rattus norvegicus
MAVRRALIVLAHAERTSFNYAMKEAAVEALKKKGWEVVESDLYAMNFNPLISRNDITGEPKDSENFQYPVESSLAYKEGRLSPDIVAEQKKLEAADLVIFQFPLYWFGVPAILKGWFERVLVAGFAYTYATMYDKGPFQNKKTLLSITTGGSGSMYSLQGVHGDMNVILWPIQSGILRFCGFQVLEPQLVYSIGHTPPDARVQVLEGWKKRLETVWEESPLYFAPSSLFDLNFQAGFLLKKEVQEEQKKNKFGLSVGHHLGKSIPADNQIKARK

SEQ ID NO: 19947 - protein, 668 aa, Homo sapiens
MTSTGKDGGAQHAQYVGPYRLEKTLGKGQTGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMSEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSDTTNCMEMMTGRLSKCGIIPKS

SEQ ID NO: 19948 - protein, 296 aa, Xenopus laevis
MGFVKVVKNKAYFKRYQVKFRRRREGKTDYYARKRLVIQDKNKYNTPKYRMIVRVTNRDIICQIAYARIEGDMIVCAAYAHELPKYGVKVGLTNYAAAYCTGLLLARRLLNKFGLDKVYEGQVEVTGDEYNVESVDGEPGAFTCYLDAGLTRTTTGNKVFGALKGAVDGGLSIPHSTKRFPGYDSESKEFNAEVHRKHIFGLNIAEYMRLLIEEDEDAYKKQFSQYIKNGVAADQLEDIYKKAHAGIRENPVHEKKPKKEVKKKRWNRAKLSLEQKKDRVAQKKASFLRAQQKADS

SEQ ID NO: 19949 - protein, 359 aa, Xenopus laevis
MTLDSMMACCLSEEVKESKRINAEIEKQLRRDKKDSRRELKLLLLGTGESGKSTFIKQMRIIHGSGYSEEDKRGFTKLVFQNIFTAMQSMIRAMETLKILYKFEQNKANAQIVREVDVEKVCTFEQPYVNAVKNLWSDPGIQECYDRRREYQLSDSTKYYLTDVDRISKPGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKIMYSHLVDYFPEFDGPQRDAATAREFILKMFVDLNPDSDKIIYSHFTCATDTENIRFVFAAVKDTILQHNLKEYNLV

SEQ ID NO: 19950 - protein, 313 aa, Homo sapiens
MTGKATPPSLYSWRGVLFTCLPAARTRKRKEMSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 19951 - protein, 353 aa, Aspergillus fumigatus
MGCGMSTEDKEGKARNEEIENQLKRDKMMQRNEIKMLLLGAGESGKSTILKQMKLIHEGGYSRDERESFKEIIYSNTVQSMRVILEAMESLELPLEDARNEYHVQTIFMQPAQIEGDSLPPEVGNAIGALWRDTGVQECFKRSREYQLNDSAKYYFDAIDRIAQPDYLPTDQDVLRSRVKTTGITETTFIIGDLTYRMFDVGGQRSERKKWIHCFENVTTILFLVAISEYDQLLFEDETVNRMQEALTLFDSICNSRWFVKTSIILFLNKIDRFKEKLPVSPMKNYFPDYEGGADYAAACDYILNRFVSLNQAEQKQIYTHFTCATDTTQIRFVMAAVNDIIIQENLRLCGLI

SEQ ID NO: 19952 - protein, 502 aa, Aspergillus fumigatus
MPTLGGLLKKRRTKDSHTLSKELESSSSPAAAQTQTSPNSADHDHHYQHYDQTHHHQHSASSNPSNNSATPSAAQPHRSSNDNPNRSSGTDQKSEGQTASMQFAVTQPHPSTHHNPRLHHLQQQQQQQQQQQQQQQQQQPQQQSHTSRLHNILHPSHHASSQASTEGHAHSQQANQTEARTTKGKYSLDDFTIQRTLGTGSFGRVHLVQSKHNHRFYAIKVLKKAQVVKMKQVEHTNDERRMLNRVRHPFLITLWGTWQDARNLYMVMDFVEGGELFSLLRKSQRFPNPVAKFYAAEVTLALEYLHSQQIIYRDLKPENLLLDRHGHLKITDFGFAKEVPDITWTLCGTPDYLAPEVVSSKGYNKSVDWWSLGILIFEMLCGFTPFWDSGSPVKIYENILRGRVKYPPYLHPDAVDLLSQLITADLTKRLGNLHGGSEDVKNHPWFAEVTWDRLARKDIDAPYVPPIRGGQGDASQYDRYPEETEQYGQQGEDVHGHLFPDF

SEQ ID NO: 19953 - protein, 236 aa, Arabidopsis thaliana
MASSRFQSGFCPISSCPSLENFIERIKDACRFTLSAVLGTILSAVLTFFFALVGTLLGALTGALIGQETESGFIRGAAVGAISGAVFSIEVFESSLVLWKSNESRFGCLLYLIDVIVSLISGRLVRERIGPAMLSAVQSQMGAVDSTFEELSSIFDTGGSKGLTGDLVDKIPKIKITGKNNLDAFGNKDSCSGCLQDFQLGETVRSLPHCHPMFHLPCIDNWLFRHGSCPMCRRDL

SEQ ID NO: 19954 - protein, 623 aa, Claviceps purpurea
MAALARLTAALAVSMSLAAAATINHDFNVTWVRANPDNAFERPVIGINGQWPIPTIECNVGDRIVINLNNQLGNQSTSLHFHGLYQNGTNQMDGPSGVTQCGVPPGSSITYNFTVDQPGTYWYHSHNDGQYPDGLRGPVVVHDPEFPYSKEIDQEVVLTLSDCYHDEIRDLIPQFLSKTNPTGVSLSNAALSMIAECTVSVQPGKTYHFRVINMGAFAGQYLWFEGHKMRIVEVDGVYTKQAEADMIYLSAAQRVSFLLTTKNDTNANFPFVASMDTSLFDQLPKDLNYNSTGWLSYDQTKTLPDPALVDELNPFDDMTLEAYDGMELLPEPDYNVELNVVMDNLGNGANYAFFNNITYKSPKVPTLYSVLSAGEQAENPAIYGEYTHPFVLKKDEIVQIVVNNLDSGRHPFHLHGHSFQAIYRSNESAGTWEAEGGPSGKTFPKVPMRRDTIVLYPPGNMVLRFKADNPGVWLFHCHIEWHVVSGLMATFIEAPTELQKKVSIPEDHLAVCRAGNVPTEGNAAGNTKDLLDLSGQNAPPDPLPEGFTTRGIVALVFSCITGLLGICVVAWYGMSQPTEEAPKAVAELIREVGENDSETRLGRENGVVGVGAETGAEGLRQRT

SEQ ID NO: 19955 - protein, 667 aa, Echinococcus multilocularis
MDSKIALLKDATTRLRINSIKATDAAKSGHPTSCSSIAEVMAVLFLDEMKYFVHQPRHPSNDRFVLSKGHAAPILYAAWAEVGHLSESELLNLRNIDSDLEGHPTPRLDFVDVATGSLGQGLSNAAGMAYTGKYIDKAKYRVYCIIGDGESAEGSIWEALAFSSYYKLDNLVAIFDVNRLGQSQPACLQHDLDCYRRRVEAFGCHAIVVDGHNIPELLTAFETARSIKGKPLALILKTYKGYDFPGISDQENWHGKPLGTSAAKTIEHLEKTLIVPSTLGKLKPQEPVVDCKEMHLIGTLKLTTPPPYKKGDKIATREAYGKALARLGSTYSRIIGLDGDTKNSTFSIYLRDARPEQFIECFIAEQNLVGVAIGCATRERTVPFVSTFAAFLSRAYDQIRMGAISQTDCNFAGSHVGVSIGEDGASQMGLEDLAMFRAIRGSTVFYPSDAVSCERAVELAANTKGICFIRTGRPAVPVIYDANEDFVIGKGKICLTALPSGEDHVTVVAAGVTLFEALKAAEVLKAEGINLRIIDPFTVKPIDAELIASSVKYTHGRLITVEDHGPEGGLSEAVAVALGERGVSFTQHVLAVQEVPHSGKPHELLAKYRINATAICEKHVLLCRRLSHFILLVSKSLIHTVIVFPLTLFLNASQWQFPGWNPPIGVE

SEQ ID NO: 19956 - protein, 146 aa, Hordeum vulgare subsp. vulgare
TSSAAASGWGHDSLKNFRQISPAVQSHLKLVYLTLCFALASSAVGAYLHIALNIGGMLTMLACVGTIAWMFSVPVYEERKRFGLLMGAALLEGASVGPLIELAIDFDPSILVTGFVGTAIAFGCFSGAAIIAKRREYLYLGGLLSS

SEQ ID NO: 19957 - protein, 511 aa, Oncorhynchus mykiss
MKQNSNVPAFLTKLWTLVEDSDTNEFICWSQEGNSFLVMDEQRFSKDILPKFFKHNNMASFVRQLNMYGFRKVMHIDTGIVKQERDGPVEFQHHYFKHGQDDLLENIKRKVSNARPNDTKIRQEDLSNILASVQNVHGKQESIDSRLNTLKRDNEGLWREISDLRQKHSQQQQIIKKLIQFIVTLVQKNRMSLKRKRPILLNSNGKKPKYIHEIYDDPPLDHNKPSVSGLKSADLTDDVVICDVTDDDTEITEGPSRALDQSDVEIVGVFNNNTVSQTDSADSIGQTNSLVIEPEETTISTYDSLPTSSTLQLNKQSGLSLEDPMKMMDSILNESGAISQNINLLGKVELMDYLDSIDCSLEDFQAMVYGKQFSIDPDILEATEGSGGPKENAGLLSKGDKSSFSADNQLVQYTSCPLLAFLDGCTPLATEADSSTATELGDSLLQHNTEVPTDLLEPDKEPPRSSLIRLEPLTEAEASESTLFYLCELNPEGDTTDSTQLEIYDLFPVQK

SEQ ID NO: 19958 - protein, 177 aa, Polytomella sp. Pringsheim 198.80
MSSRLYVGNLSWNAKEEDLRTYFGKFGEVEEASIALDRESGRSRGFGFVTLPADVAKDAIEKTNGAEFMGRNIKVNEASPPGERPPRTNNYGGGYGDFNGNGGGRDYGRGGYGRGNGGYGGRNAGYGGRGNFGGQGGYGDNRFGNDNFGGSYGGRGGYRGPRGPSAEENNSNNYGGY

SEQ ID NO: 19959 - protein, 377 aa, Physcomitrella patens
MSVADSVRERYEVSKAEVQSLREQLHEKRASLLDTDGGPFIPADFVVVISFVFMVCVRTLQGHTGKIYSLDWAYRETSRIVSASQDGRLIVWNAISSQKTYSLKLACAWVKAAAISPGGNTVACGGLDNVCSIFNLSSVPDKEGNLPVSGTLAGHTGYLSSCKYMPTQEKHIVTSSGDHTCRFWDVETQCCIAVFGGDILTGHTGDVMSVSVSSSSPHVFISGSCDKSAKLWDVRTPARAQRTFYGHEGDVNTVNFLSEGRHFGTGSDDGSCRLFDIGTGHELQQYWDKQALARGPVNVTSVAFSRSGRLLFAGYSNGNCYVWDTLLAKVVANLGGGRDDGHTNRVSCLGLAADGDALCTGSYDATLKVWSCAGKKS

SEQ ID NO: 19960 - protein, 321 aa, Parasitella parasitica
MVVDYLTLDRTEDKMPLRGFGCWKIEKKDAENTIYQAIKIGYRLFDGACDYGNEVEVGRGINKAIKEGLVKREELFIVTKLWNTFHSKQHVRTAFDRQLKDWGLEYFDLYLIHFPIPLQYVDPAVSYPPEWYVPHADKLNFERSPIHECWAEMEKLVQAKLTRNIGVANFNCQAILDLLSYAKIKPAVLQIEIHPLLPQERLVKWVQEQGIQVTAYSSFGPTSYVDLCESGKTYSSLLANADVKSIANKHNANTGQILLRYALDRNIAVIPKSVHEDRMKSNLDILNIQLDQDDRKILNSLKTNQRFNDPMIFGFGLPLFD

SEQ ID NO: 19961 - protein, 321 aa, Thlaspi caerulescens
MGCQDEQLVKTICDLYEKISKLESLKPSEDVNILFKQLVSTCIPPNPNINVTKMCDTVQEIRQKLIKICGEAEGHLEHHFSTILTSFQDNPLLHLNIFPYYNNYIKLGKLEFDLLTENLNGFVPKTIAFIGSGPLPLTSIVLASSHLKDTIFHNFDIDPSANSLASLLVSSDPDISQRMFFHTVDIMDVTESLKSFDVVFLAALVGMNKEEKVRVIEHLQKHMAPGAVLMLRSAHGPRAFLYPIVEPCDLQGFEVLSIYHPTDDVINSVVISKKLPVVSTENVGGVSCLLMPCHCSKIPAIMNKKKNMMIDEFGAREEHFS

SEQ ID NO: 19962 - protein, 179 aa, Nicotiana tabacum
MASIKSTTICFVTALFISLTISSVVAASGEEFKVGDAVGWRQPSVNETDLYHHWASKKKFHVGDSLRFEYKNDSVVVVDKWEFYHCNRTHPTSGAKDGNTTVNLDRAGPFYFVSGDPEHCKNGQRLAIEVLPLYPISQSPPQPISLAPSPSPLSSSALVSSVPLIFISVPLMVAVIVFV

SEQ ID NO: 19963 - protein, 573 aa, Nicotiana tabacum
MDPFIAAQADAGNTPNNTKKLAIGWMLPYLLVVSFAGLFSIVALRKMMIMKYKLTYPSGTATAYLINCSTLLKEQSWPRNKLVPYSNPLASALYLGLFNGYLHVKMAADLVACLHLVSKPMPKSSILIFPQHMLELVCFALMDPLMIFIKIIKLKVDTHLVISDNKGDLSVLCPYMVNVSLLIGAIVSWAIMWPMIEAKKGDWYSAQLSAASLHGIQGYRVFIAISMMLGDGLFHFAYMLVVTVLSFRNRKSGLADSSSEESFEDYDKKRQNEYFLKDQIPNWAAIGGYVGIAIISIIVVPIIFHSLKWYHILVAYLIAPILAFCNSYGSGLTDWSLASNYGKIAILTFSYWVGLQNGGVIAGLASCGLMMSILDTAAGLMGDFKTGYLTLTSPRSMFFSQVIGTAMGCVITPLVFWIFNSAYRLGDPEGAYPAPYASMYRGIALLGVEGFGSLPKHCLRLSVWFFVAAIVINLLTQLLKKFEPKYGIYRCVPSPMCMAIPFYLGGYFAIDMCVGSLILFIWQMVNKQQAKDFGPALASGLICGEPLWGIPAPVLALAGVKAPFCMKVRHGGA

SEQ ID NO: 19964 - protein, 329 aa, Nicotiana tabacum
MAANTQRKESDRIKGPWSPEEDELLQSLVEKHGPRNWSLISKSVPGRSGKSCRLRWCNQLSPQVEHRAFTSEEDETIIRAHAKFGNKWATIARLLSGRTDNAIKNHWNSTLKRKCCSMSEDLSFETPQQPLKRSSSVGPSTNFSSGMNPGSPSGSDLSDSSLSGFPQSLVYRPVPRTGGIFPLPPLVQPIETAPFIPDPPTSLCLSLPGSGTRETSIQTAQPTQLTQPPQSPPPPPLALPPVDKPVPPPTAVFMSQLPQTKQSYDFCVPALPKSGEKQFFTPEFLGVLQDMIRKEVRNYMSGVEHNGLCMQTDAIRNAVVKRIGISKIE

SEQ ID NO: 19965 - protein, 148 aa, Nicotiana tabacum
MEAATKTTKGAGGRKGGGPRKKSVTKSVKAGLQFPVGRIARFLKKGRYAQRVGSGAPIYLAAVLEYLAAEVLELAGNAARDNKKSRIIPRHVLLAVRNDEELGKLLSGVTIASGGVLPNINPVLLPKKSAAAEEKASTPKATKSPKKA

SEQ ID NO: 19966 - protein, 931 aa, Mus musculus
MVMADGPRHLQRGPVRVGFYDIEGTLGKGNFAVVKLGRHRTTKTEVAIKIIDKSQLDAVNLEKIYREVQIMKMLDHPHIIKLYQVMETKSMLYLVTEYAKNGEIFDYLANHGRLNESEARRKFWQILSAVDYCHGRKVVHRDLKAENLLLDNNMNIKIADFGFGNFFKTGELLATWCGSPPYAAPEVFEGQQYEGPQLDIWSMGVVLYVLVCGALPFDGPTLPILRQRVLEGRFRIPYFMSEDCEHLIRRMLVLDPSKRLSIAQIKEHKWMLIEVPVQRPILYPQEQENEPSIGEFNEQVLRLMHSLGIDQQKTVESLQNKSYNHFAAIYFLLVERLKSHRSSFPVEQRLDGRQRRPSTIAEQTVAKAQTVGLPVTLHPPNVRLMRSTLLPQASNVEAFSFPTSSCQAEAAFMEEECVDTPKVNGCLLDPVPPVLVRKGCQSLPSSMMETSIDEGLETEGEAEEDPSQAFEAFQATRSGQRRHTLSEVTNQLVVMPGAGKMFSMSDNPSLESVDSEYDMGSAQRDLNFLEDSPSLKDIMLANQPSPRMTSPFISLRPANPAMQALSSQKREAHNRSPVSFREGRRASDTSLTQGIVAFRQHLQNLARTKGILELNKVQLLYEQMGSNADPTLTSTAPQLQDLSSSCPQEEISQQQESVSSLSASMHPQLSPQQSLETQYLQHRLQKPNLLPKAQSPCPVYCKEPPRSLEQQLQEHRLQQKRLFLQKQSQLQAYFNQMQIAESSYPGPSQQLALPHQETPLTSQQPPSFSLTQALSPVLEPSSEQMQFSSFLSQYPEMQLQPLPSTPGPRAPPPLPSQLQQHQQPPPPPPPPPPQQPGAAPTSLQFSYQTCELPSTTSSVPNYPASCHYPVDGAQQSNLTGADCPRSSGLQDTASSYDPLALSELPGLFDCEMVEAVDPQHNGVVSCLARET

SEQ ID NO: 19967 - protein, 275 aa, Cavia porcellus
MAALRRALIILAHSEKTSFNYAMKEAAVEALQRKGWEVAVSDLYAMKFDPIISRKDITGALKDPENFQYPAESALAYKESRLSPDIVTEQKKVEEADLLIFQFPLQWFGVPAILKGWFERVFTGGFAYTYAAMYDKGPFQNKKAVLSITTGGSESMYSLKGIHGDMNIILWPIQSGTLHFCGFQVLEPQLTYGIGHTPPDVRTEILAGWKKRLENIWDETPLYFAPSSLFDLNFQAGFLLKKEIEDEQKNNKYGLSVGHHLGKPIPTDNQIKARK

SEQ ID NO: 19968 - protein, 88 aa, Pisum sativum
MDPSSQQMSRQSSMENMLVCSKEQQESKPKPQPEQALKCPRCDSTNTKFCYYNNYSLTQPRYFCKSCRRYWTKGGTLRNVPVGGGCRK

SEQ ID NO: 19969 - protein, 369 aa, Xenopus laevis
MAEATTCNMENFVAKLANGMSLRTPIEDVNSAPPEGGVKTNAEDMTSKDYYFDSYAHFGIHEEMLKDEVRTLTYRNSMFHNRHLFKDKVVLDVGSGTGILCMFAAKAGAKKVIGIECSSISDYAIKIVKANKLDHVVTIIKGKVEEVELPVEKVDIIISEWMGYCLFYESMLNTVIYARDKWLTPDGLIFPDRATLYITAIEDRQYKDYKIHWWENVYGFDMSCIKDVAIKEPLVDVVDPKQLVSNACLIKEVDIYTVKVDDLSFTSPFCLQVKRNDYIHALVAYFNIEFTRCHKRTGFSTSPESPYTHWKQTVFYMEDYLTVKTGEEIFGTIGMKPNAKNNRDLDFTFDIDFKGQLCELSCSTDYRMR

SEQ ID NO: 19970 - protein, 253 aa, Physcomitrella patens
MVVPSLPAFGGQNAMLRRNIDNNTDTLISLLQGSCSPRVSMQQGYVAVPRSSESLENMMGACGQKLPYFSSFDGPSVEEQEDVDEGIDEFAHHVEKKRRLSLEQVRSLERNFEVENKLEPERKMQLAKELGLQPRQVAVWFQNRRARWKTKQLERDYETLKKAYDRLKADFEAVTLDTSALKAEVSRLKGISNDDVKPAEFVQGKCDTTSHPASPAQSERSDIVSSRNRTTPTIHVDPVAPEEAGAHLTIELG

SEQ ID NO: 19971 - protein, 355 aa, Mus musculus
MGCRQSSEEKEAARRSRRIDRHLRSESQRQRREIKLLLLGTSNSGKSTIVKQMKIIHSGGFNLDACKEYKPLIIYNAIDSLTRIIRALAALKIDFHNPDRAYDAVQLFALTGPAESKGEITPELLGVMRRLWADPGAQACFGRSSEYHLEDNAAYYLNDLERIAAPDYIPTVEDILRSRDMTTGIVENKFTFKELTFKMVDVGGQRSERKKWIHCFEGVTAIIFCVELSGYDLKLYEDNQTSRMAESLRLFDSICNNNWFINTSLILFLNKKDLLAEKIRRIPLSVCFPEYKGQNTYEEAAVYIQRQFEDLNRNKETKEIYSHFTCATDTSNIQFVFDAVTDVIIQNNLKYIGLC

SEQ ID NO: 19972 - protein, 665 aa, Sorghum bicolor
MDTIKQQCSKVSSSSSSSSLEMEIPADLIIRIGDSIFPLHKAVMVPKCSYIRRAITALAAAASSKAADDGDATATVVELDLSALPGGADAFEKAARYCYGANFEITPANAAALRCAAAFLDMRHPSADLARRVDEFLARSALRTLPGAVAVLRSCEAPDDDLLRAAADELGVARRAADAVALAVCREALFPTTTTSGSSRLPGWWKVELAALSPRSFARVVTALRCRRADPAVVAAAAGSYAELVLAEVLAAPRDCADQRALLESVVDVLPSSADAPGIPASFLCRLLHAAVATEASAKACRDLELRVAAVLDQATAEDLLSVALDAAGERVRNTDTVRRVVTAFVERHAAAAAAAPESERRRSRRASMSGTTAATELGAGTRPGALEKVAKMVDEVAAEIATEEALPISKFVGVAGAVPKDARPSHDCLYRAVDIYLKTHPALDEIQREKVCSVMDPLKLSYQARLHASQNKRLPLQAVLSALYYDQLKLRSAADAATSMGDVVADTQTQSSSAAGRARAQAMADAALARENEALRVELARMRAYMSGTMQHGKGRESSTPASPSRTAKKATFLGTELARMRAYMSGMHHSKGSGATPPASPSRTAAAKTKASLLGSVSRSLSRLNPFKGGWTTNHTGSIAAGGRPCKTMHHVVTPKRRRSSIG

SEQ ID NO: 19973 - protein, 308 aa, Sorghum bicolor
MEINIVDKYEKLEKVGEGTYGKVYKAQDKATGQLVALKKTRLEMDEEGIPPTALREISLLNLLSHSIYVVRLLAVEQAAKNGKPVLYLVFEFLDTDLKKYLDVYRRGPAARPLPATLIKNFLYQLCKGVAHCHGHGVLHRDLKPQNLLVDKDKGILKIADLGLGRAFTVPMKSYTHEIVTLWYRAPEVLLGATHYSTGVDMWSVGCIFAEMARRQALFPGDSELQQLLHIFRLLGTPSEEQWPGVSELRDWHEFPQWKPQSLARVVPTLEPEGVDLLSKMLQLDPSNRISAIAAMEHPYFDSLDKSQF

SEQ ID NO: 19974 - protein, 523 aa, Medicago truncatula
MLVELAVTLLVIALFIHLRPTPTAKSKALRHLPNPPSPKPRLPFIGHLHLLDNPLLHHTLIKLGKRYGPLYTLYFGSMPTVVASTPDLFKLFLQTHEATSFNTRFQTSAISRLTYDNSVAMVPFAPYWKFIRKLIMNDLLNATTVNKLRPLRSREILKVLKVMANSAETQQPLDVTEELLKWTNSTISTMMLGEAEEVRDIARDVLKIFGEYSVTNFIWPLNKFKFGNYDKRTEEIFNKYDPIIEKVIKKRQEIVNKRKNGEIVEGEQNVVFLDTLLEFAQDETMEIKITKEQIKGLVVDFFSAGTDSTAVATEWTLAELINNPRVWKKAQEEIDSVVGKDRLVDESDVQNLPYIRAMVKEVFRLHPPLPVVKRKCTEECEINGYVIPEGALILFNVWQVGRDPKYWEKPLEFRPERFLENASQGEGEAASIDLRGQHFTLLPFGSGRRMCPGVNLATAGMATLLSSIIQCFDLQVPGPHGQILKGDDVKVSMDERPGLTVPRAHNLMCVPLARAGVAAKLLS

SEQ ID NO: 19975 - protein, 119 aa, Metrosideros excelsa
NKINRQVTFSKRRCGLLKKAHEISVLCDAEVALIVFSTKGKLFEYATDACMEKILERYERYSYAERQILTNNAETNGNWTLEHAKLKARMEILQKNQKNLMGEELDSLSLKELQNLEHQ

SEQ ID NO: 19976 - protein, 403 aa, Triticum aestivum
MDAGGAQPPDSEMAEAGAGAAAAAGTAPGGAMDNIQATLTHGGRFIQYNIFGNVFEVTAKYKPPILPIGKGAYGIVCSALNSETGEQVAIKKIANAFDNKIDAKRTLREIKLLRHMDHENIVAIRDIIPPAQRTAFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIFMELMDRKPLFPGRDHVHQLRLLMEVFPCGISSLQLIGTPNEADLDFVNENARRYIRQLPRHARQSLSEKFPHVHPSAIDLVEKMLTFDPRQRITVEGALAHPYLASLHDISDEPVCTMPFSFDFEQHALSEEQMKDLIHQEGITFNPDYQ

SEQ ID NO: 19977 - protein, 58 aa, Metrosideros excelsa
LVMTDPDVPGPSDPYLREHLHWMVTDIPGTTDATFGKEVVEYEMPRPNIGIHRFESLV

SEQ ID NO: 19978 - protein, 58 aa, Metrosideros collina
LVMTDPDVPGPSDPYLREHLHWMVTDIPGTTDATFGKKVVEYEMPRPNIGIHRFESLV

SEQ ID NO: 19979 - protein, 250 aa, Homo sapiens
MGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQILIRFQIQRNVIVIPGSITPSHIKENIQVFDFELTQHDMDNILSLNRNLRLAMFPM

SEQ ID NO: 19980 - protein, 263 aa, Homo sapiens
MGDIPAVGLSSWKASPGKVTEAVKEAIDAGYRHFDCAYFYHNEREVGAGIRCKIKEGAVRREDLFIATKLWCTCHKKSLVETACRKSLKALKLNYLDLYLIHWPMGFKPPHPEWIMSCSELSFCLSHPRVQDLPLDESNMVIPSDTDFLDTWEAMEDLVITGLVKNIGVSNFNHEQLERLLNKPGLRFKPLTNQILIRFQIQRNVIVIPGSITPSHIKENIQVFDFELTQHDMDNILSLNRNLRLAMFPITKNHKDYPFHIEY

SEQ ID NO: 19981 - protein, 453 aa, Orchis italica
MVLATSQQHHQHNPHEVQQPLQPHSTAAESSRELEEVFEGYGVRYSTIARIGDLGFTASTLAGMREEEVDDMMATLSHLFRWDLLVGERYGIKAAIRAERRRVEALIFSHVSGAPQLNHQHQMGYLFSSAATGHHLMPDDPRRGLLLLSPDHHSALDALSQEGLSEEPVQLEREAAGSGGEVVGRRDGRGKNPQRQTSGKKKDASCTKSKKKKKKGIEEGDDDEEEFEVWGRGGSIENDEDDDGEESQSEQSSAAERQREHPFIVTEPGEVARAKKNGLDYLFNLYEQCHEFLLQVQSVAKERGDKCPTKVTNLVFRYAKKKVGASYINKPKMRHYVHCYALHVLDEDASNSLRRVFKERGENVGAWRLACYKPLVAISASHSFDIDAVFNAHPRLSIWYVPTKLRQLCHLARSSTSQLPQSSPPTTTTLSTHFPKAFKTQLQQSPSVRPCSN

SEQ ID NO: 19982 - protein, 455 aa, Aceras anthropophorum
MVLATSQHHHQLNPHEVQQPLQPHSTATESSRELEEVFEGYGVRYSTIARIGDLGFTASTLAGMREEEVDDMMATLSHLFRWDLLVGERYGIKAAIRAERRRLEALIFSHVSGAPHLNHQHQMGYLFSSAATGHHLMPDDPRRRLLLLCPDHHNALDALSQEGLSEEPVQLEREAAGSGGEVLGRRDGMAKNPQRQTSGKKKDASFTKSMKWKKKGIDEGDDDEEEVEVWGRGGSIENDEDDDGEESQSEQSSAAERQREHPFIVTEPAEVARAKKNGLDYLFNLYEQCHEFLLQVQSVAKERANKCPTKVTNLVFRYAKKKVGASYINKPKMRHYVHCYALHVLDEDASNSLRRVFKERGENVGAWRLACYKPLVAISTSRSFDIDAVFNAHPRLSIWYVPTRLRQLCHLARSSTSQLPPSAPRTTGSSNQRVSSTVQGVQDSAAADSSRPPMF

SEQ ID NO: 19983 - protein, 455 aa, Orchis mascula
MVLATSQQHHQHNPHEVQQPLHPHSTATESSRELEEVFEGYGVRYSTIARIGDLGFTASTLAGMREEEVDDMMATLSHLFRWDLLVGERYGIKAAIRAERRRLEALIFSHVSGASHLHHQHQMGYLISSAATGHHIMPDDPRRRLLLLSPDHQNALDALSQEGLSEEPVQLEREAAGSGGEVVGRRDGKGKTPQRQTTGKKKDASCTKSKKKKKKGIEEGDDDEEEVEVWGRGASIENDEDNDGDESQSEQSSAAERQREHPFIVTEPGEVARAKKNGLDYLFNLYEQCHEFLLQVQSVAKERGDKCPTKVTNLVFRYAKKKVGASYINKPKMRHYVHCYALHVLDEDASNSLRRVFKERRENVGAWRLACYKPLVAISSSHSFDIDAVFNAHPRLSIWYVPTKLRQLCHLARSSISHLPPAAPRTAGSSNQRVSSTVHGFQDSAAADSLRPPMF

SEQ ID NO: 19984 - protein, 452 aa, Barlia robertiana
MVLATSQQHHQLNAHEVQQHPQPHSTAAESSRELEEVFEGYGVRYSTIARIGDLGFTASTLAGMREEEVDDMMATLAHLFRWDLLVGERYGIKAAIRAERRRLEALIFSHVSGAPHLNHHQHQMGNLFSSAATSHHLMPDDPRRRLLLLSPEHPNALDALSQEGLSEEPVQLEREATGSGGEVVGRRDGKGKNQQRQTSGKKKDASFTKSKKKKKGIERDDDEEEVEAWGRGASIENDEDDDGEESQSEHSSAAERQREHPFIVTEPGEVARAKKNGLDYLFNLYEQCHEFLLQVQSVAKERGDKCPTKVTNLVFRYAKKKVGASYINKPKMRHYVHCYALHVLDEDASNSLRRVFKERGENAGAWRLACYKPLVAISTSHSFDIDAVFNAHPRLSIWYVSTKLRQLCHLARSSSCQLLQYSQAVTTTLSTHFPKAFKTQLQQSPPVRPCSN

SEQ ID NO: 19985 - protein, 456 aa, Ophrys tentrediniphera
MVLATSQQHHQHNPHEVQQHLQPHSTATESSRELEEVFEGYGVRYSTIARIGDLGFTASTLAGMREEEVDDMMAALSHLFRWDLLVGERYGIKAAIRAERRRLEALIFSHVSGAARLSHHQHQMGYLFSSATTGYHLMPDDPRKRHLLLSPDHHSALDALSQEGLSEEPVQLEREAAGSGGEVVGRRDGKGKNQQRQTSAKKKDASSTKSKKKKKKGIEEGDDEEEEVEVWGRGASIENDEDDDGDESQSEQSSAAERQREHPFIVTEPGEVARAKKNGLDYLFNLYEQCHEFLNQVQSVAKERGDKCPTKVTNLVFRYAKKKVGASYINKPKMRHYVHCYALHVLDEDASNSLRRAFKERGENVGAWRLACYKPLVAISASHSFDIDAVFNAHPRLSIWYVPTKLRQLCHLARSSTSQFPLAVPRTTGSSNQRVSSTVHVVEDSAAAHSFRPPMF

SEQ ID NO: 19986 - protein, 454 aa, Orchis lactea
MVLATSQQHQQHNPHEVQQHLQPHSTAAESSRELEEVFEGYGVRYSTIARIGDLGFTASTLAGMREEEVDDMMATLSHLFRWDLLVGERYGIKAAIRAERRRLEALIFSHVSGAPHLNHQHQMGYLFSSAATGHHLMPDDPRRRLLLLSPDHHNALDALSQEGLSEEPVQLEREAAGSGGEVVGRRDGKGKTQQRQNSGKKKESSSTKSKKKKKKGMEEGDHYDEEEMEVWGRGASIENDEEEDGEESQSEQSSAAERQREHPFIVTEPGEVARAKKNGLDYLFNLYEQCHEFLLQVQAVAKERGDKCPTKVTNLVFRYAKKKVGASYINKPKMRHYVHCYALHVLDEDASNSLRRVFKERGENAGAWRLACYKPLVAISTSHSFDIDAVFNAHPRLSIWYVPTKLRQLCHLARSSTSQLPQSSPPTTTTLSTHFPKAFKTQLQQSPSVRPCSN

SEQ ID NO: 19987 - protein, 455 aa, Neotinea maculata
MVLATSQQHHQHNPHEVQQHLQPHSTAAESSRELEEVFEGYGVRYSTIARIGDLGFTASTLAGMREEEVDDMMATLSHLFRWDLLVGERYGIKAAIRAERRRLEALIFSHVSGAPHLNHQHQMGYLFSSAATGHHLMPDDPRRRLLLLSPDHHNALDALSQEGLSEEPVQLEREAAGSGGEVVGRRDGKGKTQQRQISGKKKESCSTKSKKKKKKKGMEDGDHDDEEEMEVWGRGASIENDEEEDGEESQSEQSSAAERQREHPFIVTEPGEVARAKKNGLDYLFNLYEQCHEFLLQVQAVAKERGDKCPTKVTNLVFRYAKKKVGASYINKPKMRHYVHCYALHVLDEDASNSLRRGFKERGENVGAWRLACYKPLVSISAAHSFDIDAVFNAHPRLSIWYVPTKLRQLCHLARSSTSQLPQSSPPTTTTLSTHFPKAVKTQLQQSPSDRPCSN

SEQ ID NO: 19988 - protein, 452 aa, Orchis quadripunctata
MVLATSQQHQQHNPPEVQPHLQPHSTTAESSRELEEVFEGYGVRYSTIARIGDLGFTASTLAGMREEEVDDMMATLSHLFRWDLLVGERYGIKAAIRAERRRLEALIFSGAPHLHHQHQMGYLFSSAASGHHLLPDDPRRRLLLLSPDHHNALDALSQEGLSEEPVQLEREAAGSGGEVVGRRDGRGKNQQRQTSGKKKDASSTKSKKKKKKGIEEGDDDEEEVEVWGRGASIESDEDDDGEESQSEQSSAAERQREHPFIVTEPGEVARAKKNGLDYLFNLYEQCHEFLLQVQSVAKERGDKCPTKVTNLVFRYAKKKVGASYINKPKMRHYVHCYALHVLDEDASNSLRRVFKERGENVGAWRLACYKPLVAISASHSFDIDAVFNAHPRLSIWYVPTKLRQLCHLARSSGSHLPPAAPRTAGSSNQRVSSTAHGGQDSAAADSLRPPMF

SEQ ID NO: 19989 - protein, 456 aa, Anacamptis pyramidalis
MVLATSQQHHSLNPHEVQQHLQPHSTAAESSRELEEVFEGYGVRYSTIARIGDLGFTASTLAGMREEEVDDMMSTLSHLFRWDLLVGERYGIKAAIRAERRRLDALIFSHVSGTPHLNHHQHQMGYLFSSAATGHHLMPDDPRRRLLLLCPDHHNALDALSQEGLSEEPVQLEREAAGSGGEVVGRRDGKGKNQQRQTSGKKKDASSTKSKKKKKKGIEEGDDNEEEVEVWGRRASIESDEDDDGEESQSEQSSAAERQREHPFIVTEPGEVVRAKKNGLDYLFNLYDQCHEFLLQVQSVAKERGDKCPTKVTNLVFRYAKKKVGASYINKPKMRHYVHCYALHVLDEDVSNSLRRAFKERGENVGAWRLACYQPLVAISATHSFDIDAVFNAHPRLSIWYVPTRLRQLCHLARSSTSQLPPSAPRTTGSSNQRVSSTVHGVQDSAAADSSRPPMF

SEQ ID NO: 19990 - protein, 456 aa, Orchis laxiflora
MVLATSQQHQQHNPHEVQQHLQPHSTATESSRELEEVFEGYGVRYSTIARIGDLGFTASTLAGMREEEVDDMMATLSHLFRWDLLVGERYGIKAAIRAERRRLEALIFSHVSGAPHLNHRQHQMGYLFSSAATGHHLMPDDPRRRLLLLSPDHHNALDALSQEGLSEEPVQLEREAAGSGGEVVGRRDGKGKNQQRQNSGKKKDASSTKSKKKKKKGIEEGDDNEEEVEVWGRGASIESDEDDDGEESQSEQSSAAERQREHPFIVTEPGEVARAKKNGLDYLFNLYEQCHEFLLQVQSVAKERGDKCPTKVTNLVFRYAKKKVGASYINKPKMRHYVHCYALHVLAEDASNSLRRAFKERGENVGAWRLACYQPLVAISATHSFDIDAVFNAHPRLSIWYVPTRLRQLCHLARSSTSQLPPTAPRITGSSNQRVSSTVHGVQDSAAAHSSRPPMF

SEQ ID NO: 19991 - protein, 456 aa, Orchis morio
MVLATSQQHQQHNPHEVQQHPQPHSTATESSRELEEVFEGYGVRYSTIARIGDLVFTACTLAGMREEEVDDMMATLSHLFRWDLLVGERYGIKAAIRAERRRLDALIFSHVSGAPHLNHHQHQMGYLFSSASTGHHLMPDDPRRRLLLLSPDHHNALDALSQEGLSEEPVQLEREAAGSGGEVVGRRDGKGKNQQRQTSGKKKDASSTKSKKKKKKGIEEGDDNEEEVEVWGRGASIESDEDDDGEESQSEQSSAAERQREHPFIVTEPGEVARAKKNGLDYLFNLYEQCHEFLLQVQSVAKERGDKCPTKVTNLVFRYAKKKVGASYINKPKMRHYVHCYALHVLAEDASNSLRRAFKERGENVGAWRLACYQPLVAISATQSFDIDAVFNAHPRLSIWYVPTRLRQLCHLARSSTSQLPPTAPRITGSSNQRVSSTVHGVQDSAAAHSLRPPMF

SEQ ID NO: 19992 - protein, 455 aa, Serapias lingua
MVLATSQQHQQHNPHEVQQPLQPHSTAAESSRELEEVFEGYGVRYSTIARIGDLGFTASTLAGMREEEVDDMMATLSHLFRWDLLAGERYGIKSAIRAERRRLEALIFSHVSGVSHLNHHQHQMGYLFSPATATAQHLMPDDPRRRLPLFSPDPHNALDALSQEGLSEEPVQLEREAAGSGGEVVGRRDRKGKNQQRQTLGKKKDGSSNKKKKKKGIEEGDDDEEEVEMWGRGASIENDEDDDGEESQSEQSSAVERQREHPFIVTEPGEVARAKKNGLDYLFNLYEQCHEFLVQVQSVAKERGDKCPTKVTNLVFRYAKKKVGASYINKPKMRHYVHCYALHVLDEDASNSLRRAFKERGENVGAWRLACYKPLVAISASHGFDIDAVFNAHPRLSIWYVPTKLRQLCHLARSSTSQFPPAAPRTAGSSNSCVSSTVHGVQDSAAAVSSRPPMF

SEQ ID NO: 19993 - protein, 458 aa, Dactylorhiza romana
MVLATSQQHHQLNAHEVQQHPQPHSTAAESSRELEEVFEGYGVRYSTIARIGDLGFTASTLAGMREEEVDDMMATVAHLFRWDLLVGERYGIKAAIRAERRRIEAIIFSHVSGAPQHLNHHQQQMGFLYSSAAAAGHHLISDDPRRRPLLLSPDHHNALDALSQEGLSEEPVQLAREAAGSGGEVVGRRDGKGKNQQRQTSGKKKDASSTKSKKKKKKGIEEGDDDEEEVEVWGRGASIESDEDDDGEESQSEQSSAAERQREHPFIVTEPGEVARAKKNGLDYLFNLYEQCHEFLLQVQSVAKERGDKCPTKVTNLVFRYAKKKVGASYINKPKMRHYVHCYALHVLDEDSSNSLRRAFKERGENVGAWRLACYKPLVAISAAHGFDIDAVFNAHPRLSIWYVPTRLRQLCHLDRSSTSQLPPTAPRITGSSNQRVSSTVHGVQDSAAADSSRPPMF

SEQ ID NO: 19994 - protein, 453 aa, Gennaria diphylla
MVLATSQQHQQHNPHEVQPHLQPHSTAAESSRELEEVFEGYGVRYSTIARIGDLGFTASTLAGMREEEVDDMMATLSHLFRWDLLVGERYGIKAAIRAERRRLEALIFSHVSGAPHLNHQHQMGYLFSSAATGHHLMPDDPRRRLLLLSPDHHSALDALSQEGLSEEPVQLEREAAGSGGEVVGRRDGKGKNQQRQTSGKKKDASSTKSKKKKKKGIEEGDDDEEEVEVWGRGASIESDEDDDGEESQSEQSSAAERQREHPFIVTEPGEVARAKKNGLDYLFNLYEQCHEFLLQVQSVAKERGDKCPTKVTNLVFRYAKKKVGASYINKPKMRHYVHCYALHVLEEEASNSLRRAFKERGENVGAWRLACYKPLVAISASHGFDMDAVFNAHPRLSIWYVPTKLRQLCHLARSSTSQLPQSSPPTTTTLSTHFPKAFKTQLQQSPPVRPCSN

SEQ ID NO: 19995 - protein, 313 aa, Rhizobium sp. TAL1145
MTDIREWTSTVGLENELGEVLSGLANACATIARTLRTAPLAQLSGSAGSLNVQGEAQKPLDIISNEVFVNACRELAQISLAVSEEEEDPIPISATGSYAVVFDPLDGSSNLDVNVTVGSIFSVVSATTPKHILPGGRPQHIAGFASYGPSTDLTVLAKGRVARFTLDASDTWRLVELDMRLPDRFPEIAINAARADSWDDVIRGFVNDAFHGNEIRYNARWVASLVAETQRILSRGGLFLYPADSSGRGRLRLLYEARPIAAIVEAAGGRCSTGFMPILEVNAETLHDRVPLIFGGASQVEALEAAYRADKEN

SEQ ID NO: 19996 - protein, 298 aa, Danio rerio
MSETAISFAKDFLAGGIAAAISKTAVAPIERVKLLLQVQHASKQITADKQYKGIMDCVVRIPKEQGFLSFWRGNLANVIRYFPTQALNFAFKDKYKKVFLDGVDKRTQFWRYFAGNLASGGAAGATSLCFVYPLDFARTRLAADVGKAGAEREFSGLGNCLVKISKSDGIKGLYQGFNVSVQGIIIYRAAYFGIYDTAKGMLPDPKNTHIVVSWMIAQSVTAVAGLASYPFDTVRRRMMMQSGRKGADIMYSGTIDCWRKIARDEGGKAFFKGAWSNVLRGMGGAFVLVLYDELKKVI

SEQ ID NO: 19997 - protein, 155 aa, Danio rerio
MSIKLNALFSDFYVDVSQYRDQHFKGNRYEQEKLLKQSATLYVGNLSFYTTEEQVHVLFAKCGDVKRIIIGLDKIKKTACGFCFVEYYTRADAENAMRFVNGTRLDDRIIRTDWDAGFKEGRQYGRGKSGGQVRDEYRQDYDPARGGYGKMVQKS

SEQ ID NO: 19998 - protein, 442 aa, Danio rerio
MAAGTLYTFPENWRAFKAQIAAQYSGARLKIASAPPAFTFGQTNRSPAFLGNFPLGKVPAYQGDDGFCLFESNAIAHYLSNDVLRGSTPQASAQVLQWVSFADSEVIPPASAWVFPTLGIMQFNKQATEQAKEEVKRVLAVLNQHLNTRTFLVGERISLADITVVCSLLWLYKQVLELAFRQPYPNVTRWFVTCVNQPQFKTVLGEVKLCEKMAQFDAKKFAEMQPKKEAPIKKEKGGKEGGKQQPQQQEKKEKKKEEKKAAPAEEEMDECEAALAFEPKAKDPFAHLPKSSFVMDEFKRKYSNEDTMTVALPYFWDHFDREGFSIWYAEYRFPEELTMAFMSCNLITGMFQRLDKLRKNAFASVILFGANNDSCISGIWVFRGQDLAFPLSDDWQIDYESYTWRKLDVDSEECKTMVKEYFAWEGEFKHVGKPFNQGKIFK

SEQ ID NO: 19999 - protein, 547 aa, Rattus norvegicus
MCAAEVDRHVSQRYLIKRRLGKGAYGIVWKAMDRRTGEVVAIKKIFDAFRDQTDAQRTFREIMLLREFGGHPNIIRLLDVIPAKNDRDIYLVFESMDTDLNAVIQKGRLLEDIHKRCIFYQLLRATKFIHSGRVIHRDQKPANVLLDAACRVKLCDFGLARSLSDFPEGPGGQALTEYVATRWYRAPEVLLSSRWYTPGVDMWSLGCILGEMLRGQPLFPGTSTFHQLELILETIPLPSMEELQGLGSDYSALILQNLGSRPRQTLDALLPPDTPPEALDLLKRLLAFAPDKRLSAEQALQHPYVQRFHCPDREWTRGSDVRLPVHEGDQLSAPEYRNRLYQMILERRRNSRSPREEDLGVVASRAELRASQRQSLKPGVLPQVLAETPARKRGPKPQNGHGHDPEHVEVRRQSSDPLYQLPPPGSGERPPGATGEPPSAPSGVKTHVRAVAPSLTSQAAAQAANQPLIRSDPARGGGPRAVGARRVPSRLPREAPEPRPGRRMFGISVSQGAQGAARAALGGYSQAYGTVCRSALGRLPLLPGPRA

SEQ ID NO: 20000 - protein, 336 aa, Pseudomonas sp. S-47
MTHKVALNFEDGVTRFIDANAGETVADAAYRQGINLPLDCRDGACGACKCFAESGRYSLGEEYIEDALSEAEAEQGYVLTCQMRAESDCVIRVPAASDVCKTQQASYQAAISNVRQLSESTIALSIKSASLNQLAFLPGQYVNLQVPGSDQTRAYSFSSLQKDGEVGFLIRNVPGGLMSSFLTSLAKVGDSVSLAGPLGAFYLREIKRPLLLLAGGTGLAPFTAMLEKIAEQGSEHPLHLIYGVTHDHDLVEMDKLEAFAARIPNFSYTACVASPDSAYPQKGYVTQYIEPKHLNGGEVDVYLCGPPPMVEAVSQYIRAQGIQPANFYYEKFAASA

SEQ ID NO: 20001 - protein, 486 aa, Pseudomonas sp. S-47
MKEIKHFISGAFVGSASGKLFDNVSPANGQVIGRVHEAGRAEVDAAVRAARAALKGPWGKMTVAERAEILHRVADGITARFGEFLEARMPGHRQAEVAGQPHRHSARRANFKVFADLLKNVANEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDMDKAIEGTLRSAFANCGQVCLGTERVYVERPIFDAFVARLKAGAEALKIGEPNDPEANFGPLISHKPREKVPSYYQQAVDDGATVVTGGGVPEMPAHLAGGAWVQPTIWTGLADDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 20002 - protein, 769 aa, Actinidia deliciosa
GALNHIIQMSKVLGEQIGSGHPVWPVAIHGHYADAGDAAALLSGALNVPMLFTGHSLGRDKLEQLLRQSRLSKDEINKTYKIMRRIEAEELSLDASEIVITSTRQEIEQQWRLYDGFDPVIERKLRARIRRNVSCYGRFMPRMVVMPPGMEFHHIVPHEGDMDGETEGNEDQPTSPDPPIWPEIVRFFTNPRKPMILALARPDPKKNLATLVEAFGECRPLRELANLTLIMGNRGDVDEMSSTNSSVLLSILKLIDKYDLYGQVAYPKHHKQSDVPDIYRLAAKTKGVFINPAVIEPFGLTLIEAAAYGLPIVATKNGGPVDIHRALDNGLLVDPHDQKSIADALLKLVADKQLWSKCRQNGLKNIYLFSWPEHCKTYLSRIAACKLRQPWWQRSDDGDENSESDSPSDSLRDISLNLKFSLDGEKNEGSGNADSSLEFEDRKIKLENAVLTWSKGFQKGTQKAGVTEKADTNITAGKFPVLRRRKNIIVIAVDFGAISDYSDSIRKIFDAVEKERTEGSIGFILATSFTLSEVHSFLISGGLSPSDFDAFICNSGSDLYYSSLNSEDNPFVVDLYYHSHIEYRWGGEGLRKTLIRWTGSINDKKGENEEQIVTEDEKISTNYCYAFKVRNAGKVPPVKEIRKLMRIQAHRCHVIYCQNGNKINVIPVLASRSQALRYLYLRWGVDLSKMVVFVGESGDTDYEGLLGGIHKSVILKGVCSGPTNQLHANRTYPLSDVLPIDSPNIVQAAEECSSADLRTSLLKLGFIKG

SEQ ID NO: 20003 - protein, 577 aa, Actinidia deliciosa
MAGNDWINSYLEAILDVGPGIDDAKSSLLLRERGRFSPTRYFVEQVIGFDETDLYRSWVKAAATRSPQERNTRLENMCWRIWNLARQKKQLEGEEAQRMAKRRLERERGRREATADMSEDLSEGEKGDTVSDLSAHGESNRGRLPRISSVETMEAWVSQQKGKRLYIVLISLHGLIRGENMELGRDSDTGGQVKYVVELARALGSMPGVYRVDLLTRQVSSPEVDWSYGEPTEMLPPRNSDVLMDEMGESSGAYIIRIPFGPRDKYVPKELLWPHVPEFVDGSLNHIIQMSKVLGEQIGSGHPVWPVAIHGHYADAGDAAALLSGALNVPMLFTGHSLGRDKLEQLLRQSRLSKDEINKTYKIMRRIEAEELSLDASEIVITSTRQEIEQQWRLYDGFDPVLERKLRARIRRNVSCYGRFMPRMVVIPPGMEFHHIVPHEGDMDGETEGNEDQPTSPDPPIWPEIMRFFTNPRKPMILALARPDPKKNLTTLVEAFGECRPLRELANLTLIMGNRDDVDEMSSTNSSVLLSILKLIDKYDLYGQVAYPKHHKQSDVPDIYRLAAKTKGVFINPAFIE

SEQ ID NO: 20004 - protein, 257 aa, Leuconostoc pseudomesenteroides
MTKKVAMVTGGAQGIGEAIVRRLSADGFAVAVADLNEAKSKEVATDIEKNGGTAIAVKLDVSDREGFFAAVKEVAEKLGGFDVLVNNAGLGPTTPIDTITPELFDKVYHINVAGDIWGIQAAVEQFKKNGNGGKIINATSQAGVVGNPNLSLYSSTKFAVRGLTQVAARDLAEQNITVNAYAPGIVKTPMMFDIAHEVGKNAGKDDEWGMQTFAKDIALKRLSEPEDVAAAVAFLAGPDSNYITGQTIEVDGGMQFH

SEQ ID NO: 20005 - protein, 103 aa, Arxula adeninivorans
MSGRGKGGKGLGKGGAKRHRKILRDNIQGITKPAIRRLARRGGVKRISALIYEETRSVLKTFLESVIRDAVTYTEHAKRKTVTSLDVVYALKRQGRTLYGFGG

SEQ ID NO: 20006 - protein, 260 aa, Mycobacterium tuberculosis
MSGRLTGKVALVSGGARGMGASHVRAMVAEGAKVVFGDILDEEGKAMAAELADAARYVHLDVTQPAQWKAAVDTAVTAFGGLHVLVNNAGILNIGTIEDYALTEWQRILDVNLTGVFLGIRAVVKPMKEAGRGSIINISSIEGLAGTVACHGYTATKFAVRGLTKSTALELGPSGIRVNSIHPGLVKTPMTDWVPEDIFQTALGRAAEPVEVSNLVVYLASDESSYSTGAEFVVDGGTVAGLAHNDFGAVEVSSQPEWVT

SEQ ID NO: 20007 - protein, 260 aa, Mycobacterium tuberculosis
  unsure (1)..(260): unsure at all Xaa locations
MSGRLTGKVALVSGGARGXGASHVRAXVAEGAKVVFGDILDEEGKAXAAELADAARYVHLDVTQPAQWKAAVDTAVTAFGGLHVLVNNAGILNIGTIEDYALTEWQRILDVNLTGVFLGIRAVVKPXKEAGRGSIINISSIEGLAGTVACHGYTATKFAVRGLTKSTALELGPSGIRVNSIHPGLVKTPXTDWVPEDIFQTALGRAAEPVEVSNLVVYLASDESSYSTGAEFVVDGGTVAGLAHNDFGAVEVSSQPEWVT

SEQ ID NO: 20008 - protein, 783 aa, Homo sapiens
MVIMSEFSADPAGQGQGQQKPLRVGFYDIERTLGKGNFAVVKLARHRVTKTQVAIKIIDKTRLDSSNLEKIYREVQLMKLLNHPHIIKLYQVMETKDMLYIVTEFAKNGEMFDYLTSNGHLSENEARKKFWQILSAVEYCHDHHIVHRDLKTENLLLDGNMDIKLADFGFGNFYKSGEPLSTWCGSPPYAAPEVFEGKEYEGPQLDIWSLGVVLYVLVCGSLPFDGPNLPTLRQRVLEGRFRIPFFMSQDCESLIRRMLVVDPARRITIAQIRQHRWMRAEPCLPGPACPAFSAHSYTSNLGDYDEQALGIMQTLGVDRQRTVESLQNSSYNHFAAIYYLLLERLKEYRNAQCARPGPARQPRPRSSDLSGLEVPQEGLSTDPFRPALLCPQPQTLVQSVLQAEMDCELQSSLQWPLFFPVDASCSGVFRPRPVSPSSLLDTAISEEARQGPGLEEEQDTQESLPSSTGRRHTLAEVSTRLSPLTAPCIVVSPSTTASPAEGTSSDSCLTFSASKSPAGLSGTPATQGLLGACSPVRLASPFLGSQSATPVLQAQGGLGGAVLLPVSFQEGRRASDTSLTQGLKAFRQQLRKTTRTKGFLGLNKIKGLARQVCQVPASRASRGGLSPFHAPAQSPGLHGGAAGSREGWSLLEEVLEQQRLLQLQHHPAAAPGCSQAPQPAPAPFVIAPCDGPGAAPLPSTLLTSGLPLLPPPLLQTGASPVASAAQLLDTHLHIGTGPTALPAVPPPRLARLAPGCEPLGLLQGDCEMEDLMPCSLGTFVLVQ

SEQ ID NO: 20009 - protein, 340 aa, Oryzias latipes
MSELDQLRQEAEQLKNQIRDARKACADATLSQITANIDPVGRIQMRTRRTLRGHLAKIYAMHWGTDSRLLVSASQDGKLIIWDSYTTNKVHAIPLRSSWVMTCAYAPSGNYVACGGLDNICSIYNLKTREGNVRVSRELAGHTGYLSCCRFLDDNQIVTSSGDTSCALWDIETGQQTTTFAGHTGDVMSLSLAPDTRLFVSGACDASAKLWDIREGMCRQTFTGHESDINAICFFPNGNAFATGSDDATCRLFDLRADQELMIYSHDNIICGITSVAFSKSGRLLLAGYDDFNCNVWDTLKADRAGVLAGHDNRVSCLGVTDDGMAVATGSWDSFLKIWN

SEQ ID NO: 20010 - protein, 122 aa, Actinidia deliciosa
GGQVKYVVELARALGSMPGVYRVDLLTRQVSSPEVDWSYGEPTEMLPPRNSDGLMDEMGESSGAYIIRIPFGPRDKYVPKELLWPHIPEFVDGALSHIIQMSKVLGEQIGSGHPVWPVAIHG

SEQ ID NO: 20011 - protein, 622 aa, Campylobacter jejuni
MNAKTQEAELEELFQENAKDYITYEKLVKYLTKQPSASTAKKVQALMKKHKVQLFSAAEIGQMKNIEDAKRLQEEKQKLQDTSLENEFDLANENDLLEWSRSDSPVRMYLREMGQIALLNKDEEIEISKKIELGEDIIIDAFCSVPYLIDFILDYKEPLINRERRVKELFKSFDDEEKSDDKLDELDIDEDEENETELESDEENTKKNSKKEDERTLKVIEKFKALEKAKKDWLKTSKDKESGDELLDKLSIAFKKNILKEKLMDLGPTSKLISEIVKSMETALKSDEEFDKELKRLEYRLPMFSDELKKRHADILKDITKLSKEEITERALETTMVSTYMEIKKLFQTKEASEKSFDLEKSRLKEILEQIKRGKKISDEAKGRMAKSNLRLVVSIAKRYTNRGLPFLDLIQEGNIGLMKAVDKFEYKRGYKFSTYATWWIRQAISRAIADQARTIRIPIHMIETINQINKIIREHLQKDGKEPDVSVIAKEVGLSVDKVKQVIKITKEPISLEAPIGNEDDGKFGDFVEDRNSLSPMDHILKDDLKEQIDEVLDQLNDREKAVIRMRFGLMDDESDRTLEEIGKELNVTRERVRQIESSAIKKLKHPKVGRKLKNYIEGWK

SEQ ID NO: 20012 - protein, 507 aa, Solenostemon scutellarioides
MTSLLAHPLLPPPRRRPLPPLLPPPVSHPAGPRPGRWWRNLYDVKPVRFRCFAEWAQLFGPTFSVWFGSTLNVIVSSSELAKEVLKEKDGQLADPPRSRSAVKLSRDGKDLIWADYGPHYVKVRKVCTVVLFSPKRLELLRPIREDEITVMVESIYQDSAASGKSVVIKKYLASMAFHNITRLVFGKRFVNSEGEVDKQGQEFKAIAINGLKLGASLAVSEHIPWLRWMFPLDEDAFTQHGVRMERLTREIMQEHTLARQKTGGAKQHFFDALLTLKDEYDLSEDTIIALLWDMIAAGMDTPAISVEWAMAELVRNPRVQEKVQEELDRVIGHERIMTELDIPNLPYLQCVVKESLRLHPPTPVMLPHRSNADVKIGGYDIPKGSNVHVNVWAIARDPKSWKVPLEFRPERFLEEDVDIKGHDFRLLRFGAGRRVCPGAQLGIDLATSMIGHLLHHFRWTPPTGVRAEDIDMGENPGTVTYMRTPVEAVPTPRLPANLYKRVAVVDI

SEQ ID NO: 20013 - protein, 744 aa, Calothrix viguieri
MTETSPKPIVTTAAFPANEVERLEALRRYNILDTPPEVAFDRITSLAARLFNVPITLVSLVDESRGWFKSSYGFEMREVRRDTTICSFALLSDEVLVIPDTREDSRLVCNPFVQNEPGLRFYAGAPLLTQDGFNLGTLCLLDTKPRDGLSDEQKSVLSDLAAMVMDELELRLAARKVAQMDTALLEVTQGVSTATGEAFFSALVQHMLKVLGVDYVYIGLVDPDNQEIIRTIAACAKGQIIGNFEYLLHDTPCEQVLQKRKLCCYPHRVQALFPKAPLLEPLGVESYVAVPFFDTTGIPLGLLGVMDGNALTNIQLAESLLTIFALRIATELERQQTEAARQQAQYELERLVEQRTTELSKANELLKVLLDNVQAGIVACDAEGILTLFNQAARQFHGLPEQALPPEEWAKHYDLYLPDGKTRMSKNEIPLFRALQEQTVKNVEMVIAPKHGKVKTLLASGQAIVDNEGKKQGAVVVMHDITERKIAEAERIQLIRQQVQEQSARLKAEEANRLKDEFLAVLSHELRTPLNPILGWTKLLRAGKLDSAKTDYALETIERNAKLQTQLIGDLLDVSRILQGKLSLNMAAVNLAPTISAAIETVQLAAQAKSIQIETVFDPNVGQVLGDSTRLQQVVWNLLSNAVKFTKNGGRVEIRLECVDSQAEIKVSDTGKGISPDFLPHVFESFRQADATITRKFGGLGLGLAIVRHLVELHGGTIYAESPGEDLGATFTVRLPLIAVVKTC

SEQ ID NO: 20014 - protein, 126 aa, Crocus sativus
VSNCYWNWGCAGLKPTVAAIEAGKDIALANKETLIAGGPFVLPLAHKHKVKILPADSEHSAIFQCIQGLPEGALRRIILTASGGAFRDWPVEKLKEVKVADALKHPNWNMGKKITVDSATLFNKGS

SEQ ID NO: 20015 - protein, 369 aa, Crocus sativus
MQVDPTKGIGLANTSLQFSNGRLHALCEYDLPYVVRLSPEDGDISTVGRIENNVSTKSTTAHPKTDPVTGETFSFSYGPIQPYVTYSRYDCDGKKSGPDVPIFSFKEPSFVHDFAITEHYAVFPDIQIVMKPAEIVRGRRMIGPDLEKVPRLGLLPRYATSDSEMRWFDVPGFNMVHVVNAWEEEGGEVVVIVAPNVSPIENAIDRFDLLHVSVEMARIELKSGSVSRTLLSAENLDFGVIHRGYSGRKSRYAYLGVGDPMPKIRGVVKVDFELAGRGECVVARREFGVGCFGGEPFFVPASSKKSGGEEDDGYVVSYLHDEGKGESSFVVMDARSPELEILAEVVLPRRVPYGFHGLFVTEAELLSQQ

SEQ ID NO: 20016 - protein, 245 aa, Zea diploperennis
SIRNNPVPNKLMNGEDPINNNHAQTASGLGVRLATSSSSRDPSPSHEDMDGEVEILGFKMPTHERMRKRKESNRESARRSRYRKAAHLKELEDQVAQLKAENSCLLRRIAALNHKYNDANVDNRVLRADMETLRVKVKMGEDSLKRVIEMSSSSVPSSMPISAPTPSSDVPVPVPPHIRDSIVGYFSAPAADDDASVGNGFLRLQAQEPASMIVGGTTLSATEMNRVAAATHCAGAMELIQTAMG

SEQ ID NO: 20017 - protein, 242 aa, Zea diploperennis
SIRNNPVQNKLMNGEDPINNNHAQTAGLGVRLATSSSSRDPSPSDEDMDGEVEILGFKMPTEERVRKRKESNRESARRSRYRKAAHLKELEDQVAQLKAENSCLLRRIAALNQKYNDANVDNRVLRADMETLRAKVKMGEDSLKGVIEMSSSVLLSMPISAPTPSSDAPVPPPPPIRDSIVGYFSAPAAEDDASVGNGFLRLQAQEPASMVVGGTLSATEMNRVAAATHCAGAMELIQTAMG

SEQ ID NO: 20018 - protein, 353 aa, Pseudomonas putida
MYPRNTWYVACTPDEIADKPLGRQICGEKIVFYRGHENRVAAVEDFCRTRAPLSLGYVENGNLVCGYHGLVMGCDGKTVEMPGQRVRGFPCNKTFAVVERYGFIWVWPGDQAQADPSLIPHLEWAVNDDWAYGGGLFHIGCDYRLMIDNLMDLTHETYVHASSIGQKEIDEAPPYHRHRREVLSARHMENIMAPPFWRMALRGNGLADDVPVERWQICRFTPPSHVLIEVGVAHAGKGGYHAEQHKASSIVVWNFITPETDTSIWYFWVLACNFAAQDQALTANIREGQGKIFSEDLEMLERQQQNLLAYPQRNLLKLNIDAGGVQSRKILERLIANERMPQAELIATSASPA

SEQ ID NO: 20019 - protein, 478 aa, Arthrobacter sp. BP2
MVPAAGLDYYVIHHRGEPPMGVYTTIDPATGDATAQYPEISDAELDTLIKNSAAAYRSWRTTTLEQRRAVLTRTAEIHREQAEELAKLLTLEMGKPIAQARGEVELVASIYQHYADNLEEYLADESLTFRGSGTAVVRTEPIGPLVGVMPWNYPYYQVARFAAPNIALGNTIILKHARNCPQSALAIERVLTEAGLPAGVYANAFISSAQVAAAVADRRVQGVSLTGSEKAGAAVGEVAGRNLKKCVLELGGSDPFIVLDDADIDAAAAAAVIGRLSNGGQACTASKRFIVADSVYEEFLQKFLDAMASWQTGDPTDSGTKLGPLASAAGVEELDELVQDAVSHGAKLLLGGERPDGPGAYYPATVLAGVTPAMRAFTEELFGPVAVVYRVGSLQEAIDLANNSPFGLSSSVFTSDARNAERLAEELEVGMVWINSTSKSSPDLPFGGVKGSGFGRELAGYGFNEFANKKLVRNPGAR

SEQ ID NO: 20020 - protein, 459 aa, Rhodococcus sp. Phi2
MGVYTTTDPATGEEVAQYPEISDAQLDELIGRSAAAYRSWRTTPLEQRRAVLSRAAEIHREQADELAALLTLEMGKPITQAKGEVALVASIYQYYADHAEEFMADEPLDIAGSGTAVVRTEAIGPLVGVMPWNYPYYQVARFAAPNIALGNTIILKHARNCPQSALAIERVLTEAGLPDGVYLNAFISSAQVAAAIADPRVQGVSLTGSEKAGSAVGEVAGRHMKKCVLELGGSDPFIVLGDADVDAAAAAAVVGRLGNGGQACTASKRFLVEEPVYDEFVRKFLDGMISWQPSDPTSPETKLGPLSSRSAVDELDELVQDAVSRGAQVLTGGDPRDEKGAYYPPTVLVGVTPDMRAYYEELFGPVAVVHRVGSLDEAIEAANDSPFGLSSSVFTSDPQKADRVAEELETGMVWINSTSKSSPDLPFGGVKRSGVGRELARFGFDEFANKKLVRKPGKK

SEQ ID NO: 20021 - protein, 267 aa, Helianthus annuus
MENSEAIEHEHDFSCIDRSMSFQNEDSGDISPQRRIGKGKIEIKRIENTTNRQVTFCKRRNGLLKKAYELSVLCDAEVALIVFSSRGRLYEYANNSVRGTIDRYKKSCLDPPSTGSVAEANAQFYQQEATKLRQQIANLQNQNRQFYRNIMGESLADMPGKELKNLESKLEKAINRIRAKKNELLFAEIEYMQKRELELHNSNQFLRARISENERAQQQHMSLMPGSSGYNDLGPHQSFDGLNDLQTNELQLNNNYSCQDQTPLQLV

SEQ ID NO: 20022 - protein, 247 aa, Helianthus annuus
MSFPNESGEMSPQRKLGRGKIEIKRIENTTNRQVTFCKRRNGLLKKAYELSVLCDAEVALIVFSSRGRLYEYANNSVKGTIDRYKKACLDPPSSGSVAEANAQFYQQEAAKLRQQIANLQNQNRQFYRNIMGESLGNMPAKDLKNLEGKLEKGISRIRSKKNELLFAEIEYMPKRENELHNNNQFLRAKIAENERSQQQHMSLMPGSSDYDLVPPHQPFDGRNYLQVNDLQPNNSYSCQDQTPLQLV

SEQ ID NO: 20023 - protein, 196 aa, Helianthus annuus
MGRGKIEIQRIDNTIHRLVTYSKRKNGIIRKAKEITVLCDANVSLVVYGSSGKMYEYCSPNTNLTDMLDRYPRLSGNKLWDAKHENLQIEIDRIKKENESMQIELRHLKGEDITSLNYEELIAFEDALENGLTHIREKKDEIPQIMRKHEQVLEEENKHLMYMVQQSEMAAMGDYQADGPFSFRVQPMQPNLHERM

SEQ ID NO: 20024 - protein, 210 aa, Helianthus annuus
MGRGRIEIQKIENNTNRQVTYSKRRNGIFKKAHELTVLCDAKVSLIMFSNTGKFHEYISPSTTTKKIYDMYQTTLGFDLWSSHYERMQETLKKLKDSNNKLRREIRQRVLGEDLDGLDMNDLTILEQHMQDSLTVVRERKVKNLEQRNCNLRLDYDTIHQLEKKYGMVENEVGYESTIAYSNLYGFCENPNNNIIHGSGSGYEPHGLRLD

SEQ ID NO: 20025 - protein, 251 aa, Helianthus annuus
MGRGKVQLRRIENKINRQVTFSKRRGGLLKKAHEISVLCDAEVALIVFSNKGKLFEFSTDSCMESILERYERYCYSERQLVATDATPRSWTLEYNKLKSRAELLQRNHRHYMGEDIESLSLKEIQNLEQQLDTGLKNIRARKNQLLHESINELQKKGKAIQEQNTTLTKQLKEKEKDKTIPQNTQWEQHNYVDHDTTFFLPQPHPALNIGGDYNQATTSAASGGEGADGRTSQLDLSLQPIYSHHLRCFPS

SEQ ID NO: 20026 - protein, 253 aa, Helianthus annuus
MGKGRLELKRIENKINRQVTFAKRRNGLLKKAYELSVLCDAEVALIIFSTRGKLYEFSSTSSMLKTLERYEKCSFGPPEQRKPAKEDLQEQSSYQEYMRLKERYDALKQLERNYYGEEIDSLTTNELESLERQLHCSLKQIRTIRTQSLIDKLYEQQKMEHQLYEYNKTLRLRLDEESQAEALQWDVHAHAHANGMVYGHHHQHQVSHPAHGAFYHPTGCETTLQIGYQTEQISGATSSSMSHHHHQMQGWPA

SEQ ID NO: 20027 - protein, 262 aa, Rattus norvegicus
MYELLKLHLLNSHGRNSPSAADECAYTITQSQKPVKEGTKDRAVERPSENKISKSALDYCHSKGIMHRDVKPHNVMIDHQQKKLRLIDWGLAEFYHPAQEYNVRVASRYFKGPELLVDYQMYDYSLDMWSLGCMLASMIFRKEPFFHGQDNYDQLVRIAKVLGTDDLYGYLKKYHIDLDPHFNDILGQHSRKRWENFIHSENRHLVSPEALDLLDKLLRYDHQQRLTAKEAMEHPYFYPVVKEQSQPCAENTVLSSGLTAAR

SEQ ID NO: 20028 - protein, 189 aa, Rattus norvegicus
MPMINLQSSDGEVFEVNVEIAKQSVTIKTMLEDLGMDDDEGDDDPVPLPNVNAAILKKRSFSGAPMTRMTLPLPLLRMRKTEKWTDYIPVWDQEFLKVDQGTLFELILAANYLETKGLLGITCKTVANKIKRKTPEEIHRTFNIKNDFTVEVEAQANEPLEWLNQIEMGVLGLHRVLPTCSTARWDGYL

SEQ ID NO: 20029 - protein, 677 aa, Rattus norvegicus
MGEAHCVQPRVKGHTHSRGEQVCKAAVPSWMVALTFVILVMSPWCSPGVTDILGKRQEEPNAELEAFSLIPPSSKEQRQFLTYPFRTCAMGKKGKKEKKGRGAEKTAAKMEKKVSKRSRKEEVSGTRRGGRRTPSDCERETGNEVVPRVPGWLNASLSAHPEKDELILFGGEYFNGQKTFMYNELYIYSIRKGTWTKVDIPGPPPRRCAHQAVVVPQGGGQLWIFGGEFASPDGEQFYHYKDLWVLHLATKTWEQIRSTGGPSGRSGHRMVAWKRQLILFGGFHESTRDYIYYSDVYTFSLDTFLWSKLSPSGPGPTPRSGCLMAVTPQGSIAIYGGYSKQRVKKDVDKGTQHSDMFLLKPEDGGEDKWTWTRVNPSGVKPTVRSGFSVAVAPNHQILVFGGVCDEEEEEHLEGSFFNDLYIYDAAKSRWFAAQLKGPKSEKKRRRRGKADDPEGATEEETGGTSAPEPLEVIKEVVSEDGTVITIKQVLTPSGLGVQPPPKADDSASEASSTGQEPCPRSSAMLAVKHGLLYVYGGMFEAGDRQVTLSDLYCLDLHKMEEWKTLVEMDPKSQEWLEESDSEEDSSSDEEGAEGGDEDQEEDSSEDSAEEGADPQHPEVAHGEQYEEYLSRTEQHWLKLARNHVGPDAKEKKVLRVAQAMAKACFDDAVPDIAQAKH

SEQ ID NO: 20030 - protein, 271 aa, Rattus norvegicus
MPREDRVTCKSNYFLKIIQLLDDYPKCFIMGADNVSSKQMQQIRMSLQGKAVAIREHLEKNRALEKLPPHTRGNVGFMFTKEDLTEIRDMLLTNKVPAATQAGALAPCEVTAHAQNTGLGPEKTSFFQVLGINTKISRGIIEILSDVQLIKTGNKVGAGEATLLNISPSVSGLIIRQVFDNGSIYNPEVLDITEQILRSHFLEGVRNVAAVCLQIGPDVADVFQAALQCSNFHGQTKPGSSPGLQGFQDWKLSAFLGYTSFRPIVISRRYE

SEQ ID NO: 20031 - protein, 264 aa, Rattus norvegicus
MFLQDFRPFLSSNPLDQDNRANERGHQTHTDFWGPSRPPRLPMTRRYRSRGSTRPDRSPAIEGIIQQIFAGFFANSAIPGSPHPFSWSGMLHSNPGDYAWGQTGLDAIVTQLLGQLENTGPPPADKEKITSLPTVTVTQEQVKSIPDLIKEQFLSDSNSTALQVFFSDPTLLKGGPQVEERGYTGLECPVCKEDYTVEEKVRQLPCNHFFHSSCIVPWLELHDTCPVCRKSLNGEDSTRQTQSSEASASNRFSNDSQLHDRWTF

SEQ ID NO: 20032 - protein, 1178 aa, Rattus norvegicus
MEVDTLDISSIRDTRTGRYARLPKDPKIREVLGFGGPDTRLEEKLMTVVAGPDPVNTTFLNFMAVQDDTVKVWSEELFKLAMNILAQNASRNTFLRKAYTKLKLQVNQDGRIPVKNILKMFSADKKRVETALESCGLNFNRSESIRPDEFSLEIFERFLNKLCLRPDIDKILLEIGAKGKPYLTLEQLMDFINQKQRDPRLNEVLYPPLRSSQARLLIEKYEPNKQFLERDQMSMEGFSRYLGGEENGILPLEALDLSMDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGEALLIDPLDKYPLSAGTPLPSPQDLMGRILVKNKKRHRPSTGVPDSSVRKRPLEQSNSALSESSAATEPSSPQLGSPSSDSCPGLSNGEEVGLEKTSLEPQKSLGEEGLNRGPNVLMPDRDREDEEEDEEEEETTDPKKPTTDEGTASSEVNATEEMSTLVNYVEPVKFKSFEAARKRNKCFEMSSFVETKAMEQLTKSPMEFVEYNKQQLSRIYPKGTRVDSSNYMPQLFWNVGCQLVALNFQTLDLPMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGRFVGHRILPVSAIRSGYHYVCLRNEANQPLCLPALLIYTEASDYIPDDHQDYAEALINPIKHVSLMDQRAKQLAALIGESEAQASTEMCQETPSQQQGSQLSSNPAPNPLDASPRWPPGPTTSPTSTSLSSPGQRDDLIASILSEVTPTPLEELRSHKAMVKLRSRQDRDLRELHKKHQRKAVALTRRLLDGLAQARAEGKCRPSSSALSRATNVEDVKEEEKEAARQYREFQNRQVQSLLELREAQADAETERRLEHLKQAQQRLREVVLDAHTTQFKRLKELNEREKKELQKILDRKRNNSISEAKTREKHKKEVELTEINRRHITESVNSIRRLEEAQKQRHERLLAGQQQVLQQLVEEEPKLVAQLTQECQEQRERLPQEIRRCLLGETSEGLGDGPLVACASNGHAAGSGGHQSGADSESQEENTQL

SEQ ID NO: 20033 - protein, 465 aa, Rattus norvegicus
MLQKTVLLLALVAQVLMLENGLLRTPPMGWLAWERFRCNINCEEDPKNCISERLFMEMADRLAQDGWRDLGYVYLNIDDCWIGGRDATGRLIPDPKRFPHGIAFLADYAHSLGLKLGIYEDMGKMTCMGYPGTTLDKVELDAATFAEWKVDMLKLDGCYSTPKERAEGYPKMAAALNATGRPIAFSCSWPAYEGGLPPKVNYTEVAGTCNLWRNYKDIQDSWKSVLSILDWFVKHQDILQPVSGPGHWNDPDMLLIGNFGLSFDESRAQMALWTVLAAPLFMSTDLRTISPQNIDILQNPLLIKINQDPLGIQGRLIFKSKSHIEVFKRNLSDDASALVFFSRRTDMPYHFHCSLLELNYPKGSVYEGQNVFTGDIISGLHPETNFTVIINPSGVVMWYLYPVKGLGIYTMMSQLREETVREWEALDHLLPVLTPEPRVVIQLRVEDTGFAQQLWFFTIPSAVAE

SEQ ID NO: 20034 - protein, 204 aa, Rattus norvegicus
MSGVSSSDGVVIQEPQQCWHSVRIPTALRGLNRALSHPGHTSGLLWSLTAGTRGPDPADSDFSVASQTLGRDPMGRCVTTFADCLQIAEVATGDDKKRIIDSARSAYQEAMDISKKEMLPTNPIRLGLALNFSVFHYEIANSPEEAISLAKTTFDEAVADLHTLSEDSYKDSALIMQLLRDNLTLWTADNAGEEGGEAPEEPQS

SEQ ID NO: 20035 - protein, 128 aa, Rattus norvegicus
MAGGKAGKDNGKAKAKAVSRSQRAGLQFPVGRIHRHLKTRATSRGRVGATAAVYSAAILEYLTAEVLELAGNASKDLKVKRITPSHLQLAIRGDEELDSLINATIAGGGVIPHIHKSLIGKKGQQKTA

SEQ ID NO: 20036 - protein, 736 aa, Rattus norvegicus
MGDWDSLRSSLSLRGRPLAEAPSSVSQRDLRHRTPVLVNRRAVLQHLNLSNMNIRKLAMGIVWLNHGCAVLLEAGRKGPNGLLDFPKEFPLSCLIFKHFTKESNTGRRQSETKATQEPTRLPQELHRRLLQELQTGECSKSCRQESAPRAADRRVLQELHRRVLQELQTGECSKSCTGECPKSCRQESAPRAAQESAPRAADRRVLQELQTGECPKSCRPESAPRAAQESAPRAAQESAPRAADRRVLQEPALKHRRGGREGLLSLGPSDRIASGTLNVHGTFRQHGVLRSMWLLAAHQVLRKMQRRHSSNTDNIPPERSRSQALSPEASVDEGGVFESLKAEPASPPTLFSGLAGGLPASPFPAGLVLGSTAGGGDVFIPMPATRDEAGGRSTEGSTYHHRQAHHHFHHGAHRGGSLLQHVGGDHRGHSEEGVDEQPGTPAPALSELKAVICWLQKGLPFILILLAKLCFQHKLGIAVCIGMASTFAYANSALREQVSLKEKRSVLVILWILAFLAGNTLYVLYTFSSQQLYSSLIFLKPNLETLDFFDLLWIVGIADFVLKYITIALKCLIVALPKIILAVKSKGKFYLVIEELSQLFRSLVPIQLWYKYIMGDDSSDSYFLGGVLIILYSLCKSFDICGRVGGLRKALKLLCTSQNYGVRATGQQCTEAGAVCAICQAEFRDPMILLCQHVFCEECLCLWLDRERTCPLCRSVAVDTLRCWKDGATSAHLQVY

SEQ ID NO: 20037 - protein, 204 aa, Rattus norvegicus
MDYVGSKQMQQICMPLRGKAVVLMGKNAMMCKAFRGHLENNPVLEDLLPHILENVGVVFTKEDLMRLETCCWPIRCQLLLELVPFAPCEIGYPTVASVPHSIINGYKWVLALTVDTEYTSPLAEKVKAFLDNPSVSVAATTTAAPASSAPAKADVKEELDESDEGNYPKVPVEPMLRDLELPVVVNIKNNHKPSLAGINEPYGL

SEQ ID NO: 20038 - protein, 301 aa, Rattus norvegicus
MPGLMHMREMYSASKPLKGARIDGCLHMTVETVLIEALVTLDAEVQWSSCTFPAAAIAKAGIPVFAWKGETDEELLKVPTINVNDSFTKSMFDNLYGGRESLIDSIKQLTDMIVGKVAVVAGYGDVIKSCAQVLRGFGARVIITEINPTASCHGGLYEVTTMHEACCVDIILGRHFKQMKDDAIVCSPGHFDVEIDVKWLNKNSVEKNGCHITLLTEGHLVNLGCAMGHPSFGMSNSFTNQVMVQIELWTHTYKYPIMVHFLPKKLDEAVAEAHLGKLTEKQAQYLGMSVNGPFKPDHYLY

SEQ ID NO: 20039 - protein, 2857 aa, Rattus norvegicus
MAADTQVSETLKRFAVKVTTASVKERREILSELGRCIAGKDLPEGAVKGLCKLFCLTLHRYRDAASRRALQAAIQQLAEAQPEATAKNLLHSLQSSGVGSKACVPSKSSGSAALLALTWTCLLVRIVFPLKAKRQGDIWNKLVEVQCLLLLEVLGGSHKHAVDGAVKKLTKLWKENPGLVEQYFSAILSLEPNQNYAGMLGLLVQFCTNHKEMDVVNQHKAGVQHGDCGFDALGGLSTLLEFYVKHILMSKAKPPKYLLDNCAPLLRFMSHSEFKDLILPTIQKSLLRSPENVIETISSLLASVTLDLSQYALDIVKGLANQLKSNSPRLMDEAVLALRNLSRQCSDSSATEALTKHLFAILGGSEGKLTIIAQKMSVLSVHEGTLVHAVSVLALWCNRFTTEVPKKLTDWFKKVFSLKTSTSAVRHAYLQCMLASFRGDTLLQALDFLPLLMQTVEKAASQSTQVPTVTEGVAAALLVSKLSVADSQAEAKLSNFWQLVVDEKKQIFTSEKFLLLASEEALCTVLHLTERLFLDHAHRLTNSRVQYYYRVLVAVLLSRTWHVRRQAQQTVRKLLSSLGGIKLANGLLEELKTVLNSHKVLPLETLVTDAGEVMETGKTYVPPRVLQEALCVISGVPGLKGDITSTEQLAQEMLIISHHPSLVAVQSGLWPALLTRMKIDPEAFITRHLDQIIPRITTQSPLNQSSMNAMGSLSILSPDRVLPQLISSITASVQNPALCLVTREEFAVMQTPAGELFDKSIIQSAQQDSIKKANMKRENKAYSFKEQIIELELKEEIKKKKGIKEEVQLTSKQKEMLQAQMDKEAQIRRRLQELDGELEAALGLLDAIMTRNPRGLTQYIPVLVDAFLPLLKSPLAAPRVKGPFLSLAACVMPPRLKTLGTLVSHVTLRLLKPECALDQSWCQEELPVAVRRAVSLLHTHTIPSRVGKGEPDAAPLSAPAFSLIFPMLKMVLTEMPYHSEEEEEQMAQILQILTVHAQLRASPDTPPERVDENGPELLPRVAMLRLLTWVIGTGSPRLQVLASDTLTALCASSSGEDGCAFAEQEEVDVLLAALQSPCASVRETALRGLMELHLVLPAPDTDEKNGLNLLRRLWVVKFDKEEEIRKLAERLWTTMGLDLQSDLCSLLIDDVIYHEAAVRQAGAEALSQAVARYQRQAAEVMGRLMEIYQEKLYVSDWGRRPPPVLDALGRVISESPPDQWEARCGLALALNKLSQYLDSSQVKPLFQFFVPDALNDRNPDVRKCMLDAALATLNAHGKENVNSLLPVFEEFLKDAPNDASYDAVRQSVVVLMGSLAKHLDKSDPKVKPIVAKLIAALSTPSQQVQESVASCLPPLVPAVKEDAGGMIQRLMQQLLESDKYAERKGAAYGLAGLVKGLGILSLKQQEMMAALTDAIQDKKNFRRREGALFAFEMLCTMLGKLFEPYVVHVLPHLLLCFGDGNQYVREAADDCAKAVMSNLSAHGVKLVLPSLLAALEEESWRTKAGSVELLGAMAYCAPKQLSSCLPNIVPKLTEVLTDSHVKVQKAGQQALRQIGSVIRNPEILDLYKPVSVFLWHAAIAPVLLDALTDPSRKTQKCLQTLLDTKFVHFIDAPSLALIMPIVQRAFQDRSTDTRKMAAQIIGNMYSLTDQKECLPSSCDFLIERLRLELVLLSRRDLAPYLPSVTPGLKASLLDPVPEVRTVSAKALGAMVKGMGESCFEDLLPWLMETLTYEQSSVDRSGAAQGLAEVMAGLGVEKLEKLMPEIVATASKVDIAPHVRDGYIMMFNYLPITFGDKFTPYVGPIIPCILKALADENEFVRDTALRAGQRVISMYAETAIALLLPQLEQGLFDDSGESVMDPTLTLSLRLYDSALGLRFSSVQLLGDLLFHISGVTGKMTTETASEDDNFGTAQSNKAIITALGVDRRNRVLAGLYMGRSDTQLVVRQASLHVWKIVVSNTPRTLREILPTLFGLLLGFLASTCADKRTIAARTLGDLVRKLGEKILPEIIPILEEGLRSQKSDERQGVCIGLSEIMKSTSRDAVLYFSESLVPTARKALCDPLEEVREAAAKTFEQLHSTIGHQALEDILPFLLKQLDDEEVSEFALDGLKQVMAVKSRVVLPYLVPKLTTPPVNTRVLAFLSSVAGDALTRHLGVILPAVMLALKEKLGTPDEQLEMANCQAVILSVEDDTGHRIIIEDLLEATRSPEVGMRQAAAIILNMYCSRSKADYTSHLRSLVSGLIRLFNDSSPVVLGESWDALNAITKKLDAGNQLALIEEFHKEIRYIGNECRGEHVPGFCLPKKGVTSILPVLREGVLTGSPEQKEEAAKALGLVIRLTSADALRPSVVSITGPLIRILGDRFSWSVKAALLETLSLLLGKVGIALKPFLPQLQTTFTKALQDSNRGVRLKAADALGKLISIHIKVDPLFTELLNGIRVVEDPGIRDTMLQALRFVIQGAGAKVDAAIRKNIVSLLLGMLGHDEVWLRVSGCTAEPTASRLRLFSLCCVGDWFSCQLDALAVRESGSVYGADFWSQTKQGLTGFEHVFALSPRPSPVASASVTFSACPLMSPDRADRFWGHAEPCSPAAAVAGALGLWLCRPIGPTVGKHWPSSHALLALAGLRADNTRISSAGCLGELCAFLTEEELNTVLQQCLLADVSGIDWMVRHGRSLALSVAVNVAPSRLCTGKYSNEVQDMVLSNAVADRIPIAVSGIRGMGFLMKYHIETGGGQLPPRLSTLLIKCLQNPSSDIRLVAEKMIWWANKEPRPALEPQAIKPILKALLDNTKDKNTVVRAYSEQAIVNLLKLRQGEELLQSLSKILDVASLEALNECSRRSLKKLACQADSVEQVDDTILT

SEQ ID NO: 20040 - protein, 169 aa, Rattus norvegicus
MIKQFLRDVDWGDVDYLVIDTPPGTSDEHLSVVQYLAAAHIDGAVILTTPQEVALQDVRKEISFCHKVKLPIIGVVENMSGFICPKCKRESQIFPPTTGGAEAMCQALKIPLLGKVPLDPHIGKSCDKGQSFFVEAPDSPATAAYKSIIQRIREFCNSRQSHDENLISP

SEQ ID NO: 20041 - protein, 161 aa, Rattus norvegicus
MYVALLQSCRSADGPRQQDQVCDWPNEVSGSFSVNYYNYLQAAEDAEFITPSRSATCMSDKLPYKVADIGLAAWGWKSLRTRCQGTRTAVCLHITVETAVLTETLVVLGAEVRQSSCNISTQDHEQLHHLGCPGQSLLFPHRGVDKALADMKLPLGFSFPP

SEQ ID NO: 20042 - protein, 220 aa, Rattus norvegicus
MTSKDYYFDSYTHFGIHEEMLKNEEVLDVGSGTGILCISAAKAGSRKVTGMLCSSISDYAVKIVKANTLDHVVTIIKGKVEVELPLEKGGHKTAGHQCLPHKRDGHLHSQGGDLTFISPFGLQVKKNDCIHALVAYFNTEFTRCHKRTGFSTSPEFPYTHWKNTVFHMEDYLTVKTSEEIFGTIGMRSNAKYKHDLDFTIDLDFKGQLYELSCSTDYRMH

SEQ ID NO: 20043 - protein, 233 aa, Rattus norvegicus
MPREYRATWNPNYFLKIIQLLDDYPKCFIVGADNAVVLMGKNAMMRKAIRGHLVNNRALEKLLPHIRGNSGFVFTKEDLTEIRDMLLANKVPAAAGAGALAPCTIEILSDVQLIKIGDKVGASEATLLNMLSISPFSFGLIIQQVFDNGSIYSPEIGYPTVASVPHSIINGYKRVLALSVETDYTFSLAEKVKAFLADPSAFAAAAPGAAAAPAKAEAKEEKSDEDLGFSLFD

SEQ ID NO: 20044 - protein, 902 aa, Rattus norvegicus
MTASPESMGQKFRNMTANECFQSRSTVLQGQPFGGIPTVLLLNIILWVCVVLVYSFLRKAAWDYGRLALLIHNDSLTSLIYGEQSEKSSPSEVYLEAERRDKGFSTWFFNSLTMRDRDLINKCGEDARIYIMFQYHLIIFVLILCIPSLGIILPVNYIGSALDWSSHFGRTTIVNVSTDAAFSVHDSTLHSCEILFEESVLVPGAEFEWLGIYLGKQKPVARQIKWGVVGDGQGTILRVWSQFLWLHSIFAFMYFLTNFAFMGHHCLGFVPKKNLHHPTRSAMKAPHAGCISVEAQPYLSQLQFTRTLMITYVPTEIQDPETISKHFHEAYPGCVVTRVHFCYDVRNLIDLDDQRRHAMRGRLYYTAKAKKTGKVMIKVHPCSHLCFCKCWTCFKEVTDKGVGNTRERVDAEQYYSELEEQLTDEFNAELNRVQLKRLDLIFVTFQDARTVKRIHNDYKYINCGRHPMQSSVTTIVKNNHWRVARAPHPKDIIWKHLSIRRFSWWARFIAINTSLFFLFFFLTTPAIIINTIDMYNVTRPIEKLQSPVVTQFFPSVLLWAFTVIMPLLVYFSAFLEAHWTRSNQNLIIMYKCYIFLVFMVVILPSMGLTSLDVFLRWLFDIYYLEHATIRFQCVFLPDNGAFFINYVITSALFGTGMELMRLGSLCTYCTRLFLSRSEPERVHIRKNLAMDFQFGREYAWMLNVFSVVMAYSITCPIIVPFGLLYLCMKHITDRYNMYYSYAPTKLNAQIHMAAVYQAIFAPLLGLFWMLFFSILRVGSLHSITLFSLSSIIISVIIAFSGVFLGKFRIAQQYEQPEEETETVFDVEPSSTTSTPTSLLYVATVLQEPELNLTPASSPARHTYGTMNSQPEEGEEESGLRGFARELDPAQFQEGLELEGQSH

SEQ ID NO: 20045 - protein, 216 aa, Rattus norvegicus
MSLRGKAVVLMGKNVMMRKAIRDHLKNNRALEKLLPHIWGNSGFVFTKEDLTEIRDILLTKNVPAATRASALAPYEIKYWSGNEKTLGIATNISRGTIEILSDMQQVFDNSSIYNPEVLHITEQTLHSRFLEGVHNVASVYLQTDYPTVASVPHSIINGYKPALALSVETEYTFPLAEKKLKVRRPVGKATIVYSAMILEGFVQTFEKRQEINQKT

SEQ ID NO: 20046 - protein, 271 aa, Rattus norvegicus
MEAAAEPGNLAGVRHIILVLSGKGGVGKSTISTELALALRHQGKKVGILDVDLCGPSIPHMLHAQGKAVHQCDSGWVPVFVDQEQSISLMSVGFLLENPDEAVVWRGPKKHALIKQFVSDVAWGELDYLVVDTPPGTSDEHMATVEALRPYKPLGALVVTTPQAVSIGDVRRELTFCKKTGLQVIGVIENMSGFACPHCAECTNVFSSGGGEELARLAGVPFLGSVPLDPQLTRSLEEGRDFIQEFPKSTAYSALTSIAHKVLHQMPALCS

SEQ ID NO: 20047 - protein, 304 aa, Rattus norvegicus
MKGKEEKEGGARLGTGGGGSPDKSPSAQELKEQGNRLFVGRKYPEAAACYGRAITRNPLVAVYYTNRALCYLKMQQPEQALADCRRALELDGQSVKAHFFLGQCQLEMESYDEAIANLQRAYSLAKEQRLNFGDDIPSALRIAKKKRWNSIEERRIHQESELHSYLTRLIAAERERELEECQRNHEGDEDDGHIRAQQACIEAKHDKYMADMNELFSQVDEKRKKRDIPDYLCGKISFELMREPCITPSGITYDRKDIEEHLQRVGHFDPVTRSPLTQEQLIPNLAMKEVIDAFISENGWVEDY

SEQ ID NO: 20048 - protein, 1392 aa, Rattus norvegicus
MFLLHGKLVLFAVLYRKKKDTQGFGEESREPSTGDNIREFLLSLRYFRIFIALWNVFMMLCMIVILTTNLPRSTGKAGTWLRCMQMKSTKSVSISADLLSADSIQKSAADKLLQMARRRLRLDSPSYSPHGSQRRQPLPFLVSLWPLQSSDSSKLEVLIRWRVLPFRNPKAVSRKSRCSRTWHQMRDRLLQAIDSQSNAACVGTPPPPTRPCQGFSPGGDLPATAAAISVSRSPGSGGRRQGGKAPLSKRQLTDFENCGGLTHLSVFAQLNMLTVSELYCTSVCLMNKGEGYDLLLRKNHKADTMAIISYLESLASAGRQVPCSKGTGTGGQSWKSSLQTQSELSVGTGGPTVLVTQNAFLGSYIVSRVHHDEALQLVLAVNKVVSDPEARQVLIETLEFENVNVECKKVIRPLKTFPLMLCFCVAVFASVAVLLGCPVISSIAFWSYCFQNNNPGTCPIRNMVAVLEVISSLERYPITKEALEETRLGKLINDVRKKTKNEELAKRAKRLLRSWQKLIEPVHQNEVALRALAGAAGSANGGAHNCRPELGVAGAPKSIHDLKNRNDIQRLPGQRLDRLGSRKRRGDQRDLGHPGPPHKVSKGSPDPLVPNASPLPTNGISGSPESLPSPLDGSGHLGPDGSRLELSENEKHSTKIPVNAVRPRPSSPGLGKPPVPCLQTKAAQLQPLDRADEPPGPPYPRGSPRCSISPRNSRHEGSFARHRSSYIPKGPVSSPSPRPQPLDTTQVPSPLPLAQPPTPPVRRLDLLPNAESPVHWPEQPEGHPRLTGPACRAGLSPDSSKADSDAASSGGSDSKKKKRYRPRDYTVNLDGQVAEAGVKPVRLKERKLTFDPMTRQIRPLTQKEPVRADSPVPTEQLPRTELEQQEAKASLQSPFEQTNWKELSRNEIIQSYLSRQSSLLSSSGAQTPGAHHFMAEYLKQEESSRQGARQPHVLLPLPTPTDLPGLTREVTQDDLDRIQAQQWPGVNGCEDTQASGGRGRIAPHLSRRFPAVHQSTKYSGRMRGNQAPVFRVRPRPLPGGVQVRVEPSRRPLCAGLPPLLRAWRVPPAPPVSGPGPSPHPASGPLLPPRFYPRYVLPLAFGKYFASVSAHVSIWKVPVSYAHTVKATMPIWVVLLSRIIMKEKQSTKVYLSLVPIISGVLLATVTELSFDVWGLVSALAATLCFSLQNIFSKKVLRDSRIHHLRLLNILGCHAVFFMIPTWVLVDLSTFLVSSDLAYVSQWPWTLLLLVVSGFCNFAQNVIAFSILNLISPLSYSVANATKRIMVIAVSLIMLRNPVTSTNVLGMMTAILGVFLYNKTKYDANQQARRHLLPVSTSDLSNREHLRSPMEKPHNGALFPQQGDFQYRNILLTDHFQYSRQGHPNSYALSRHDV

SEQ ID NO: 20049 - protein, 233 aa, Rattus norvegicus
MGEPQQVSALPPPPMQYIKEYTDENIQEGLAPKPPPPIKDSYMMFGNQFQCDDLIIRPLESQGIERLHPMQFDHKKELRKLNMSILINFLDLLDILIRSPGSIKREEKLEDLKLLFVHVHHLINEYRPHQARETLRVMMEVQKRQRLETAERFQKHLERVIEMIQNCLASLPDDLPHSEAGMRVKTEPMDTDDNSNCTGQNEQQRESSGHRRDQIIEKDAALCVLIDEMNERP

SEQ ID NO: 20050 - protein, 163 aa, Rattus norvegicus
MPTIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVRKENQWCEEK

SEQ ID NO: 20051 - protein, 427 aa, Rattus norvegicus
MEQCACVERELDKVLHKFLTYGQHCEQSLEELLHYVGQLRAELASAALQGTPLSATLSLVMSQCCRKIKDTVQKLASDHKDIHSSVSRVGKAIDRNFDSEICGVVSDAVWDSREKQQQILQMAIVEHLYQQGMLSVAEELCQESTLNVDLDFKQPFLELNRILEALHEQDLGPALEWAVSHRQRLLELNSSLEFKLHRLHFIRLLAGGPEKQLEALSYARHFQPFARLHQRGKCPGCWGTTLQFCGSLGYSLSSAFPELSSHCLVEIQVMMGSLVYLRLGLEKSPYCHLLDNSHWAEICETFTRDACSLLGLSVESPLSVSFASGCVALPVLMNIKAVIEQRQCTGVWSHKDELPIEIELGMKCWYHSVFACPILRQQTSDSNPPIKLICGHVISRDALNKLINGGKLKCPYCPMEQNPADGKRIIF

SEQ ID NO: 20052 - protein, 384 aa, Rattus norvegicus
MLLFGGLLEENVTPTMQISVVSDGTSILQSAFVTGLRESLRMRRISSHFVNLCSVGSAPEERTAVTGGRASCHRPQALKDALGGKSNLEDTLAFRWETVTASKDVKKIPVADFSGQTFKTYSQKESIHYEKSFEGACLICWPYSKRELISSIKSPSPLVIIDKESASDPNHATVSYCPVVKMPQSLTLHYPPKIEGQAQVETKVSKDTYALDSDSSMEKLTALSASLARVVVPAIQEAEADGFPTGREIVERPRQQTPIIARYCVQPQWVFDCLNARLLLPVAEYFPGVQLPPNLLPFIAEKEGDYIPSEKLKLLVLQQGEDPGNLEEEDEDDEDNDNEGDTGVAAENKEEDVEAESEEEKEAHLSALEQQSWKERSPRLRPAP

SEQ ID NO: 20053 - protein, 343 aa, Rattus norvegicus
MSDKLPYKVTDIGLAAWGWKALDIAENEMLGLMSMRETYSASKPLKGARIAGCLHMTVETAVLIKTLVALGAELLSSIRGISEKTTTGIHNLYKMMANGILKVPAININDSVTKSKFDNLYGCWESLIDGIKRTTDVMITGKVAVVADHGDVGKGCAQALQGFGAQIIITEIDPINALQAAMEGYEVTTMNEACKAGNIFVTTTGCVDIVLGQHFEQMKDDAIVCNIGHFDVEIDVKWLNENVVEVNIKPQVDYYLLKNGHLIILLAGGQPGLCHGPPQLCDEQLLHKPEKYPVGVHFLPKKLDEAVAEAHLGKLNGKLTKLTGNQAQYLGMPINSPFKPDHY

SEQ ID NO: 20054 - protein, 433 aa, Rattus norvegicus
MPTETEEELPTPTPEPSISEEGNFHSQYQVLRTIGQGGNAKVLLAHHRLTGTPVAVKVLRKDKEWFQPAMMEANIMRKINHPNIVSLIQVIEKKTRIYLIMELVEGQELYQYIRESGHIEEDEARQIFEQILSAVSYCHGKGIVHRDLKLDNIMIDKNKKVKVIDFGLSTQFQPGKMLNHHCGTYSFGSSELLLGHRYDGPKNDMWIIGVVLYCMVVGKLPFDSVIIQELQRQVVAGVYPAPCGVSKELEDLLSKLLRVNPNFRPTARKAMKHPWFKEHWNGLIGPYEEMLPLTPDPAIWDAMKSIGFQASVVKHSLKQRKYNEEMATYFFLQKQALQGDGCTAQAQQDHYHKCAVSVPCIQTTSIFTEKSSNKEIKKTTHSPTEPHLRISPSPAGGFKGWTRNIANALIKLCCCMPRRKKPRLGQNRISPQK

SEQ ID NO: 20055 - protein, 426 aa, Rattus norvegicus
MPTETEEELPTPTPEPSISEEGNFHSQYQVLGTIGQGGNAKVLLAHHRLTGTPVAVKVLRKDKQWFQPAMMEANIMRKINHPNIVSLIQVIEKETRIYLIMELVEGQELYQYIRESGHIEEDEARQIFEQILSAVSYCHGKGIVHRDLKLDNIMIDKNKKVKVIDFGLSTQFQPGKMLNHHCGTYSFGSPELLLGHRYDGPKNDMWIIGVVLYCMVVGKLPFDSVIIQELQRQVVAGVYPAPCGVSKELEDLLSKLLRVNPNFRPTARKAMKHPWFKEHWNGLIGPYEEMLPLTPDPAILDAMKSIGFQASVNAHPKGGKRSTVAGRLRPLPMTPTQDHYHKCAVSVPCIQTTSIFTEKSSNKEIKEDNPLSHRAPLEDKPIPSRVRHRGFKGWTRNIANALIKLCCCMPRRKKPRLGQNRISPQK

SEQ ID NO: 20056 - protein, 460 aa, Rattus norvegicus
MEPAEDSLGAAIQPPELAPVPERSLRILLGLREALSSDVRQEAAALAALAGPVFLAQLMIFLISIVSSIFCGHLGKVELDAVTLAVSAPQPINYNTLKTRLSARKPSETTFHYPKLQSFGGKNLKRVGVILQRGILILLLCCFPCWAIFLNTERLLLFLRQDPEVARLAQVYVMICIPALPGIIMPQVIVGIAANVVNVGMNAFLLYALDLGVVGSAWANTTSQFFLSALLFLYVWWKGIHIHTWGGWTRECFQEWSSYTRLAIPSMFMVCIEWWTFEIGTFLAGLVNVTELGAQAVIYELASVAYMVPFGFGVAASVRVGNALGAGNADQARCSCTTVLLCTGVCALLVGILLAALKDVVAYVFTNDNTVTKRMSHCSLQTDLPILEREVIDGVILPDIIRPESQTGQLVVEENSQCVVPTVGEVLTGRQLVVYRGTALIVSIAVLIAGIVVRVINDRG

SEQ ID NO: 20057 - protein, 173 aa, Caenorhabditis elegans
MGAKAAGAKKIVGIDLIESKFESAKFFGATECINPKSVELPEGKSFQAWLVEQFDGGFDYTFECIGNVHTMRQALEAAHKGWGVSCIIGVAGAGQEIATRPFQLVTGRTWKGTAFGGWKSVESVPRLVDDYMNKKLLIDEFITHRWNIDDINTAFDVLHKGESLRSVLAFEKI

SEQ ID NO: 20058 - protein, 1494 aa, Rattus norvegicus
MPETSDTDLPRTEQLPKAILVPVIDLASKILDTSRTKEFEEPESKAKLNICGHAAKSHVATLIHSHKAARPISNTAPYRLTVVYADITFDSMTAFLSDAIHESGEINWDCFPGIHSFVHSRITASAATAQTGKDEAKLTQKGHLTVKEHILGTIHSNLKDSVPSGETKALQLSKTGINVNSRKTAGIFSGAHSTMAMQCTVQQLVGHFLSSVHSSIMVSCALMRWAEQSTHYSFIKDCAESGLVVTCEAWTLVKILDLDTGECFGLGFWQRFGLGYWFWTRILAKVWTRILVNVLGLDSGNGLDSDTGERFGLGFWLHLDLPGAESGLVVTCEAWTLVKILDLDTGECFGLGFWQRFGLGYCAESGLVVTCETWTLVKILDSDIGGILDLDFGKGLDSDTGEHFGLGFWQRFGLGYCWCGQSTKMKRWQVCQDLRSSPFQEDALTDHYRILASLGQGAFGEVKLATHLLTHTKVAIKVLPKSKKRNMVRTEIEIMKSLDHPHIIKLLHIVDTNKNIFIVLEHAVGGELLTRIVDFGYLPEEECNRLFRQIVLALQYCHQRGIVHRDIKPENILLDHKGNVKLSDFGLSTKIVMGQKLITLCGTLPYCAPELFDFKGYDGQAIDVWSLGVVLYYMATGYLPFEGFTYEAVKEKILAGKYSMNFRLSRELWDVISKLLSVNPGERPRANEILRLNWLKNENEASPSSLGGNTDSHPDPTILVMMGDMGYEQGQIRESLREQKFDQVMATYLMLKQKACSEDKSIKKSHPTQSAQTLQSTGSSMENQTILSRGSSEPTLTTFYSPNASESLNKGKITTMRHTMPPNLNCFNKSESLNKGKRTIVRHTMPPTLNCLKKNTRPVPRNSPRLHKSLGMRSAWGKTESRDSSEGSLERNSSDPSLTNFSSQSFMSSFKYGSTYSKRKAFLLSYHASQEEDQYKTTILPSGKLKTTVPPNSLQEDQSTGHLHNVLTAGAVDNRNLQEKSPPFSTMATKGEGPAIKERESIPSSPRAPREQFRGRSQTPPRAPFRRRVWKTLKSGFLKGLGSLCCCLPIQKKVGFHDGCWFPNCACQLRCFIGLRNAENKVTMACMSSLRTQALQDFPGMLSEDSWEDTQQGTEPETSYIFVVQRAGEVSGALHSGSKLNTQVMPPCSSHGEGTWLTLGDLSKTPCSQVSFMEEAPEISRKVAPETQVASSATWTGSNMRSNMRSDLRNTQQFSLTVCCARRVDESVWRTSSLGTVPLSNRSQAISVRCIASALHPPTPLLCKCGKESQLVSLAPSLWLFPVLLETLWSLRTIPESREHLTEDTDSSTRGESQLSEDSWEDTQQGTEPETSYIFVVQRAGEVPGALHSGSKLNTQVMPPCSSHGEGTWLTLGDLSKTPCSQVSFMEEAPEISRKVAPETQVASSATWKGSNMRSNMRSDLRNTQQFSLTVCCARRVDESVWRTSSLGTVPLSNRSQAISVRCIASALHPPTPLLCKCGKESQLVSLVTQSPRH

SEQ ID NO: 20059 - protein, 131 aa, Rattus norvegicus
MAAAVAMETDDAGNRLRFQLELEFVQCLANPNYLNFLAQRGYFKDKAFVNYLKYLLYWKEPEYAKYLKYPQCLHMLELLQYEHFRKELVNAQCAKFIDEQQILHWQHYSRKRMRLQQALAEQQQQNTTAGK

SEQ ID NO: 20060 - protein, 301 aa, Rattus norvegicus
MEDEVVRIAKKMDKMVQKKNAAGALDLLKELKNIPMTLELLQSTRIGMSVNAIRKQSTDEEVTSLAKSLIKSWKKLLDGPSTDKDSEEKKKEPAISSQNSPEAREESSSSSHVSSRKDETNARDTYVSSFPRAPSTSDSVRLKCREMLAAALRTGDDYVAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 20061 - protein, 317 aa, Rattus norvegicus
MDEELERDEKVFLLGEEVAQYDGAYKVSRGLWKKYGDKRIIDTPISEMGFAGIAVGAAMAGLRPICEFMTFNFSMQAIDQVINSAAKTYYMSAGLQPVPIVFRGPNGASAGVAAQHSQCFAAWYGHCPGLKVVSPWNSEDAKGLIKSAIRDDNPVVMLENELMYGVAFELPTEAQSKDFLIPIGKAKIERQGTHITVVAHSRPVGHCLEAAAVLSKEGIECEVINLRTIRPMDIEAIEASVMKTNHLVTVEGGWPQFGVGAEICARIMEGPAFNFLDAPAVRVTGADVPMPYAKILEDNSIPQVKDIIFAIKKTLNI

SEQ ID NO: 20062 - protein, 448 aa, Rattus norvegicus
MKIVGQLSDKFYYTDCLFFGAIISATDPVTVLAIFNELHADVDLYALLFGESVLNDAVAIVLSSSIVAYQPAGLNTHAFDAAAFFKSVGIFLALFFLMSWSTFLLAEACGFTGVVAVLFCGITQAHYTYNNLSVESRSRSKQLFEVLHFLAENFIFSYMGLALFTFQKHVAIFLGRAAHIYPLSFFLNLGRRHKIGWNFQHMMMFSGLRGAMAFALAIRDTASYSRQMMFTTTLLIVFFTVWVIGGGTTPMLSWLNIRVGVEELSEEDQNEHRWQYFSEVNEVFSPVRISDLTHWTDRPVLGCWQLQDDHDVDDSDFCYILMASGLPGTSYLKPILTHSGPPLTTTLPAWCGLMARCLTSPQVYDNQEPLREDDSDFILTEGDLTLTYGDSTVTANGSSSSYTASTSLECGRRTKSSSEEVLERDLGMGDQKVSSRGTPLVFPLQENA

SEQ ID NO: 20063 - protein, 220 aa, Rattus norvegicus
MNCIRSITDLREQRQLHYEPTCQKDAKEGDKETQGGAITGGISEETTPGVHNLYKRTANGILKVPAINVNNYVTKDKFDNLYGCQEFLRDGIQRATDMMIAGKVAVVTGCGCVDIILGWRFEQMKDDAIVYNAGCFNVEIDVKWLNENAVEKWIKNGYYIILLAEGHLVNLGRPSFMMSNFTNQRAKPEFLRSMHFAKRCKKGLKKSRQFIHVQRPLQPL

SEQ ID NO: 20064 - protein, 703 aa, Rattus norvegicus
MKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGSGGSPVPTRRALEMAQHSQRSRSVSGASTGLSSSPLSSPRSPVFSFSPEPGVGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSSGGGIYSVTFTLISGPSRRFKRVVETIQAQLLSTHDQPSVQALADEKNGAQTRPAGTPPRSLQPPPGRPDPDLSSSPRRGPSKDKKLLATNGTPLP

SEQ ID NO: 20065 - protein, 396 aa, Rattus norvegicus
MHMSSPKSTSNSDQKLFSQSYTTPDKQPLAILIHRCKYPLASETDLDLLSEVDLELGRDTDLDHRGDVDLDLLPQLLLREISEAVSHHGFKQFVQESTFKPIKFSLGLGIKPPRSHGTTHLAVVAVVEMQDRNKVIGGIQESIYNLIRTFVIHENTFELDTKDKNIYRLRHQKQGCCTAIPSKIKHSGSLGVPLGSLAEEIVQQSFCSCCEHYKLEPSTQAGHHVTLQYGGESKGYVGNLGTGVGKGELERAFSYYGPLRTVWIARNPPGFAFVDLKTLEMQRMRLEDWVGKCYECGEQGHYAYDYHRCSRRRSRSRSRSHSGSKGRRYSYSRSRSCGRRIEIPQGRDQDLGLFHDQEAANQNPDLHLLEEVIPHQEVHIGVQVQKEWTEVLKFTR

SEQ ID NO: 20066 - protein, 994 aa, Rattus norvegicus
MATAAESGARTWPGSGSPRLGSPAGSPVLGISGRARPGSGPERTGRAIGSVAPGHSFRKVTLTKPTFCHLCSDFIWGLAGFLCDVCNFMSHEKCLKQVKTPCTSIAPSLVRVPVAHCFGSLGLYKRKFCVVCRKSLEVPAFRCEGTIGPLAPLELSSSLKGLVSATPVCELHVHPDCVPFACSDCRQCHQDGQHDYDTYHHHWREGNLPSGARCEVCRKTCGSSDVLAGVRCEWCGVQAHSVCSTALTPECTFGRLRSMVLPPSCVRLLSRNFSKMHCFRIPETMVLELGDGDDGLDGSAAVGTGREVSAATESTKQTLKIFDGNDSMRKNQFRLVTVSRLARNEEVMEAALRAYYINEDPKDFQLQALPLTLLSGNAQALGKAGTTEEETSKDSGPGDSVPEAWVIRSLPRTQEILKIYPDWLKVGVAYVSIRVNSQSTARSVVQEVLPLFGRQVEDQERFQLIEVLMSSRQVQRTVLVDEEPLLDRLRDIRQTSVRQASQTRFYVAEARAVTPHVSLFVGGLPPGLSPQDYSNLLHEAMATKAAVVSVSHVYSLQGAVVLDVTCFAEAERLYMLARDTAVHGRPLTALVLPDVLHTKLPPDCCPLLVFVNPKSGGLKGRELLCSFRKLLNPHQVFELTNGGPLPGNSKWTAGISKSSMASDGTSKKERAAQGKNEYADSDLGSQEVPCFRVLVCGGDGTVGWVLAALEETRRHLACPEPSVAILPLGTGNDLGRVLRWGAGYSGEDPFSVLVSVDEADAVLMDRWTILLDAHEIDSTENNVVETEPPKIVQMNNYCGIGIDAELSLDFHQAREEEPGKFTSRFHNKGVYVRVGLQKISHSRSLHKEIRLQVEQQEVELPSIEGLIFINIPSWGSGADLWGSDSDSRFEKPRIDDGLLEVVGVTGVVHMGQVQGGLRSGIRIAQGSYFRVTLLKATPVQVDGEPWIQAPGHMIISATAPKVHMLRKAKQKPRKAGAIRDTRVDTLPAPEGNPL

SEQ ID NO: 20067 - protein, 298 aa, Rattus norvegicus
MALRKELLKSIWYAFTALDVEKSGKVSKSQLKKEERAPSPPVEVGEPREFVLQPAPQGRAVRCRLTRDKKGMDRGMYPSYFLHLDTEKKVFLLAGRKRKRSKTANYLISSDPTNLSRGGENFIGKLRSNLLGNRFTVFDNGQNPQRGGGGDVESLRQELAAVVYETNVLGFRGPRRMTVIIPGMNSDNERVPIRPRNSSDGLLVRWQNKTLESLIELHNKPPIWNEDSGSYTLNFQGRVTQASVKNFQIVHADDPDYIVLQFGRVAEDAFTLDYRYPLCALQAFAIALSSFDGKLACE

SEQ ID NO: 20068 - protein, 401 aa, Rattus norvegicus
MISFLELSNGTRSVAFMAVPHRSQETSYLLPPNPEDWEEQGIPDFVYGQKDLVSKEIQWPKNSPSALNSLPLSRFDSALCSAWRQRVELGLFRYRLEDLQTQILPGSVGFVAQLNIERGIQRRRPQNIKSVRQEFDPEQFNFNKIRPGEVLFRMQREPNGPAAPKQEDVLVVINVSPLEWGHVLLVPTPAHGLPQRLLPGVLRVGLEAVLLSQHPGFRVGFNSLGGLASVNHLHLHGYYLAHPLPVEGAPSTPLDPKGYIHLLQALPAPGFLFYTSGPGPDLEALISRVCQATDYLSDHEIAHNLFVTRGAPPGQASSTSDLSGIRVILWARKSSFGIKESGAFNVALCELAGHLPVKTSQDFSSLTEAAAVALIQDCLLPQTQADEVQAALVALMAQEEL

SEQ ID NO: 20069 - protein, 128 aa, Rattus norvegicus
MAGGKAGKDSGKAKAKAVSRSQRAGLQFPVGCIHRHLKTRTTSHGRVGATAAVYSAAILEYLTAEVLELAGNASKDLKVKRITPRHLQLAIRGDEELDSLIKATIAGGGVIPHIHKSLIGKKGQQKTA

SEQ ID NO: 20070 - protein, 299 aa, Rattus norvegicus
MTDVAVSFAKDFLAGGVAAAISKTAAVAPIERVKLLLQVRHASKQISADKRYKGIMDGVVRIPKEQGVLSFWRGNLASVIRYFPTQALNFAFKDKYKQIYLGGVDKRTQFWRYFAGNLASGGAAGATSLCFVYPLDFARTRLAADVGKAGAEREFKGLGDCLVKIYKSDGIKGLYQGFNVSVQDIIIYRAAYFGIYDTAKGMLLDPKNTHIFISWMIAQSVTAVAGLTSYPFDTVRRRMMMQSGRKRTDIMYTGTLDCWRKIARDEGGKAFFKGAWSNVLRGMGGAFVLVLYDEIKKYT

SEQ ID NO: 20071 - protein, 403 aa, Rattus norvegicus
MSMRKKCGEEASTRTSNVERKSSQSQRNRSNVTGGKVPHIRMDNGASIEEFYTFGRILGQGSFGMVIEATDKETGAKWAIKKVNKEKAGSSAVKLLEREVNILKTVKHQHIIHLEQVFESPQKMYLVMELCEDGELKEVLDQRGHFSESETRLIIQSLASAIAYLHSKDIVHRDLKLENIMVKSSFIDDNNEMNLNIKVSDFGLAVQKHGSRSESMMQTTCGTPIYMAPEVINAHDYSQQCDIWSIGVIMYILLCGEPPFLANSEEKLFELIRKGELQFQDPVWDSVSDSAKSALKQLMKVDPAHRITAKELLDNQWLTGNTLSSARPTNVLEMMKEWKNNPESDDDTKADKETEQHTEEKLKHNKIEEKAPNVNHSPSAKSVNQTSDKSLVKVTYCGLGYFV

SEQ ID NO: 20072 - protein, 181 aa, Rattus norvegicus
MPREVRATWKSNYFLKIIQLLDDYRKCFIVGADNVGSKRMQQIRMSLRRKAVVLMGKNAMMYKAIRGHLEKNPALEKLLPHIRGNVGFVFTKEDLTTKIPRGTTEILSDVQPIKTGDKHVFDNGSIYSPQVLDITEQALHTRFLEGVRNVASVCLQIGYLTVASLHHQWVQEDPGFVCEDL

SEQ ID NO: 20073 - protein, 683 aa, Rattus norvegicus
MERASLIQKAKLAEQAERYEDMAAFMKSAVEKGEELSCEERNLLSVAYKNVKSNEEGSEGKGPEVKEYREKVETELRGVCDTVLGLLDSHLIKGAGEAESRVFYLKMKGDYYRYLAEVATGDDKKRIIDSARLPGGHGHQQEGDAAHQPHTPGPGLNFSVFHYQIANSPEEAISLAKTTFDEAMADLHTLSEDSYKDSTLIMQLLRDTLTLWTADNAGEEGHRPQGVCSHQRQQAEKDSSTLSPPMARVVLFVSGAVSPVQTLFLLQCGLCIFSADTVSSSVQTLFLLQCRHCCFSSADTVSSVQTLYLHCRCCISSADTVSSSVQTLFLLQCRHCSFFNVDSVSPVQTLFLLQCRHCIFSADTVSSLQVLYLQCRHCFLFSADTVSSPVQTLLLLQCRHCISSADTVSSLQVLYLQCRHCFLFSADTVSSPVQTLFLLQCGLCIFSADTVSSPVQTLLLLQCRHCISSADTVSSSVQTLFLLQCRHCSFFNVDSVSSVQTLFLLQCRHCIFSADTVSSLQVLYLQCRHCFFFSADTVSSSMWTLYLQCRHCFFFSADTVSSPVQTLFLLQCGLCIFSADTVSSPVQTLYLQCRHCIFTAVQTLFPLQCRHCFFSSADTVSSSVQTLFPLQCRHCFLFSADTVSSVQTLYLQCRHCIFTAVQTLFLLQCRHCSFFNVDSVSSV

SEQ ID NO: 20074 - protein, 630 aa, Rattus norvegicus
MESVALHRRGNLAPSASALATESARPLADRLIKSPKPLMKKQAVKRHHHKHNLRHRYEFLETLGKGTYGKVKKARESSGRLVAIKSIRKDKIKDEQDLLHIRREIEIMSSLNHPHIIAIHEVFENSSKIVIVMEYASRGDLYDYISERPRLNERDARHFFRQIVSALHYCHQNGIVHRDLKLENILLDASGNIKIADFGLSNLYHKGKFLQTFCGSPLYASPEIVNGKPYVGPEVDSWSLGVLLYILVHGTMPFDGQDHKTLVKQISSGAYREPCKPSDACGLIRWLLMVNPIRRATLEDVASHWWVNWGYSTRIGEQEALREGGHPSGDSGRASMADWLRRSSRPLLENGAKVCSFFKQHVPGGGSTGPGLERQHSLKKSRKENDMAQTLQNDPAEDTSSRPGKNSLKLPKGILKKKASPSSGEVQEGPQELRPVSNTPGQPVPAIPLLPRKGILKKSRQRESGYYSSPEPSESGELLDAGDVFVSGDPMEQKSPQASGRLHRKGILKLNGKFSRTALEGTAPSTFGSLDQLASPHPTARASRPSGAVSEDSILSSESFDQLDLPERLPETPLRGCVSVDNLRRLEQPPSEGLKRWWQESLGDSCFSLTDCQEVTAAYRQALGICSKLS

SEQ ID NO: 20075 - protein, 859 aa, Rattus norvegicus
MYMHVLCFVDLCAYGHVGLCEGVCSEACAFPGALVGVLGIFVEELCLHHVVSFPPALGNPDYCHSLETLVPKLLGHDRHPELGPRGNACDTTQLEALTAGTTAGECSLKSCEPKDRSRYERMYGFTLQGLVKLGIHCVTCQKVAIKIVNREKLSESVLMKGIDMVSLQVEREIAILKLIEHPHVLKLHDVYENKKYLYLVLEHVSGGELFDYLVKKGRLTPKEARKFFRQIISALDFCHSHSICHRDLKPENLLLDERNNIRIADFGMASLQVGDSLLETSCGSPHYACPEVIRIPVPCTLPTSGIALLPQGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEYVGVGENQEKMIYFLLLDRKERYPSHEDEDLPPRNEIGTKLPPYPIPHFWLLAQSDSSLHTDPPRKRVDSPMLNRHGKRRPERKSMEVLSVTDGGSPVPARRAIEMAQHGQSKAVFSKSLDIAEAHPQFSKEDRSRSISGASSGLSTSPLSSPRPVRKFVLPPLPPELPYVACPLATSLEPEACRSTSRPGHILSPQAALRPNPKTQTLPCKAKLTDKPLQGTKSNPLPACTQTQPPGASLGTPLALSPGPPTLPAPARLLPTGTEPNTKSVPTIQVTPHPSPRGSPLPTPKGTPVHTPKESPAGTPNPTPPSSPSVGGVPWRTRLNSIKNSFLGSPRFHRRKLQVPTPEEMSNLTPESSPECALFMGLITPWQPTLTSAIPLSLGCLGSPVYAQALDHPSPLGPIFCEE

SEQ ID NO: 20076 - protein, 310 aa, Rattus norvegicus
MCVYVHVNRESTYSQLTGISLVTMLARLQKSMAAESQGLTQALAECAVDSAHGQSSENENAQIIREVEVDKVSAISRDQVAAIKQLWLDPGIQECYDRRREYQLSDSAKYYLTDIDRIAMPSFVPTQQDVLRVRVPTTGIIEYPFDLENIIFRMVDVGGQRSERRKWIHCFESVTSIIFLVALSEYDQVLAECDNENRMEESKALFKTIITYPWFLNSSVILFLNKKDLLEEKIMYSHLISYFPEYTGPKQDVKAARDFILKLYQDQNPDKEKVIYSHFTCATDTENIRFVFAAVKDTILQLNLREFNLV

SEQ ID NO: 20077 - protein, 234 aa, Rattus norvegicus
MAEAVPVPQLRPVTHLIFDLDGLLLNTEDLYTDVFQAICSRYGKKYNWDVKSLVMGKKAPETTQIIVDFLKLPISKEQLLEESQERLQKVLHTAALMPGAEELIHHLRKNRLPFALATSSATLSFQTKTSRYKGFFSLFHHIVLGDDPEVINSKPAPDIFLTCAKRFSPPPNPEDCLVFEDSPNGVEAAVACGMQVVMVPHENLSSDLTTKATLVLSSLHEFKPELFGLPAFDE

SEQ ID NO: 20078 - protein, 175 aa, Rattus norvegicus
MHRDSCPLDCKVYVGNLGNNGNKTELERAFGYYGPLRSVWVARNPPGFAFVEFEDPRDAADAVRELDGRTLCGCRVRVELSNGEKRSRNRGPPPSWGRRPRDDYRRRSPPPRRRSPRRSFSRSRSSFSLLESALWGVICSLGQFQLRTSSQPEEATESFLQEERAPSETVLKTRF

SEQ ID NO: 20079 - protein, 833 aa, Rattus norvegicus
MVATGVLVQTMAKGRDEDPPYYPLKGQWGSAWFDSIAPLLPLSMLATVGTMVHMDRIPMIQRAKGTKRVFWLPVRQSPQQYDAIVDSSGVTMLHLAALASLKGDIVELNKRLQQTERERDLLEKTLAKAQCEQSHLMREHEDVQERTTLRYEERITELHSIIAELNKKIDRLQGTTIREEDEYSELRSELSQSQQEVNEDSRSVDQDQTSVSIPENQSTMVTADMDNCSDLNSELQRVLTGLESVVCGRKKSSCSLSVAEVDRHIEQLTTASEHCDLAIKTVEEIEGVLGRDLYPNLTEERSRWEKELAGLREENESLTAMLCSKEEELNRTKATMNAIREERDRLRRRSSDGEIFEVDVQIAKQSVTIKTMLEDMGMDDEGADGPGPLSNCSNSKRRSFSGAPSRRMALCSEDEENKEKRTDDITVQDQGFLKVDQGTLLELILAANYLDIKGLLDVTWKTVANMIKGKTLEKIRKTFHIKNDFTVEVEAEAQVRELQTRLQSVQATGPSSPGRLTPANRPINPSTGELSTSSSSNDIPIAKVSSSVAEHLAHSLQDCSNIQEIFQTLYSHGSAISESKIREFEVETERLNSRIEHLKSQNDLLTITLEECKSNAERMSMLVGKYESNATALRLALQYSEQCIEAYELLLALGETEQSLILGQFRAAGVGSSPGDQSGDENITQMLKRAHDCRKTAENAAKALLMKLDGSCGGAFTVAGCSVQPWESLSSNSHTRYCSRLCPAPLPAVGFSLACSRKPCDLDKAGGFMVTAKSYKEGSVNDASVQSTVRRDRTVEYGRDRTRAQSLPYTLLPILLCSLWLYYSPFLGITWSD

SEQ ID NO: 20080 - protein, 717 aa, Rattus norvegicus
MGPAMLRAFSSWKWLLLLMVLTCLEASSYVNESSSPTGQQTPDARFAASSSDPDERISVFELDYDYVQIPYEVTLWILLASLAKIGFHLYHRLPHLMPESCLLIIVGALVGSIIFGTHHKSPPVMDSSIYFLYLLPPIVLESGYFMPTRPFFENIGSILWWAGLGALINAFGIGLSLYFICQIKAFGLGDINLLQNLLFGSLISAVDPVAVLAVFEEARVNEQLYMMIFGEALLNDGISVVLYNILIAFTKMHKFEDIEAVDILAGCARFVIVGCGGVFFGIIFGFISAFITRFTQNISAIEPLIVFMFSYLSYLAAETLYLSGILAITACAVTMKKYVEENVSQTSYTTIKYFMKMLSSVSETLIFIFMGVSTVGKNHEWNWAFVCFTLAFCQIWRAISVFTLFYVSNQFRTFPFSIKDQLIIFYSGVRGAGSFSLAFLLPLSLFPRKKLFVTATLVVTYFTVFFQGITIGPLVRYLDVRKTNKKESINEELHIRLMDHLKAGIEDVCGQWSHYQVRDKFKKFDHRYLRKILIRRNQPKSSIVSLYKKLEMKQAIEMAETGLLSSVASPTPYQSERIQGIKRLSPEDVESMRDILTRNMYQVRQRTLSYNKYNLKPQTSEKQAKEILIRRQNTLRESLRKGQSLPWVKPAGTKNFRYLSFPYSNPQPARRGARAAESTGNPCCWLLHFLLCRAMVEKIWGPGGQETQPRLLCRNLN

SEQ ID NO: 20081 - protein, 207 aa, Rattus norvegicus
MHKAIRGYLENNPALEKLLPHFRGNVSFAFTTEDLTEIRAMLLTSKVPAAALAGAIASCEVTAHAQNTGLAPEKTSFFQASGITTKISRVTIEILSDVQLIKPGDKVFDNGSIYNPDMLDITNQILHSHFLEGVCNMTRVCLQVGYSTVATGPHSIISGYKQDELRTRFHWSLTKWQTMGKTTSFDYAKLKKIETIEEHIPIKKTIE

SEQ ID NO: 20082 - protein, 982 aa, Rattus norvegicus
MLGVYAVKVDRKEKTQRQWWRFLKGFMEMRLGQTWGYGMRVRLSEDMDVCQECAKSLEESLGRAEDVSSPQEEEDSNRDGQANPCGSCDASIDQRDSREALYGTWKLRCGIHSMFPLHLAALNAHSDCCRKLLSSGQKYSIVSLFSNEHVLSAGFEIDTPDTFGRTCLHAAAAGGNVECIKLLQSSGADFHKKDKCGRTPLHYAAANCHFHCIKALVTTGANINETDNWGRTALHYAAASDMDRNKMILGNAHDNSEELERAREVKGKDAALCLEFLLQNDANPSIRDKEGYNSIHYAAAYGHRQCLELKSPWKHNAVILFPSKTQRAVPAQRVESINVTHGTECFRADHLSPFQGDCHLLQSSVTQCMTPASLALQGVLVLIDKDNGESMIFVEPEDCMSPLRGRPSPRGQVNPQAQNLPPCSIFIVSLEMCPCFRNHNSLVTLAFNFPQLLERTNTGFEESDGGALKSPLHLAAYNGHHQALEVLLQSLVDLDIRDEKGRTALYLAAFKGHTECVEALVNQGASIFVKDNVTKRTPLHASVINGHTLCLRLLLEIADNPEVVDVKDAKGQTPLMLAVAYGHIDAVSLLLEKEANVDAVDTVGCTALHRGIMTGHEECVQMLLEQEASILCKDSRGRTPLHYAAARGHATWLNELVQIALSEEDCCLKDNQGYTPLHWACYNGNENCIEVLLEQKCFRKFIGNPFTPLHCAIINGHESCASLLLGAIDSSIVSCRDDKGRTTLHAAAFGDHAECLQLLLRHDAQVNAVDNSGKTALMMAAENGQAGAVDILVNSAQADLTVKDKDLNTPLHLAISKGHEKCALLILDKIQDESLINAKNSALQTPLHIAARNGLKVVVEELLAKGACVLAVDENGHTPALACAPNKDVADCLALILATMMTFSPSSTMTAVNFVYFRKDNLSRRTLSNMGSRVSLCSNNLDSEVSSCGTCHCSRTRTPDGSATLVVFHTVEQFGLCIRGAC

SEQ ID NO: 20083 - protein, 106 aa, Rattus norvegicus
MKGDYVRYLAEIACGDDQKQTIENSQGAYQEAFDISKKEMQLTHLIRLGLALHSSVFYYEILNNPELACTLAKTAFDEAIAELGALNEDSYNDSILIMQLLRDNLT

SEQ ID NO: 20084 - protein, 221 aa, Rattus norvegicus
MAGKKVLLVYAHQEPKSFNGSMKQVAVEELSKQGCTVTVSDLYTMNFEPRATRNDVTGALSNPEVFKYGIEAYEAYKKKALTSDILEEQRKFPLYWFSVPAILKGWMDRVLCQGFAFDVPGFYDSGFLKDKLALLSFTTGGTAEMYTKAGVNGDFRYFLWPLQHGTLHFCGFKVLAPQISFGPEVSSEEQRKVMLASWVQRLKSIWKEEPIHCTPSWYFQG

SEQ ID NO: 20085 - protein, 508 aa, Rattus norvegicus
MLGAAGTALLCAGLLLGLAQQLWTLRWTLSRDWASTLPLPKGSMGWPFFGETLHWLVQGSRFHSSRRERYGTVFKTHLLGRPVIRVSGAENVRTILLGEHRLVRSQWPQSAHILLGSHTLLGAVGERHRQRRKVLARVFSRPALEQFVPRLQEALRREVRSWCAAQRPVAVYQAAKALTFRMAARILLGLQLDEARCTELAQTFERLVENLFSLPLDVPFSGLRKGIRARDQLYQHLDEVIAEKLREELTAEPGDALHLIINSARELGRELSVQELKELAVELLFAAFFTTASASTSLILLLLQHPAAIAKIQQELSAQGLGSPCSCAPRASGSRPDCSCEPDLSLAVLGRLRYVDCVVKEVLRLLPPVSGGYRTALRTFELDGYQIPKGWSVMYSIRDTHETAAVYRSPPEGFDPERFGVESEDARGSGGRFHYIPFGGGARSCLGQELAQAVLQLLAVELVRTARWELATPAFPVMQTVPIVHPVDGLLLLFHPLPTLGAGDGSPF

SEQ ID NO: 20086 - protein, 366 aa, Rattus norvegicus
MALLRRPTVSSDLKNIDTGVNPKAKSHVTVRRAVLEEIGNKVRARPAQVAKKPQNTKVPVQPTKAINASKQPKPTASVKPVQMETLAPKDPLPAPEDVSMKEESLCQAFSDALLCKIEDIDNEDGENPQLCSDYVKDIYQYLRQLEALQSINPHFLDGRDINGRMRAILVDWLVQVHSKFRLLQETLYMCIAIMDRFLQAQPVCRKKLQLVGITALLLASKYEEMFSPNIEDFVYITDNAYTSSQIREMETLILKELKFELGRPLPLHFLRRASKAGEVDVEQHTLAKYLMELTLVDYDMVHYHPSQVAAAASCLSQKVLGQGKWNLKQQYYTGYMESEILEVMQHMAKNVVKVNENLTKFIAVKN

SEQ ID NO: 20087 - protein, 605 aa, Rattus norvegicus
MGTACSSFALSDTWSPAGEQADEQGRWESPPGRAPGEEKVFITLQRHRITQRLPFSLRKDNTQPNYIFLQSSLPVTNYNHLRRVSQPLIRTLTLLKFPRGAGAECQTDVLNHSENYLGNLVTLIETLGTRTVTSQDRKTIFTNQDSQSQSLRHRNDDIIFSINIAYLLTSSNVYYWHYATAKLQEFRSEMLSLPLEGQWVWPPLHLKSKETNLFWGKSVLNQNEFITPSGSAASMSDKLPYKVEDIGLAAWGWKALHIAENEMLGLMLMREMYSASKPLKGARIAGCLHMTVETAVLIETLMTLGAECLPGRERHEEYLWCIEQTLHFKDGPLNMILDGGGDLTNLIHTKYPQLLSGIHGISEETTTGVHNLYKMMANGILKVPAINVNDSVTKSKFDNLYGCRESLIDGIKRATDVMIAGKVAVVAGYGDVGKGCAQALQGFGIDPINALQAAMEGYEVTTVDEAYKEGNILVTTTGCVDIILGWHFEQMKDDASVCNIGHFDVEIDAKWLNENTVEKVNIKPSFVMSNSFTNQICLLTPDLPTGQLLGSVSWLIRHVTFLSPSTNLLPKKVSVQRNGEAIYLSIFNCDLNPTVHPSPLPSSTP

SEQ ID NO: 20088 - protein, 117 aa, Rattus norvegicus
MGKGVELRYLATQYMSGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 20089 - protein, 138 aa, Rattus norvegicus
MQLSPESKVFYLKMKGDYFRCLAEVACGDDRKQTIGNPQGAYQEAFDISKKEMQLTRPIRLGLALHSPVFYYESLNNPEPAYTLAKMAFDEAIAELETLNEDSYKDSALVTQLLRDNLTLWTSDSAGEECDAADGAEN

SEQ ID NO: 20090 - protein, 235 aa, Rattus norvegicus
MCIWLPVEVRMCQSPYSVLVHDKCSRGHSSSTWEGCSLWIISGHSGQQAGFPVVPQQLKLEWQKLVDGGLPIGGVGAWPSDCRVGDPRRITIGDCLYSEKSVGRSYGHKRKKQLGLWCWYCNRDFDDEKILIQHQKAKLFKCHICHKKLYTGPALAIHACSKVTSHQSLSQDCIQFQGHQDCLQYGGHHQGMPGYLPGTMPPYGQGPPMVPPYQGGPLRPPRGMRPPEMSQGGCY

SEQ ID NO: 20091 - protein, 351 aa, Rattus norvegicus
MALEIMNCSHEKQNVLQTFAYYLLAQNYCSIPSRESGLGIPASWVTSCSLQITDVERADSSNPAQEEKKSNPNGRNSNKDNFSMSSGVAADAFDSQARDQTEWDVDFTLLCKLQDIKMYINMKVLGSDSFGIKSSVTMVVGSKIFQEKASHRRSRLGSKVTRLSPWQLTSGPIFWDISFKGFRPILSTVSVQAPTASPRLGYSSKERSHVTHTVAIQNRTAVGETDNQAGEDPGKAKTKAVSRSQRAGSQFPVGRSHRHLKSRTISHGRVGAPAAVYSAAVLEFLTAEVLELEGNASKDLKGKRITPRHLQLAIRGHDDLGSLIKATIADVGVIPHIHKSLIGKKGRQKTV

SEQ ID NO: 20092 - protein, 481 aa, Rattus norvegicus
MASNSKKKTMESQYKVLFTLGKGSFGTVKLALHLKTEALVAIKTVELNKKTIRGILAEIATLETLHHPKIVSLFQILVTSRHINFITEYVPGANLFEIIKEEGPLQEEEAKVTFGQIVSAVKHCHSLDIAHRDIKPQNILRDQGGNVKLIDFGLATKCRSGTLLKQRCGTKGFYAPELIQGEPYDAKKTDVWSLGVLLYFIIIGYYPFRGSTMNEIEKKISTGTYDIPSHVSGQLENLIHQILTLSPEMRPSIEDIERHPWVEKCELKVPTVMDPDYNIIDMLCGMGFKTNEILESLQRKKYDEPMGAYLILKYQVNKGIELGSPTSAKPVDPCPAPPPSPAHPTISGLPLKRRASEPNFSLFHIRPSGKHGSVALALSGYKVARSVSMPPISPDCTNKKNSASIRALYSGPVADPRICSSILEDRLSVPSDQDSDIETSQNIGCVKRLGKSIRACLSGLCCPQGSEGKEPSIHPPRKWLP

SEQ ID NO: 20093 - protein, 619 aa, Rattus norvegicus
MSGSNGPTDTRAYQSLAEDCPFGSAEQPKRSTGRLVMHSMAMFGREFCYAVEAAYVTPVLLSVGLPKSLYSMVWLLSPILGFLLQPVVGSASDHCRARWGRRRPYILTLGVMMLLGMALYLNGDAAVSALVANPRQKLVWAISITMIGVVLFDFSADFIDGPIKAYLFDVCSHQDKEKGLHYHALFTGKVVSVPSASGQKNCFPSEEDGGNTLGLVSFYFRKEAQERYSPYVDLNYGLGTRPINEPEMHSSLILNQEKKPESGFMSPVRKRGVSHLGFGGALGYLLGAIDWMHLELGKLLGTEFQVMFFFSALVLTLCFITHLCSIPEDPLRDDATDPPLQPDPQGSSLSADGMPRYGSIEKVKNGDADTGLPVQGGKNKKPSGQSQRTMSMKSLLRALVNMPSHYRCLCISHLIGWTAFLSNMLFFTDFMGQIVYHGDPYGAHNSTEFLIYERGVEVGCWGLCINSVFSSVYSYFQKVMVSYIGLKGLYFMGYLLFGLGTGFIGLFPNVYSTLVLCSMFGVMSSTLYTVPFNLIAEYHREEEKEKQQEVPGGPDNHGRGKGVDCAALTCMVQLAQILVGGGLGFLVNMAGSVVVVVITASAVALIGCCFVALFVRYVD

SEQ ID NO: 20094 - protein, 432 aa, Rattus norvegicus
MELRVLIEPQVKRVTIVGTTYSQELFETPLFQESRATIHNSRLGGKRPNGSQALKTKPAELSHGKMETYSKGDKELMQSDLHKIIVSPQPLSSDHVKVFLYQILRGLKYLHSAGILHRDIKPGNLLVNSNCVLKICDFGLARVEELDESRHMTQEVVTQYYRAPEILMGSRHYSNAIDIWSVGCIFAELLGRRILFQAQSPIQQLDLITDLLGTPSLEAMRTACEGAKAHILRGPHKQPSLPVLYTLSSQATHEAVHLLCRMLVFDPSKRISAKDALAHPYLDEGRLRYHTCMCKCCFSTSTGRVYTSDFEPVTNPKFDDTFEKNLSSVRQVKEIIHQFILEQQKGNRVPLCINPQSAAFKSFISDVDRAFLVLTLLLDQTVYEINHPVIQMMRCSSTFLVLAIVLPGPGRKVIAIPFYLATLDLGSNNTGP

SEQ ID NO: 20095 - protein, 455 aa, Rattus norvegicus
MSQISMPVQENNLVLPCGLQDGLFSRERLHTEEKNRVTIVGTTYSQELFETPLFQESRATIHNSRLGGKRPNGSQALKTKPAELSHGKMETYSKGDKELMQSDLHKIIVSPQPLSSDHVKVFLYQILRGLKYLHSAGILHRDIKPGNLLVNSNCVLKICDFGLARVEELDESRHMTQEVVTQYYRAPEILMGSRHYSNAIDIWSVGCIFAELLGRRILFQAQSPIQQLDLITDLLGTPSLEAMRTACEGAKAHILRGPHKQPSLPVLYTLSSQATHEAVHLLCRMLVFDPSKRISAKDALAHPYLDEGRLRYHTCMCKCCFSTSTGRVYTSDFEPVTNPKFDDTFEKNLSSVRQVKEIIHQFILEQQKGNRVPLCINPQSAAFKSFISDVDRAFLVLTLLLDQTVYEINHPVIQMMRCSSTFLVLAIVLPGPGRKVIAIPFYLATLDLGSNNTGP

SEQ ID NO: 20096 - protein, 337 aa, Rattus norvegicus
MDDRKLVRYRLPRAYVSPERGTHGDEAADHDLRIHRLMADEADLTSALTRKTTLKTPLISSPMDTVTEADMAIAMALMGGIGFIHFNCTPEFQANEERKVKKFEQVFITDPVVLSPSHTQEGKLPIVNDQGELVAIIARTDLKKNRDYPLASKDFHKYLLCGTSVDTHEDSKYHVDLLTQSSADFIVLDSSQGNSVYQIAMELMACGRPQGTAVYKVGEYARRFGVLVIADGGIQTVGHVVKALALGASTVLAATTEAPGKYSFSDGGSIQDKGCIQKFVPYLIAGIQHGCQYTGAQSLCILRSMMYSGELKFEKQTMSAQIEGSVHGLGSYEKWVY

SEQ ID NO: 20097 - protein, 510 aa, Rattus norvegicus
MLCQQRSPGARPCWLISLQHRVACVVLSWAAAWQRRKLEQSTLNVSQSQQQALMGCLKEAQGSCCLPRENTDMTTFRNLPLTKTSHTQQKESEEKLLPPTLPQYHGDASLQATLLGLMTLNKAYPEVLAPGSTACVTPTSPWPYSVPWLGHALGRVSPIGAKDARTLLLEALISPGLRVLEARTAVELLDVFVGLEADGEELAEVIASGSLGKLPRRAAELQEALEQGPRGLALRLWPKLQVVVTLDAGGQAEAVAALRVLWCQGLAFFSPAYAASGGVMALNLWPEQPQGSYLLSPGVPFIELLPIKEGTQEEAASTLLLTDVRREEKYELVLTDSTSLTRCRLGDVVQVIGTYNQCPVVRFTCRLGQTLSVRGEVTDENVFSVALAQAVGQWPGAKLLDHVCVESHILDSYEGSAPHYEVFVELRGLRNLSEENRDKLDHCLQEASPRYKSLRFWGSVGPAKVHLVRPGSFRVLREALAACPSSSCPEMPRVLRLRHLAQLLQKRVIP

SEQ ID NO: 20098 - protein, 764 aa, Rattus norvegicus
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDATTKEVKDSLGKQWSQLSDKKRLKWIHKALEQRKEYEEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQTTSPASKKPSQEGGKGGSEKPKRPVSAMFIFSEEKRRQLQEERPELSESELTRLLARMWNDLSEKKKAKYKAREAALKAQSERKPGGEREDRGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQRQYKVHLDLWVKSLSPQDRAAYKEYISNKRKNMTKLRGPNPKSSRTTLQSKSESEEDDDEEDDDDDDEEEEEDDENGDSSEDGGDSSESSSEDESEDGDENEDDDDDEDDDEDDDEDEDNESEGSSSSSSSSGDSSDSDSN

SEQ ID NO: 20099 - protein, 166 aa, Rattus norvegicus
MIAMDPQQRPSAKHVLKHPFFWSLEKQLQFFQDVSDRIEKESLDGPIVRQLERGGRAVVKMDWRENITVPLQTDLRKFRTYKGGSVRDLLRAMRNKRHHYRELPLEVQETLGSIPDDFVRYFTSRFPHLLSHTYRAMELCRHERLFQTYYWHEPTEAQPPGIPDAL

SEQ ID NO: 20100 - protein, 782 aa, Rattus norvegicus
MRGLFRFTSQPQTIAFPVFPRYSNKSFGRASTVTLPEALLFVSTLDGSLHAVSKRTGSIKWTLKEAHQPEQLLLGKSGLGQGVSGMQLPWGTGGSDLQRCSAGEDPVLQVPTHVEEPAFLPDPNDGSLYTLGGKNNEGLTKLPFTIPELVQASPCRSSDGILYMGKKQDIWYVIDLLTGEKQQTLSSAFADSLCPSTSLLYLGRTEYTITMYDTKTRELRWNATYFDYAASLPEDDVDYKMSHFVSNGDGLVVTVDSESGDVLWIQNYASPVVAFYIWQREGLRKVVHINVAVETLRYLTFMSGEVGRITKWKYPFPKETEAKSKLTPTLYVGKYSTSLYASPSMVHEGVAVVPRGSTLPLLEGPQTDGVTIGDKGECVITPSTDLKFDPGLKGKSKLNYLRNYWLLIGHHETPLSASTKMLERFPNNLPKHRENVIPADSEKRSFEEDVEEKLPRAPAKPEAPVDSMLKDMATIILSTFLLVGWVAFIITYPLSMHQQRQLQHQQFQKELEKIQLLQQQQLPFHPHGDLTQDPDFLDSSGLFSESSGTSSPSPSPRASNHSLNSSSSASKAGTSPSLEPDDEDEETRMVIVGKISFCPKDVLGHGAEGTIVYKGMFDNRDVAVKRILPECFSFADREVQLLRESDEHPNVIRYFCTEKDRQFQYIAIELCAATLQEYVEQKDFAHLGLEPITLLHQTTSGLAHLHSLNIVHRDLKPHNILLSMPNAHGRIKAMISDFGLCKKLAVGRHSFSRRSGVPGTEGWIAPEMLSEDCKENPTFKSC

SEQ ID NO: 20101 - protein, 353 aa, Rattus norvegicus
MSLHGKRKEIYKYEAPWTVYAMNWSVRPDKRFRLALGSFVEEYNNKGFVSHVGESCEEWPHKALKSAVEEQSGTIHTDLRRHSYSNGDYLRVWRVGETETRLECLLNNNKNSDFCAPLTSFDWNEVDPYLLGEGFEFQLEENEDTFPQIRPIDTTCTIWGLETGQVLGRVNLVSGHVKTQLIAHDKEVYDIAFSRAGGGRDMFASVGADGSVRMFDLRHLEHSTIIYEDPQHHPLLRLCWNKQDPNYLATMAMDGMEVVILDVRVPCTPVARLNNHRACVNGIAWAPHSSCHICTAADDHQALIWDIQQMPRAIEDPILAYTAEGEINNVQWASTQPDWIAICYNNCLEILRV

SEQ ID NO: 20102 - protein, 631 aa, Rattus norvegicus
MLSLNADEQEALDSIMKDLVALQMSRRPRVSGYETMKNKDTGHPNRQSDVRIKFEHNGERRIIAFSRPVRYEDVEHKVTTVFGQPLDLHYMNNELSILLKNQDDLDKAIDILDRSASMKSLRILLLSQDRNHTSSSPHSGVSRQVRVKPSQSAGDINTIYQAPEPRSRHLSVSSQNPGRSSPPPGYVPERQQHIARQGSYTSINSEGEFIPETSEQCMLDPLSSAENSLSGSCQSLDRSADSPSFRKSQMSRARSFPDNRKECSDRETQLYDKGVKGGTYPRRYHVSVHHKDYNDGRRTFPRIRRHQGNLFTLVPSSRSLSTNGENMGAAVQYLDPRGRLRSADSENALTVQERSVPTKSPSAPINWRRGKLLGQGAFGRVYLCYDVDTGRELASKQVQFDPDSPETSKEVSALECEIQLLKNLQHERIVQYYGCLRDRAEKILTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLVY

SEQ ID NO: 20103 - protein, 378 aa, Rattus norvegicus
MLVQILSSLPGGGRSFGFSLVNSPLRPFDCKYNPVIECSHTYVCASQPSLELQPMFQGKRALVSFQVVSGPCKQKQILLGNRSEFRPTIYSNVIKGMRVLVDAREKLHIPWGDNKNQVHGDKLMAFDTRAPMAAQGMVETRVFLQYLPAIRALWDDSGIQNAYDRRREFQLGESVKYFLDNLDKLGVPDYIPSQQDILLARRPTKGIHEYDFEIKNVPFKMVDVGGQRSERKRWFECFDSVTSILFLVSSSEFDQVLMEDRLTNRLTESLNIFETIVNNRVFSNVSIILFLNKTDLLEEKVQVVSIKDYFLEFEGDPHCLRDVQKFLVECFRGKRRDQQQRPLYHHFTTAINTENIRLVFRDVKDTILHDNLKQLMLQ

SEQ ID NO: 20104 - protein, 298 aa, Rattus norvegicus
MTDAAVSFAKVFLAGGVAAAIFKMVVAPIKCVKLLLQVQHASKQITADKQYKGIMDGVVRIPKEQGVLSFWRGNLASVIRYFPTQALNFAFKDKYKQIFLGGVDKRTQFWRYFAGNLASGGAAGATSLRFVYPLDFARTSLAADVGKAGAEREFKGLGDYLVKIYKSDGIKGLYHGFNVSVQGIIIYQAAYFGIYDTAKGMLPDPKNTHIFISWMIAQSVTSVAGLTSYPFDTVPRHMMMQSGHKGTDIVHTGTLDCWRKIAPDEGGKAFFKGAWSNVLRGMGGAFVLVLYDEIKKDT

SEQ ID NO: 20105 - protein, 1020 aa, Rattus norvegicus
MDLTLSRADYLQVNRSAGALTGGRGPGEATVPPGRVSSEGTGHLFTITVSVDSESPYVFQVVIGDQDGVVMCFGMKKGEAVSVFKTLPGQKVSRLELGGALNTPQEKIFIAAGSEIRGFTKRGKQFLSFETNLTESIKAMYISGSDLFLSASYIYNHYCDCKDQNYYLSGDKINDVICLPVERLSRVTPVLACQDRVLRVLQGSDVTYEIEVPGPPTVLALHNGDGGDSGEGLLFGTSDGRLGLIQITASKPIHKWEIRNDKKRGGILCLDSFDIMGDGVKDLLVGRDDGMVEVYSFENANEPVLRFDQMLSESVTSVQGGCVGKDGYDEIVLATYSGWVTGLTTEPTHKESGPGEELKLNQEMQNKIASLRTELEHLQLKVLQERENYQQSSQSSQAKSTVPSFSINDKFTLNKDDASYSLVLEVRTAIDNVLIQSDVPIDLLDVDKNSAVVSFSSCDTESNDNFLLATYRCQANTTRLELKIRSIEGQYGTLQAYVTPRIQPKTCQVRQYHIKPLSLHQRTHFIDHDRPMNTLTLTGQFSFAEVHSWAVLCLPEVPEKPPAGECATFYFQNTFLDTQLECAYSACSVRRPPGSRAARERRAPCTLCRRRIRTGAAMPGNSRQAGSALLSQQEDQENVNPEKVAPAQQPRAQAVLKAGKVRGPAPQQRLKTRRVAPLKDLPINDEHVPTVPSWKAVSKQPAFTIHVDEAEETQKRPAEQKETQCEDALAFSAAVSLPGARKPLVPLDYPMDGSFESPHAMDISIVLEDEKPVNVNEVPDYHEDIHTYLREMEVKCKPKVSYMKRQPDITNSMRAILVDWLVEVGEEYKLQNETLHLAVNYIDRFLSSMSVLRGKLQLVGTAAMLLASKFEEIYPPEVAEFVYITDDTYSKKQVLRMEHLVLKVLAFDLAAPTVNQFLTQYFLHLQPANCKVESLAMFLGELSLIDADPYLKYLPSLIAGAAFHLALYTVTGQSWPESLVQKTGYTLESLKPCLMDLHQTYLKAPQHAQQSIREKYKHSK

SEQ ID NO: 20106 - protein, 192 aa, Rattus norvegicus
MTDAAVSFAKVFLAVGVTAAIFKMVVAPIECVMLQVQHASKQISADKQYKGIMYCVVRIPKEQGVLSFWHGNLANVIRYFPTQALNFVFKDKYKQIFLGGVDKRTQFWRYFAGNLASGGAAGATSLRFVYPLDFARSRLAADVGKAGAERDFKGLGDYLVTIYKSDGIKGLYHGFNVSVQGIIIYRAAYFGI

SEQ ID NO: 20107 - protein, 464 aa, Rattus norvegicus
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDESAASTSFQPQPVQPQQGYIPPMAQPGLPPVPGAPGMPPGIPPLMPGVPPLMPGMPPVMPGMPPGLHHQRKYTQSFCGENIMMPMGGMMPPGPGIPPLMPGMPPGMPPPVPRPGIPPMTQAQAVSAPGILNRPPAPTAAVPAPQPPVTKPLFPSAGQAQAAVQGPVGTDFKPLNSTPAATTTEPPKPTFPAYTQSTASTTSTTNSTAAKPAASITSKPATLTTTSATSKLIHPDEDISLEERRAQLPKYQRNLPRPGQTPIGNPPVGPIGGMMPPQPGIPQQQGMRPPMPPHGQYGGHHQGMPGYLPGAMPPYGQGPPMVPPYQGGPPRPPMGMRPPVMSQGGRY

SEQ ID NO: 20108 - protein, 380 aa, Rattus norvegicus
MLLSIGMLMLSATQVYTILTVQLFAFLNLLPVEADILAYNFENASQTFEDLPARFGYRLPAEGLKGFLINSKPENACEPIVPPPLKDNSSGTFIVLIRRLDCNFDIKVLNAQRAGYKAAIVHNVDSDDLISMGSNDIDILKKIDIPSVFIGESSANSLKDEFTYEKGGHVILVPELSLPLEYYLIPFLIIVGICLILIVIFMITKFVQDRHRNRRNRLRKDQLKKLPVHKFKKGDEYDVCAICLEEYEDGDKLRILPCSHAYHCKCVDPWLTKTKKTCPVCKQKVVPSQGDSDSDTDSSQEENQVSEHTPLLPPSASARTQSFGSLSESHSHHMTESSDYEDDDNEETDSSDADNEITDHSVVVQLQPNGEPDYNIANTV

SEQ ID NO: 20109 - protein, 112 aa, Mus musculus
LEQYNLVFIMSGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 20110 - protein, 107 aa, Mus musculus
SKYTMSGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 20111 - protein, 221 aa, Rattus norvegicus
MEAGGVADSFLSSACVLFTLGMFSTGLSDLRHMQRTRSVDNIQFLPFLTTDVNNLGWLSYGVLKGDGTLIIVNTVGAVLQTLYILAYLHYSPQKHAVLLQTATLLAVLLLGYGYFWLLVPDLETRLQQLGLFCSVFTISMYLSPLADLAKIIQTKSTQRLSFSLTIATLLSSTSWSIYGFRLKDPYITVPNLPGILTGFIRLVLFYKYPPEQDTKYRLLQT

SEQ ID NO: 20112 - protein, 134 aa, Rattus norvegicus
MTLRGKHKCIENVSRQNCPICLEDIHTSRVVAHVLPCGHLLHRTCYEEMLKEGYRCPLCMHSALDMTRYWRQLDIEVAQTPMPSEYQNVTVDILCNDCNGRSTVQFHILGMKCKLCDSYNTAQAGGRTVSMDEQ

SEQ ID NO: 20113 - protein, 443 aa, Rattus norvegicus
MTEPRGCGEIGGQIASVRTAEDTKWRLTILLSHVTCLQDFFGDDDVFIACGPEKYRYAQDDFVLDHSVNGTPSSQLSTPKSTKSSSSSPTSPGSFRGLKISAQGRSSSNVNGGPELDRCMSPEGVNGNRCSESFTLLEKYRIGKVIGDGNFAVVKECMDRSTGKEFALKIIDKAKCCGKEHLIENEVSILRRVKHPNIIMLVEEMETTTELFLVMELVKGGDLFDAITSSTKYTERDGSAMVYNLASALRYLHGLSIVHRDIKPENLLVCEYPDGTKSLKLGDFGLATVVEGPLYTVCGTPTYVAPEIIAETGYGLKVDVWAAGVITYILLCGFPPFRSENNLQEDLFDQILAGKLEFPAPYWDNITDSAKELISQMLQVNVEARCTAGEILSHPWVSDDASQENNMQAEVTGKLKQHFNNALPKQNSTTTGVSVIMDRKQPS

SEQ ID NO: 20114 - protein, 776 aa, Xenopus laevis
MTTRTPLPTVNERDADQPALGHADQKTSSSGSSKPNMLRCRTSIATTADEQPHIGNYRLLKTIGKGNFAKVKLARHVLTGKEVAVKIIDKTQLNSSSLQKLFREVRIMKVLNHPNIVKLFEVIETEKTLYLIMEYASGGEVFDYLVAHGRMKEKEARAKFRQIVSAVQYCHQKLIVHRDLKAENLLLDSDMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMRDRWMNVGHEEDELKPYVEPIPDYKDPKRTELMITMGYSREEISDSLVNQKYNEVMATYLLLGYRTSEMDNDNLTLKPRPPPDISNSIVTSPAHKVQRSVSANPKQRRLSDQAGPAIPNSNSYSKKTQSNNAENRRPEDEKESGRKSSSTVRVPPSPLSGLDRKKTTPTPSTNSVLSTGTNRSRNSPMLDRASLVPGSVQNGKDSFSTPGSRASTASAPATSARIRQHQKSMSTSVHPSKPAPSLEGNCDVQRPSTAPQRVPVASPSAHNISSSATERTNFPRGVSSRSTFHAGQVRQARDQQNLGFGSVSPASPSGNSQGRRGATGSIFSKFTSKFVRRNPNEPEVKDRVESTRPHLSVVDKEKDKEDHRDSKPRSLRFTWSMKTTSSMEPNEMMREIQKVLDANNCQHESQEKYMLLCIHGSPGHDNYVQWEMEVCKLPRLSLNGVRFKRISGTSMAFKNIASKIANDLKL

SEQ ID NO: 20115 - protein, 460 aa, Xenopus laevis
MNSFSNDDFDFSFLEEGFSARDIVEQKINEVSLSDDKDAFYVADLGDIVKKHVRWFKALPRVTPFYAVKCNDGKAIVKTLSILGAGFDCASKTEIQLVQSIGVSPERIIYANPCKQVSQIKYAASCGVEKMTFDSEVELMKVARNHPNAKLVLRIATDDSKAVCRLSVKFGATLKTSRLLLERAKELNVDIIGVSFHVGSGCTDPQTYVQAVSDARCVFDMGAELGFNMHLLDIGGGFPGSEDVKLKFEEITSVINPALDKYFPADSGVKIIAEPGRYYVASSFTLAVNIIAKKVMVNEQSGSDDEEDAANDKTLMYYVNDGVYGSFNCILFDHAHVKPVLTKKPKPDEKFYSSSIWGPTCDGLDRIVERFELPELQVGDWMLFENMGAYTVAAASTFNGFQRPTLYYVMSRPHWQLMHDIKEHGILPEVPDLSALHVSCAQESGMELAPAVCTAASINV

SEQ ID NO: 20116 - protein, 291 aa, Xenopus laevis
MELLCCEVDTIRRAHLDRNLITDRVLQTMLKAEETSCPSVSYFKCVQKEVLPNMRKIVATWMLEVCEEQKCEEEVFPLAMNYLDRFLSVEPLRKSRLQLLGATCMFLASKMKETIPLTAEKLCIYTDNSIRPDELLLMELLILNKLKWDLASVTPHDFIEHFLNKMPLTEDTKQIIRKHAQTFVALCATDVKFISNPPSMIAAGSVAAAVQGLNLGNADGVFSTQRLTLFLSQVIKCDPDCLRACQEQIESLLESSLRQAQQQHNTSSDTKNMEEEVDISCTPTDVRDVNI

SEQ ID NO: 20117 - protein, 375 aa, Rattus norvegicus
MSLSKKRKLESGVGGAGGEGAEEENGGEQEAAPPRPRRTKRERDQLYYECYSDVSVHEEMIADRVRTDAYRLGILRNWAALRGKTVLDVGAGTGILSIFCAQAGARRVYAVEASAIWQQAQEVVRLNGLEDRVHILPGPVETVELPEQVDAIVSEWMGYGLLHESMLSSVLHARTKWLKEGGLLLPDSAELFVAPISDQMLEWRLGFWSQVKQHYGVDMSCMESFATRCLMGHSEIVVQGLSGEDVLARPQRFAQLELARAGLEQELEAGVGGRFRCSCYGSAPLHGFAIWFQVTFPGGDSEKPLVLSTSPFHPATHWKQALLYLNEPVPVEQDTDISGEITLLPSRDNPRRLRVLLRYKVGDHEEKTKDFAMED

SEQ ID NO: 20118 - protein, 500 aa, Xenopus laevis
MKKFKRRLSLTLRGSQTIDESLSELAEQMTIEENSSKDNGSFKKPPLRRPHSVIGGSLGSFMAMPRNGSRLDIVHENLKMGSDGESDQASGTSSDEVQSPTGVCLRNRIHRRISMEDLNKRLSLPADIRIPDGYLEKLQINSPPFDQPLSRRSRRASLSEIGFGKMETYVKLEKLGEGTYATVFKGRSKLTENLVALKEIRLEHEEGAPCTAIREVSLLKDLKHANIVTLHDIVHTDKSLTLVFEYLDKDLKQYMDDCGNIMSIHNVKIFLYQILRGLAYCHKRKVLHRDLKPQNLLINEKGELKLADFGLARAKSVPTKTYSNEVVTLWYRPPDVLLGSSEYSTQIDMWGVGCIFFEMASGRPLFPGSTVEDELHLIFRLLGTPAEETWPGISSNDEFRNYNFPKYKPQPLINHAPRLDSEGIELLTRFLQYESKKRISAEDAMKHAYFRSLGTKLHSLPENISIFSLKDIQLQKDPGFRNSSYPETGHGKNRRQSMLF

SEQ ID NO: 20119 - protein, 389 aa, Xenopus laevis
MTREEELPDWQTSQDFYEKYEPKEILGRGVSSVVRRCIFKPTREDFAVKIIDITGDHLTSEQIAELRESTIKEIDILNKVSGFSNVIQLKDSYESHTFFFLVFDLMRKGELFDYLTEQVTLSEKETRKIIRSLLEVISKLHGYNIVHRDLKPENILLDDDMNIKLTDFGFSCQIPEGEKLKEICGTPGYLAPEILHCSMDENHPGYGKEVDMWSCGVIMYTLLAGSPPFWHRKQMLMLRMIMSGEYHFGSPEWDDRSDTVKDLIARLLIVNPERRLTADEALVHPFFQQYDVEEVRYFSPLRKFKVVCLTVLASVRIYHYYRKVKPVTREIIVRDPYAFKPIRKMIDGCAFRIYGHWVKKGEQQNRAALFENTAKAILLSLAAESNFTS

SEQ ID NO: 20120 - protein, 716 aa, Homo sapiens
MASSSDSEDDSFMAVDQEETVLEGTMDQDEEPHPVLEAEETRHNRSMSELPEEVLEYILSFLSPYQEHKTAALVCKQWYRLIKGVAHQCYHGFMKAVQEGNIQWESRTYPYPGTPITQRFSHSACYYDANQSMYVFGGCTQSSCNAAFNDLWRLDLNSKEWIRPLASGSYPSPKAGATLVVYKDLLVLFGGWTRPSPYPLHQPERFFDEIHTYSPSKNWWNCIVTTHGPPPMAGHSSCVIDDKMIVFGGSLGSRQMSNDVWVLDLEQWAWSKPNISGPSPHPRGGQSQIVIDDATILILGGCGGPNALFKDAWLLHMHSGPWAWQPLKVENEEHGAPELWCHPACRVGQCVVVFSQAPSGRAPLSPSLNSRPSPISATPPALVPETREYRSQSPVRSMDEAPCVNGRWGTLRPRAQRQTPSGSREGSLSPARGDGSPILNGGSLSPGTAAVGGSLDSPVQAISPSTPSAPEGYDLKIGLSLAPRRGSLPDQKDLRLGSIDLNWDLKPASSSNPMDGMDNRTVGGSMRHPPEQTNGVHTPPHVASALAGAVSPGALRRSLEAIKAMSSKGPSASAALSPPLGSSPGSPGSQSLSSGETVPIPRPGPAQGDGHSLPPIARRLGHHPPQSLNVGKPLYQSMNCKPMQMYVLDIKDTKEKGRVKWKVFNSSSVVGPPETSLHTVVQGRGELIIFGGLMDKKQNVKYYPKTNALYFVRAKR

SEQ ID NO: 20121 - protein, 168 aa, Rattus norvegicus
MCFLFSTFPRTGKCHVQTIQLCRRLTVEFMHYVIAARALRKVFLSIKGIYYQAEVLGQPIVWIAPYAFSHDHPTDVDYRVMATFTEFYTTLLGFVNFRLYQSLNLHYPPKIESQAQAEMKVSEDTYALDSESSMEKLAALSASLARVVVPPVWFMPLSGQRGLCPTQS

SEQ ID NO: 20122 - protein, 267 aa, Rattus norvegicus
MVVVAAAPSAASAAPKVLLLSGQPASGGRALPLMVPGPRAAGSEASGTPQARKRQRLTHLSPEEKALRRKLKNRVAAQTARDRKKARMSELEQQVVDLEEENQKLQLENQLLREKTHGLVIENQELRTRLGMNALVTEEVSEAESKGNGVRLVAGSAESAALRLRAPLQQVQAQLSPPQNIFPWILTLLPLQILSLISFWAFWTSWTLSCFSNVLPQSLLIWRNSQRSTQKDLVPYQPPFLCQWGPHQPSWKPLMNSFVLTMYTPSL

SEQ ID NO: 20123 - protein, 194 aa, Rattus norvegicus
MASKGPSASASTENSSAGGPSGSSNGTGESGGQDSTFECNICLDTAKDAVISLCGHLFWLLLLVFPTWLETRPNRQVCPVCKAGISRDKVIPLYGRGSTGQQDPREKTPPRPQGQRPEPENRGGFQGFGFGDGGFQMSFGIGAFPFGIFATAFNINDGRPPPAVPGTPQYVDEQFLSRLFLFVALVIMFWLLIA

SEQ ID NO: 20124 - protein, 290 aa, Rattus norvegicus
MSDKLPYRVSDFGLAAWEQKALEVAENEMPGLMCMREMNSVSKPLKGAHIASCLHVTVETAVLIETLVALGAEVRCSSCNIFSTQDHAVAAIAKAGTRGISEETMSGAHNLYKMMANEILKVPAINVNDSVAKNKFDNLYGCRESLVDGIKQATDVMVSGKVAALAGYGDVGKVTTMGDACKEGNIFVTTTGCVDIVFGLHFEQMKDDAIVCGSMRTLCICFMMSNSFTSQVVAQIELWTHPDKYPKLDEAVAEAHLGKQNVKLTKLTEKQAQYLGMPVNSPFKPEHYRY

SEQ ID NO: 20125 - protein, 166 aa, Rattus norvegicus
MGCKVAGASRIIGIDINKDKFAKAKEFGATECINPQDFSKSIQEVLIEMTDGGVDFSFECIGNVKVMRSALEAAHKGWGVSVVVGVAASGEEISTRPFQLVTGRTWKGTAFGGWKSVESVPKLVSEYMSKKIKVDEFVTGNLSFDQINKAFDLMHSGNSIRTVLKM

SEQ ID NO: 20126 - protein, 375 aa, Rattus norvegicus
MERDSHTTKTSGDVITCRAAVAWTTNAPLSVEEVTVDPPKACEVRVKIISSGICGTDNHILEGKMETPFPVILGHEGAGIVESIGQGVTTVKPGDKVLMFPLPECRECIYCLHPKGNFCKKQKIFDSALIMSFYFFFLFLVVALCLGSSILSPTGLMLDGTSRFTCRGKKIYHLQGTSTFTEYTVVDEIAVAKINDRAPMDTVCIISCEVSTGFGAVFNTAQVTPGSTCVVFGLGGIGSAIVMACKASGASRIIRVDTDEQKFPRARALGVTDCLNPKKLEKPVQKVVKEMTGVGVDFAFEAIGLIETMVSALKSCNRSSGVCVIMGVAPTGSQLSFDPVLLLPGRTLKSSVLGGYKTRDDIPKLVTDYVQKNST

SEQ ID NO: 20127 - protein, 654 aa, Rattus norvegicus
MSPTLMDFAREVKVMYRLCDLTPDTKVLILGDDRGNQDHKELHILANHHVAHPGTPVVKKGAVSQDKVRRGQPDLREKQSTVGQNFEAGDSTRNLGDSELLYTPSTMMGLFSQALYGQTISPKHVMLFFAVRVMGQGHNKMLIREMIKMEPGVIRCKATVLWKPGAPLAIEEIEVAPPKAKEVRIKQSPMTTRQPGRNSSQTNSFGLKDTQPLSDKVQSDSLTCAFDPKYRAVQIMMVATGVCGTDIKHLDTQELSKFCPMIMGHEGVGIVESVGEGVSSVRTGDKVILLCIPQCGECKTCLNSKNNICTEIRLSKTHLASEGTSRITCKGKLVHQYIALGSFSEYTVLKEISVAKIDEGAPLEKVCIIGCGFATGYGAAINSAKVTPGSTCAVFGLGGVGLSVIIGCKAAGAARIIAVDINKDRFAKAKTVGATDCVDPRDFEKPIEEVLSDMIDGGVDFCFEVTGNTEAVGAALGSCHKDHGVCVTVGALASFTSTLSIRSHLFFSGRILKGSILGGWKTKEEIPKLVSDYMAKKFNIDPLITHTLTLSEANEAVQLMKIMYRLCDLTPDTKVLILGDDRGNQDHKELHILANHHVAHPGTPVVKKGAVSQDKVRKGQPDLREKLSTVGQNFEAGDSMRNLGTANSSTHRLG

SEQ ID NO: 20128 - protein, 241 aa, Rattus norvegicus
MNPPNGKRCEFVMEVTNKTRADVKGGTLTQYEGKLRLVEIAQVPKAHVDEFKSVSKFKIFNTNNLWISLAAVKRLQEQNAIDMEIIVNPKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 20129 - protein, 94 aa, Rattus norvegicus
MNGIYMKATCVKAVMEQGIELSNEECNLLSVAYKNVVGATEFACTLAKPAFDEALNEDSYKDSTLIMQLLRENLTVWTSGCAGEECDAAEGAKN

SEQ ID NO: 20130 - protein, 102 aa, Rattus norvegicus
MKIESLGLRSKVLRSIDELRTRMESLSSGIPDEFICPITRELMKDPVIASDGYSYEREAMESWIHKKKRTSPMTNLALPSLVLTPNRTLKMAINRWLETHQK

SEQ ID NO: 20131 - protein, 220 aa, Rattus norvegicus
MAAVAATLNGQPAFQARGLRLSRAGSSRQQPACMSNSKRSGPRRARCGEELGRLKLVLLELNFLPTTGTKLAKQQHILARDILEIRAQWSILCKDIPSFKRYLAQLKCYYFDYKEQLPESAYTHQLLDLNLLFLMSQNRVAEFHTELEGLPAKGIQTNVYIKHPVSHEQYLMEGSYNKVFLAKGNIPAERYTFFTDILLDTIRDEIAGCIEKAYEKILFC

SEQ ID NO: 20132 - protein, 109 aa, Rattus norvegicus
MLGGMLAGHSESGGELIERNGKKYKLFYGMSSEMAMKKYSGGVAEYRASEGKIVEVPFKGDVEHTIRDILGGIRSTCTYVGAAKLKELSRRTTFIRVTQQVNPIFSDCQ

SEQ ID NO: 20133 - protein, 1071 aa, Rattus norvegicus
MRPKTFPATTYSGNSRQRLQEIREGLKQPAKSSTQGLLVGPNSDTSSLDAKVLGNKDASRQQQMRATPKFGPYQKALREIRYSLLPFANESGTSAAAEVNRQMLQELVNAGCDQEMAGRALKQTGSRSIEAALEYISKMGYLDPRNEQIVRVIKQTSPVTFAQSRPHKALHQLKFLLSAKAAGFFLPGKGLVPTAVTRRPSFEGTGEAFPSHHQLGGANYEGPAALEEMPRQYLDFLFPGASVHGAPAHQHPPKGYSTAVDAGTHFPGAHYGRAHLLSEQPGYGVQRSPSFQSKTPPDTYSSLAKAQGGPPASLTFPAHAGLYTTSHHKPAAAVPGAHPLHVLGTRGPTFTGDSSTQAVLAPSRNSLNNDLYELGSPVPWPAAPLARRDSLQKQSLEASRPHVAFRAGPSRTNSFSSPQPEPSLPAPNTVTAVTAAHILHPVKSVRVLRPEPQTAVGPSHPAWVPAPTAPAAAEGLESKEGSAGPPPLDMDFGGSERRCPPPPYPKHLLLPSKSEQYSAGLDRLCTGVEQSLRGGTEQDRNDKGHKGAKGDKAGRDKKQIQTSPVPVRKNSRDEEKRESRIKSYSPYAFKFFMEQHVENVIKTYQQKVSRRLQLEQEMAKAGLCETEQEQMRKILYQKESNYNRLKRAKMDKSMFVKIKTLGIGAFGEVCLACKVDTHALYAMKTLRKKDVLNRNQVAHVKAERDILAEADNEWVVKLYYSFQDKDSLYFVMDYIPGGDMMSLLIRMEVFPEHLARFYIAELTLAIESVHKMGFIHRDIKPDNILIDLDGHIKLTDFGLCTGFRWTHNSKYYQKGNHIRQDSMEPGDLWDDVSNCRCGDRLKTLEQRAQKQHQRCLAHSLVGTPNYIAPEVLLRKGYTQLCDWWSVGVILFEMLVGQPPFLAPTPTETQLKVINWENTLHIPTQVKLSAEARDLITKLCCAADCRLGRDGADDLKAHPFFSTIDFSRDIRKQPAPYVPTISHPMDTSNFDPVDEESPWHEASGESAKAWDTLASPNSKHPEHAFYEFTFRRFFDDNGYPFRCPKPSEPAESADPGDAELGGAVEGCQPVYV

SEQ ID NO: 20134 - protein, 599 aa, Rattus norvegicus
MTDAAVSFAKDFLAGGVAAANSKTAVAPIERVKLLVVQHASKQITADKHYRLCGSYPQGTGSPVLLAWQPGQCHQALNFAFKDKYKQIFLGGVDKRTQLWQYFAGNLASGGAAGATSLCFVYPLDFVRTRLAADVCKAEAEREFKGLGDCLVKIYKSDGIKGLYQGFNVSVQDIIVYRAAYFGIYDTAKGMLPDPKNTHVFISWMIASVTAVAGLTSYPFDTVRRRMMMQSGRKGTDITYKGTLDCWQKIARDEEARLFARLSSYCDIPWTSTTVFKVLLNVDLTEDKETSCPCSWPDQVFVTWVKLLTDMGKMVKNTSVSTHNAQVMSEAFSIQRNQCYLQLSIDMPIGNTGNLKIGINQVHCSKRKFRQCCCLVREPLGSRGMTMASVISFRAETSILQPEGEANKTAQAVQGKSAGLFGNQSRELRRTGDKGSQWDWLCKGILKIKVTQNKLSVDCGDLSPVHSFGSVFLDVKRTVPVCGQGPRVSAGVNQPVAEVFLPSMGFCQCLTLMLQWLQIRIGQQGDQIVPNRPCVCVSTVDKKGSFKALLMGTMGIKIPVKMELRKEPKDVLFHPPLKTYRSPYIRSLSKHHQRWSAAE

SEQ ID NO: 20135 - protein, 1008 aa, Rattus norvegicus
MTLVWSGFCRATFSFCVSPLLVFVNSKSGDNQGVKFLRRFKQLLNPAQVFDLMNGGPYLGTFSFNSKVFSVNYGTQVNFYIHTLIFNMDVDMHIKRTVIGERAFYVLNTENDCFTFSLRLFQKFDNFRILVCGGDGSVGWVLSEIDKLNLHKQASVAPRLPSKCYHCVLLQCQLGVLPLGTGNDLARVLGWGGSYDDDTQLPQILEKLERASTKMLDRWSIMTYELKLPAKASVLPEPAEATEEFYAPLAAVCILAIVGVVSVCVLQVCEKLIVSHRAILPAFLVFSPCSMTIYEDSVANHLTKILNSDERAVVISSAKILCETVKDFVAKVEKAQDRTLENTVVAEAVASKCSVLNEKLEQLLQALHADSQASRVPPGVGPAIPEEDTDTASEESLGESKDQLVNDFGKPSSQKAVKPREIMLRANSLKKAVRQVIEEAGKVMDEQTVQPCEPVSPSCDYDTEADEAKEDDTKESLSAKTTPQSPDAQASRGHSQIDSVAGPAMATTKENLPVLNTRIICPGLPKGPEENVHVSGLPKGPEENVHVSGLPKGPQENTHVSGLRLRAGLAASIAGSSIINKMLLANVDPFGAMPFIDPDPDSLDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKIMEVFAVFDSVQMAVSRVIKLQHHRIAQCRTVKITIFGDEGVPVQVDGEAWVQPPGIIKIVHKNRAQMLTRDRAFESTLKSWEDKQKCDTGKPVLRTNLYIHPTADLATEEVSQMRLCSQAAEELITRICDAATIHCLLEQELAHAVNACSHALNKANPRFPESLTRDTATEIAINVKALYNETESLLVGRVPLTRRGSVGPVLFTTSQGTETQLPGPQGGHVHSGNAELVGRSLGYLLHLESPHEERVSSALHSVEMELRKLTEIPWLYYILRPNEDEVRQVQTIGCGQ

SEQ ID NO: 20136 - protein, 219 aa, Rattus norvegicus
MTQRKGGEAQSVYLNVNFTLLLGTSEETTTGVHNLYKMLTNGILKVPAINVNNSVIKSRFDNLYGCWKSLIDGIKWATDVMIAGKVAVVEGYGDVGKVVPSVLQAALGEGGFEVTTMDEACKEGNIFVTTDCVDLIVGWHFQQMKDDAILCNTGHFDMEIDENWLNENAEEKMNIRPQKLDKAVTEAHLGKLNVKLTKLTWACPGLSINGPYKPDQYCY

SEQ ID NO: 20137 - protein, 192 aa, Rattus norvegicus
MVATVWEDGVRGLAQGLRGCEHYDRACLLKAPCFDKLYTCRLCHDTNEDHQLDRFKNCPICLEDIHTSCVVVHVLPCGHLLNRMCYEEMLKEGYRCLLCKHSALDMTRYWRQLDNQVAPTPMPSEYRNVTVDILCNDCTGRSTVQFHILVMKCKLRDSYNTAQAGRPQSFRGSTVRSLSLAGEQLCDIDETL

SEQ ID NO: 20138 - protein, 364 aa, Rattus norvegicus
MGRWALDVAFVWKAALTLGLVLLYYCFSIGITFYNKWLTKSFHFPLFMTMLHLAVIFLFSALSRALVQCSSHRARVVLSWTDYLRRVAPTALATALDVGLSNWSFLYITVSLYTMTKSSAVLFILIFSLIFKLEELRAALVLVVLLIAGGLFMFTYKSTQFNVEGFALVLGASFIGGIRWTLTQMLLQKADLGLQNPIDTMFHLQPLMFLGLFPLFAVFEGLHLSTSEKIFRFQDPGLLLWVLGSLLLGGILAFGLGFSEFLLVSRTSSLTLSIAGIFKEVCTLLLAAHLLGDQISLLNWLGFALCLSGISLHVALKALHSRGDGGPKPRKGLGSSADLELLLQSSQQEEDNGEEEYFMTQGQQ

SEQ ID NO: 20139 - protein, 512 aa, Rattus norvegicus
MPLQEETLREVWASDSGHEEDWLSPEPPPRPKQRPAQGQKLRKKKPETPESPESKPPRRAGAGRRKHGEPPADPAEPRTEQTVYAKFLRDPEAKKRDPRETFLVARAPDVGGGDVGSPDAPQKPLKTKKKEVGEGTKLRKVKKKGAGETDKNPSESPATVRKKIPASMFLVGEGGTAEKGVKKKGSRMFPKVQSPFWLDVFHCRDMLLSTLKGNVHRPEYTVNPETRLRVLSTAPLRRETTQEPAPKEERAPSPPVEVGEPREFVLQPAPQGRAVRCRLTRDKKGMDRGMYPSYFLHLDTEKKVFLLAGRKRKRSKTANYLISSDPTNLSRGGENFIGKLRSNLLGNRFTVFDNGQNPQRGGGGDVESLRQELAAVVYETNVLGFRGPRRMTVIIPGMNSDNERVPIRPRNSSDGLLVRWQNKTLESLIELHNKPPIWNEDSGSYTLNFQGRVTQASVKNFQIVHADDPDYIVLQFGRVAEDAFTLDYRYPLCALQAFAIALSSFDGKLACE

SEQ ID NO: 20140 - protein, 209 aa, Rattus norvegicus
MGAVIKVIEFKKLANWKEEEMFRPNMFFLLLLPPIIFESGYSLHKGNFFQNIGSITLFAVFGTAISAFVVGGGIYFLGQADVISKLNMTDRTGTGSGLDDKSSEGLGAVPVCFAFGSLISAVDPVATIAIFNALHVDPVLNMLVFGESILNDAVSIVLTNTAEGLTRKHMSDVSGWQTFSQALGYFLKMFFGSAALGTLTGLISALISF

SEQ ID NO: 20141 - protein, 559 aa, Rattus norvegicus
MLLPWTKPAFTSRNSTLSMSMPLRPPPNLDLALSRGNGSVGPVHPPQPLIHYLNARERICGEKQVLQFQLILCLIERGKSSFSLIHTSERIGKTPNTPARMKFSDCELSGPPAFGGVSAGLGHGMRATSVLDPPPNPPPLTHLPRRGQGGRGLGRACAADRVGQRRQTRRDAKPEATQRRPRRLLAQATPLKDARIAGCLHMTVQTAALIETLMALEVQWSSRNIFFTQDHAAAAIAKAGIPVFAWKGETDEEYLCCLEQTLHFKEGPLNMILEDGGDLTNLIHTKYPQLLSDIRGISEEISNGVHNVYKTMANGILKVPAIHVNNSITKSRFDSLYSCQESLIDSIKQATDAMIVGKGALVAGYGDMGKGCTQALRDFRVQVIITEIDPINALGFNEGAVEKVNIQPQVDHHWLKNGHHIILLVEGHLVNLGHPSFRMSNSFSNQVIAQIELWTHPDKYPVRVHFLPKKLDEAVAEAHLGKPNVELTKLTEKRAQYLGMPINDPSSLITATAEIWDCPSPSSCHPCSRPYLSFPRTNVTNFADTSPVFHPVPPPLPPL

SEQ ID NO: 20142 - protein, 601 aa, Rattus norvegicus
MAGFQGGLLSILPACQLSGPLLQIPDKPPQMLQESYGVDKEFYILERRHTQESEVTVGEQDGPPSQGCIWQIGAIVNQKTPKELTIGVPEEDPVDYGCEMQLLQDGAQLQLQLQPEEFVAIADYTATDETQVVGDHRGRGDLVTHGGGLPTQLLLSFLRGEKILILRQTTADWWWGERAGCCGYIPANHLGKQVEEYDPEDTWQDEEYFDSYGTLKLHLEMLADQPRTTKYHSVILQNKESLKDKVILDVGCGTGIISLFCAHHARPKAVYAVEASDMAQHTGQLVLQNGFADTITVFQQKVEDVVLPEKVDVLVSEWMGTCLLVMPWPVVVWGSFESHHFPWFTKLQYIDDINGPRAVQAVFTHPNPLHPQRYAGTAVQFEFMIESILYARDAWLKEDGIIWPTTAALHLVPCSAEKDYHSKVLFWDNAYEFNLSALKSLAIKEFFSRPKSNHILKPEDCLSEPCTILQLDMRTVQVSDLETMRGELRFDIQKAGTLHGFTAWFSVHFQSLEEGQPQQVLSTGPLHPTTHWKQTLFMMDDPVPVHTGDVVTGSVVLQRNPVWRRHMSVCLSWVVTSAVDPTSQRKKRSEENASCSLDVQS

SEQ ID NO: 20143 - protein, 427 aa, Rattus norvegicus
MAEMETFQTQRGEENLLAILRRRWWKYMILGFIDLEANYLVVKAYQYTTLTSVQACISDANASSPTFSLSIFHSLEKNLETASALIVFLPDMSTTELIATPWGAVWYQPDINSTRRAADREVTYSELPISSQFETSYFSSRARSVNKKSVLWSTVVILLSWFFLLIRYKAVHFIGIVVCILGMGCMVGADVLVGRHQGAELCVCQAGSCPTGCTESEVTRVVARVPLEYQSRENKLVGDLLVLGGATLYGISNVWEESIIRTLSRVEFLGMIGLFGAFFSGIQLAIMEHKELLKVPWDWQIGLLYVGFSACMFGLYSFMPVVIKKTSATSVNLSLLTADLYSLFCGLFLFHYKFSGLYLLSFFTILIGLVLYSSTSTYIAQDPRVYKQFRNPSGPVSDLPSTAQVEPSVTYTSLGQETEEEPHVRVA

SEQ ID NO: 20144 - protein, 488 aa, Rattus norvegicus
MPFIGRKIQQQLTKAKKDLVKNMPFLKLDKDYVKTLPAQGLSTAEVLERLKEYSSMDVFWQEGKASGAVYSGEPKLTELLVQAYGEFTWSNPLHPDIFPGLRKLEAEIVRMTCSLFNGGPDSCGCVTSGGTESILMACKAYRDLALEKGIKTPEIVAPESAHAAFDKAAHYFGMKIVRVAQKKNMEVDVRAMKRAISRNTAMLVCSAPQFPHGVIDPIPEVAKLAVKYKIPFHVDACLGGFLIVFMEKAGYPLEKPFDFRVKGVTSISADTHKYGYAPKGSSVVMYSNEKYRKYQFFVDADWQGGIYASPSIAGSRPGGIIAACWAALMHFGENGYVEATKQIIKTARFLKSELENIKNIFILGDPQLSVIALGSNDFDIYRLSNMMSAKGWNFNYLQFPRSIHFCITLVHTRKRVAIQFLKDIRESVTQIMKNPKAKTTGMGAIYGMAQATIDRKMVAEISSVFLDSLYSTDPVTQGNQMNGSPKPR

SEQ ID NO: 20145 - protein, 108 aa, Rattus norvegicus
MAAFVLNITEQTLHSAFSLLRGSPQVTSICLQIGYPTVASVSHSISNEYRRVLALSMETDYTFPHAKKVKAFLTDPSVFGAPAPVTAATTDAHAPTAAPAKTEAKEES

SEQ ID NO: 20146 - protein, 156 aa, Rattus norvegicus
MSSEEGKLFVGGLNFNTDEQALEDHFSSFGPISEVVVVKDRETQRSRGFGFITFTNPEHASDAMRAMNGESLDGRQIRVDHAGKSARGTRGGAFGAHGRGRSYSRGGGDQGYGSGRYDSRPGGYGYGYGRSRDYSGRSQGGYDRYSGGNYRDNYDN

SEQ ID NO: 20147 - protein, 1378 aa, Rattus norvegicus
MEALILYLPLLVEMVGSAAVFFAPFPAGGSYQKIGKSNHTASASSQGTIKKRSAFEDVTNASYVQCVQPKEDNTELKSHISKRTRKGVGEITQKKIKSSKLGHVTSLSNVEKEFILDIPNKPKTLTTEEPPVFPKTLVLNEQHATEETSLMRKTLKSCAFYQETFLMEKPQTLLEKTKDYKEFDSELMTSRRKDKPEEATIIEEMTDLKEPDLGKVTLTSSPLYLKNKHAVQEEKHAIQGKSSFKKKSLAMKVVTTKENSPVKKPHFRKKKPTTELKSLLQEQSSLQEKYNTQGDASILKKPRVLQKNINNKVDTLTEPVTLKRKHSTNEAIHTKKLSSSKNNHDTQGKGTNLRPLGVQPVTHENEPLSSKKSTTKKKDSHFHGPSVLPDKHSPQMKVSTAKNSLALQNPTTEEMMLHFPVAPVLKMGQNMEEAPCLKKPSPLRKQQQLPKRSRSFSKCAVQETVTSKSLSFKKSNTKKDPSFQGPFALQKKRNSPGKLSKQKKRYVPPKHCMEKDSHFQLDSAFKKQHIREEPASTHKPLILEMQQTTKGTEFRLRNPLVLPTVTSGTKSLTKEPPSFKKENTPLLKRKCATHTITLQQAQLELEETTGEDRNLFSTRPELHKKEPTPGLLQDPLPQNENCLIPQQLSFSMPLDSQKITSQERAHSKESVTSNDDNNFFSQDLFSPFSSTDEDTLKFHKSLDFQEKVDRKNDSPTKMSDSQDSVSEEESFLRKLFCKGRHSSSEESSQERPVALEQEFLLKKVLNENTSSDVEGPLSHQSPHIQNHSGTTKEALEALDALEALDALEALEASETLEALEALEASGALEEPLNIQEELSSEDIVAIMKSLITEDESIKEAFIRSYTTATEAPAEKSLSLEETSINEVATLKEPLSSQEKHRAELVTVLKELLVLVKNPRLERLALAFQENPPSNVETLLREVLALVEKSTGEESTLNEPLALQEKLSTKAELSPKELLALEDNPSFKKASPQGSLTFDHKPDIEKDEITRMSFSFEEFSIDSLYEKVLALSEGFTTTEQLSFTDLQNFDESKIVDEEDIFKSFFVFENENNPNLSSNGFESRKDNSSAPMPSLEAFNSVMNSEPCVSATKSSQSSLGGKETEEKFIVTKYMDEQMELTSDMRAILVDWMVEVQANFRMSHETLYLAVKLMDRYLMKAQCEKNHLQLLGSTAYMIAAKFEESYPPSLTEFLYICEDLYPKSEMVSLERNILKTLNFDINIPIAYHFLRRYASCIHASMKTLTLSRFICEMTLQEYDYIDERPSKLAAASFILALYMRNLKDCVNGWGGLVPSLEYSTGYQLAELHILVRKLNHLLNFRSRTVLKNVFEKYSEETYFEVAKIPPLSMKDLEDLLNCALFS

SEQ ID NO: 20148 - protein, 417 aa, Rattus norvegicus
MGFLQNGGDIAPKEQLVSMKQDVEPARSTLELFLYTSKWRPLKRLLSPSSAGNSQRGLEHGCAEALADLRGTGGILKGIWEEKAKMVTSFPVVFQWEKHETPQLGINPAERKLLLKMLDPFLLFDEFKGGRPGGFPDHPHRGFETWMTAGRGILHAEMPCSEEPAHGLQLWVNLKRSEKMVEPQYQELKSEEIPKPSKDGVTVAVISGEALGIKSKVYTRTPTLYLDFKLDQGAKHSQPIPKGWTSFIYTISGDVYIVTMESSSPLVLSNLPNPIAEKTESTGRETSMQSTLPLLVSILTIPIFLETGEASRERPPWEIDYQLAGSILIAKYILNLQTDGLLMTSVQGPDDAQQKIEPHRTAVLGEGDTVQLENKFLTSVQVLPTTTTKNVPNKGSVTAGEEPAVDMRPNPVYLSLV

SEQ ID NO: 20149 - protein, 381 aa, Rattus norvegicus
MNPLQTGPWQTSAPSFWLLKFSFIWLVSQNCCTASAVWTAYMNISFHVGNRMLSELGETGVFGRSSILKRVAGVVVPPEGKIQNACDPNTSFILPRNKEPWIALIERGGCAFTQKIKVASENGARGVIIYNFPGTGNQVFPMSHQAFEDIVVVMIGNVKGMEILHLIRKGVHVTVMVEVGRKHVIWLNHYFVSFMIVTTATLAYFTFYHIRRLWVARIEDRRWKRLTRELKKAFGQLQVRILKEGDEEVSPNADSCVICFEAYKPNEIVRILTCKHFFHKNCIDPWILAHGTCPMCKCDILKALGIQMDIEDGSDSLQVLMSNELPGTFSAMEEELNNELPPARTSSKVTHVQEHPTSVNVGSQPPEAEETGHPSFGQHDL

SEQ ID NO: 20150 - protein, 362 aa, Rattus norvegicus
MVDYLIRGSTSYVRKITLKTPLVSSRMHAVTEAGMAIAMVLTGGIGFIHHNSTPEFQANEVRKVKKYEQGFITDPVSLVLWTVCTMFLRSKPSMASVVTPSQIQDELVAIIAWAMRKNRDYPLASKDAKKQLLYGAAIGTHGDDKDRLDLLALAGKFHFSNQYDQYIEEKYPNLQVIGGNVVTAAQAKNFIHAGVDALSLEYARHFGVLVNPNGGTQNVGHIAKALALGASTVMMGSLLAPGEYFLSNGIQLKRYSGMGSLDAMDKHLGSQNWYFSEADKIKVAVSGAVQDKGSIPKFVPYLIAGIQHPDIGAKSLTQVRAMIYSEKLKFEERTSSAQMQGGVHSLHSFEKRLFWKQIQYMP

SEQ ID NO: 20151 - protein, 475 aa, Rattus norvegicus
MRVEVSGVAWLFLTVWFPVLLSLLFHSLPKHCTDFIVKQLNLKSLRINVTQSQILAKFTPHLCTGKRTSVFAEQDSNGVEVSHLNKQQLQLLKERFQAFLNGETQIVADEAFCNAVRSYYEDSGGQSGTVTLLLKSAGWPVARHTDLRGIEISLARIGDTCVTCADVTVNGGMNPPGLTPSAHRSVSSRLLRLSVFLLLSLPDTKGKAIWTAHLNITFQVGNRIISELGESGVFGNHSPLERVSGAVVLPEGWNQNACSPLTNFSRPDQADSWLALIERGGCTFTHKINVAAEKGANGVIIYNYPGTGNKVFPMSHQGTENIVAVMIGNLKGMELLHLIQQGVYVTIIIEVGRMHMPWLSHYVMSLFTFLAATVAYLFLYCAWRPRAPNSSTRRQRQIKSDVKKAIGQLQLRVLKEGDKELDPNEDSCVVCFDIYKAQDVIRILTCKHFFHKTCIDPWLLAHRTCPMCKCDILRS

SEQ ID NO: 20152 - protein, 1165 aa, Rattus norvegicus
MSSQKELLLGLLLLPLCDVDRNLSYGPEDCCFRRNRRVAEGFLIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESVGKCPPVSHVLAVTLLGLTERPPVSTTRRSVIYNLRAVGYVPAGFPVFAWKGESEDDFWWCIDRCVNVEGWQPNMILDDGGDLTHWIYKKLYQLSKAGKLCVPAMNVNDSVTKQKFDNLYCCRESILDGLKRTTDMMFGGKQVVVCGYGEVGKGCCAALKAMGSVVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRETGCTQGPGSVPQPAAGVGGEEPGDIRQREAEAEPWPAVFLTRAKSVTDTFQILDSCRRVKPEFGSRCTDREPARRELYSYTESLEFTTNRKCFEEDFKTQVQDTKEWLELEEDAQKTYVMGLLDRLEVVSREQRLKVARAVLYLAQATARPLVVPFGNQPSPLLTALSSGFSTHNEEPFALLLFSMVTKFCSGLAPHFPIKKVLLLLWKVVMFTLGGFEHLQALKIQKRAELGLPPLAEDSIQVVKSMRAASPPSYTLDLGESQLAPPPSKLRGRRGSRRHKYISIADVQIKNEEELEKCPMSLGEEVIPETPSEILYQGMLYSLPQYMIALLKILLAAAPTSKAKTDSINILADVLPEEMPATVLQSMKLGIDVNRHKEIIVKSISALLLLLLKHFKLNHIYQFEYVAQHLVFANCIPLILKFFNQNILSYITAKNSISVLDYPCCTIQDLPELTTESLMLVVFKSAPILKRALKVKQAMLQLYVLKLLKIQTKYLGRQWRKSNMKTMSAIYQKVRHRMNDDWAYGNDIDARPWDFQAEECTLRANIEAFNSRRYDKPQDSEFSPVDNCLQSVLGQRLDLPEDFHYSYELWLEREVFSQPICWEELLQNH

SEQ ID NO: 20153 - protein, 1757 aa, Rattus norvegicus
MSLTPPSDLKIKERGKKSALRRKCAVCKIVVHTACIEQLEKINFRCKPTFREGGSRSPRENFVRHHWVHRRRQEGKCKQCGKVACSDVSGEQDHFPWQFDPGISSWNFLDVMKNVQSSEGSPVLHGQAKHWSCVDSKQGEVLFPPPHSTLCSRKAFKCPHFATDWLFYLRDDAIVGTQSWSHSRTAGGPLRTKWYQEQQAMALRVKSVFLVLSGGMNTQDCDLHGLGSHLFTHNTLLQTSRCCCCCFYVPDKLAKPYSVTGFQQKFSFHSKEIVAISCSWCKQAFHNKVTCFMLHHIEEPCSLGAHAAVIVPPTWIIKVKKPQNSLKASNRKKKRTSFKRKASKRGTEENKGRPFVIKPISSPLMKPLLVFVNPKSGGNQSRKPDSGIKVAVLAFGMPHVKTVMCLDLLGTKVLQMFMWYLNPRQVFDLSQEGPKDALELYRKVPNLRILACGGDGTTLEPLVGEVWSSDGSFDFRLVLEPVVDAQDRAGSPGLAFVPCQQVESASASAARGQRAECIGVIIAPENRLGAGSGAVSLPSRFTLRFRSLTHTVGVQPSHLDLPFSGTDVVSSHLACPSQRHMGTALFASAFGIPNASGLFVTFRMHPAGYPVHSAFTVLSCVLSSSEMVSSTATRTDLAPGPLDWYCVGWILSILDELQLSPQPPVGVLPLGTGNDLARTLNWGGGYTDEPVSKILCQVEDGTIVQLDRWNLHVERNPDLPPEELEDGVCKLPLNVFNNYFSLGFDAHVTLEFHESREANPEKFNSRFRNKMFYAGAAFSDFLQRSSRDLSKHVKVVVSIDCPVTGIHSGARGKNSMFYAVVDLVILDETLRLMTTSEASLSLLWLLQCDGTDLTPKIQDLKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMHPSGASCGPAASVCSPRLLHHVSTVPFRFDPRSPTSPQGVDCLRRIFPPQILFGAEFKSSMAKDVQMQNREPSILVAGLWFNVRIPLSGGGSQSPLLIRNPQSVPDRLRIRVNKISLQDYEGLHYDKEKLREACKLPVPKGHLFEQLNPMGRGRGYFSSRDLFGVCGSKGQYVVLMQPSPDTEEFVWALENFEGLLPVLDGACDGKRRGVTPGHSHCDLSRAPWLTRILTLTPPSDSQNTCKAVLPVRSTAVSLKTIHCHFGFLFFPPSSAIPLGILVVRGDCDLETCRMYIDRLQEDQETSFPRAISAQRLSPRWCFLDATSADRFYRIDRSQEHLHFVMEISHDEIFILDPDMVVSQQAGTPPGMPDLVVEQASGLSDWWNPALRKRMLSDSGMITPHYEDSDLKDFSHSRVLHGDPVIQGSEEAFYLWAKMGVKRRRRPSKSSVVKVSFIGMNIAAFKAFREPSPTLKQLSVWSSQSFILGNPEDFHHVTGDSNRIFRQQKGVSKLSLNAMLYTGAQPFLPFFLSVDGHQSLRKIMDIRDVTREGKANRVPTLLRKCCANTCVETSEPCLWISAYECQADARSDDGKACCQATLHHGEPNQLCQCASSRELPYWLLPPAPGQYPVLLLTKQRLFVFKRRVHDQIESAHFSPAILQAVITGDLMKLMESYKNGGSLLIQGPGHCSLLHYAAKTGNGEIVKYILDHALLSETEQAWSMWISRNESKSDFRLRESEVALLCHLPSRMLQCFDLIWSAVGKTPQERAQQAGDPDLAAYLESRQNYKIIGHEDLETAV

SEQ ID NO: 20154 - protein, 1008 aa, Rattus norvegicus
MGLRFHKVKNNYRKDKEPVTNSHGGCKIRVQGDWTRERHFEIPDEERCLKFLSEVLAAQEAQSQLLVPEQKDSSNWYQKLDTKDKPAYSGLLGFEDNFSSMNLDKKMNTQNPPTGIHREPPPPPSSNRMLPREKEALNKEQPKVTNTMRKLFAPNSQSGQREGLIKHILAKREKEYVNIQSFRFFVGTWNVNGQSPDSSLEPWLNCDPNPPDIYCIGFQELDLSTEAFFYFESVKEQEWAMAVERGLPSKAKYKKVQLVRLVGMMLLVFAKKDQCQYIRDIATETVGTGIMGKMGNKGGVAMRFVFHNTTFCIVNSHLAAHVEEFERRNQDYKDICARMSFSVPNQTLPQVNIMKHDVVIWLGDLNYRLCMPDANEVKSLINKNELQKLLKFDQLNIQRTQKKAFVDFNEGEIKFIPTYKYDSKTDRWDSSGKCRVPAWCDRILWRGINVNQLHYRSHMELKTSDHKPVSALFHIGVKVVDERRYRKVFEDIVRIMDRMENDFLPSLDLSRREGAKLHRIPGTIRGTLNRFMFENVKFRQLQKEKFQISNNGQVPCHFSFIPKLNDTQYCKPWLRAEPFEGYLEPNETIDISLDVYVSKDSVTILNSGEDKIEDILVLHLDRGKDYFLTISGNYLPSCFGTSLEALCRMKRPIREVPVTKLIDLEGLEQQQPAGLSECNLCRCHGILAPVTQSAFRRWNVICFHRALMMGDSNNRKVQKANDSPRKVFVELLIEPVTSDADSWIFMEKSLLQMVPLDEGTSERPLQVPKEIWLLVDHLFKYACHQELLVSLCLETQTKRNEGVTTTSNERGTQEPVLLSFRQLALPANLPTQALSGRKKNEGKRWQLLITHPMDPVTVQAMLTKSLGNSAGSNHSVAEALLIFLEALPEPVICYELYQRCLDSAHDPRICKQVISQLPRCHRNVFRYLMAFLRELLKFSDYNNVSTNMIGQKVITEEADDVEQGGPQGNASPGPTLQYLAKLGSSDEQGYVPLTIGNNSPESQQKLIL

SEQ ID NO: 20155 - protein, 699 aa, Rattus norvegicus
MGQTGKKSEKGPVCWRKRVKSEYMRLRQLKRFRRADEVKTMFSSNRQKILERTETLNQEWKQRRIQPVHIMTSVSSLRGTRECSVTSDLDFPAQVIPLKTLNAVASVPIMYSWSPLQQNFMVEDETVLHNIPYMGDEVLDQDGTFIEELIKNYDGKVHGDRDKETCPPRKFPADKIFEAISSMFPDKGTAEELKEKYKELTEQQLPGALPPECTPNIDGPNAKSVQREQSLHSFHTLFCRRCFKYDCFLHPFHATPNTYKRKNTETALDNKPCGPQCYQHLEGAKEFAAALTAERIKTPPKRPGGRRRGRLPNNSSRPSTPTISVLESKDTDSDREAGTETGGENNDKEEEEKKDETSSSSEANSRCQTPIKMKPNIEPPENVEWSGAEASMFRVLIGTYYDNFCAIARLIGTKTCRQVYEFRVKESSIIAPVPTEDVDTPPRKKKRKHRLWAAHCRKIQLKKDGSSNHVYNYQPCDHPRQPCDSSCPCVIAQNFCEKFCQCSSECQNRFPGCRCKAQCNTKQCPCYLAVRECDPDLCLTCGAADHWDSKNVSCKNCSIQRGSKKHLLLAPSDVAGWGIFIKDPVQKNEFISEYCGEIISQDEADRRGKVYDKYMCSFLFNLNNDFVVDATRKGNKIRFANHSVNPNCYAKVMMVNGDHRIGIFAKRAIQTGEELFFDYRYSQADALKYVGIEREMEIP

SEQ ID NO: 20156 - protein, 406 aa, Rattus norvegicus
MSEREVNLPGGRQERNHLDLRAEYAGRVSRYGQYGGETKVYVGNLGTGPGKGELERAFSYYGPLRTVWIARNPPGFAFVEFEDPRDAEDAVGGLDGKVICGSRVRVELSTGMPQRSRFDRPPAHRPFDPNDRCYECGEKGHYAYDCHRYSRRRRSSILLFLKFPITGATLHLVSLGPYRSLSVICVAVQVELAPPPPEQLSFCTPAHELHACTPAHELHAHTLTLCLHVPCSSSVKHQPRFRDHDKSPDMSLSVTNWEKNVASQPMRKQRLEASAQEVLSVLLQASSSRAQEGLLRLSSDAKQLTACIQGAEDRVLGSGYGACVVGTEPTCFWFHMSTGTHDASTLNALIQLLRTKFALPPAATLLSVMSIRSIPLLCFDATCFPVSADADKAIQPNSDKQGSVQP

SEQ ID NO: 20157 - protein, 502 aa, Rattus norvegicus
MGLEASQMSWTSHREMVRAQWKVIILLILLMVIPSDGLFHSIYRSILVAQPFKGNAGQPLFLSPYIRTGKIKEGQRKSMVSPFPGMYDKSYAGYITVNQTYNSNLFFWFFPARTQPADAPVVLWLQGGPGGSSMFGLFVEHGPYIITSNMTVLSRDFPWTFSLSMLYIDNPVGTGFSFTDHIQGYAIDEDDVAQDLYSALVQFFKLFPEYAKNDFYITGELLHILRQQVCEVCDSRWGEGPTELGIEVPGKRHLASVVQSYAGKYVPAIAYYIHSLNPVRRFKIRLKGIALGDAYTDPETIIGGYATFLYEVGLLDEQQRRHFRKQCRKCIKYIKEQEWMKAFEVLDELLDGDLTAGPSFFQNVTGCTNYYNILQCTEPEDQSYFSKFLSLPQVRQAIHVGNRNFSDGAEVEKYLREDTVKSVKPWLAEIMNYYKVLIYNGQLDIIVAAALTERSLMTMDWKGSYAYRRTHKKIWKIFESDDEVAGYVRRVGKFHQLTREIL

SEQ ID NO: 20158 - protein, 310 aa, Rattus norvegicus
MSGYRWYAGETKVYVGNLGTGASKGENPPGFAFVEFEDPRDAEDAVRGLNGKVICGSLVRVELPTGMPWRSRFDRPPAHRHDRIYECGEKGHYAYDCHCYSPQRRSRTQSRSHSQSREGDTLPHTAGAEEGGQDQHLLDNQGRGISNPVQGRDQNPGLFRDQEAADQNPDLHLLKEVIPHQEVHTQVQVQKEWTDVLKFTLYLITFLGNMLIIFLTQTSPVLHSPKYFLHHLSMVNEACEGLERWLSGAFWVSSLEKHPTLTLWVEGKPPRGFLDTGADTTVITKAFWPKAWPIAYLTPPYKEWGQPQPL

SEQ ID NO: 20159 - protein, 330 aa, Rattus norvegicus
MSGYRWYGGETMVYVGNLGTGAGKGELERSLSYYGPLRTVWIARNPPGFAFVEFEDPRDAEDVQGSEVEQIKTKHVSQGLTRVLQLFGFSLRMEDLFPRRLAMLSRPSTWGAVDTSTILWWRMLLRPSTVRRLDGKVICGSGVRVELSTGMPQRSRFDRSPACHPFDLNDRCDECGEKGHYAYDCHCYSPQRRSRSRSRSHSQSREGNTLTHAAEAAEGGQDQHLLDDQCPCLFIDQEQLHSEDLGVVLQQDRGISNPVQGQDQNPGLFRDQEAANQNPDLHLLKEVVPHQEVHAEMQVQKEWSEILKFPFSREKLFCLHYYKGFVVSVK

SEQ ID NO: 20160 - protein, 143 aa, Rattus norvegicus
MLLELARRVRGAWSWAPGSRSLFNRMDFEDLGLVDWEHHLPPPAAKAVVESLPRTVIRSSKAELKCPVCLLEFEEEETVIEMPCHHLFHSNCILPWLSKTNSCPLCRHELPTDDDSYEEHKKDKARRQQQQHRLENLHGAMYT

SEQ ID NO: 20161 - protein, 442 aa, Rattus norvegicus
MDQCVTVERELEKVLHKFSGYGQLCERGLEELIDYTGGLKHEILQSHGQDAELSGTLSLVLTQCCKRIKDTVQKLASDHKDIHSSVSRVGKAIDKSQWGSRWGCEILEEQGSDRQEAVEHVYLNFDSDISSVGIDGCWQADSQRLLNEVMVEHFFRQGMLDVAEELCQESGLSVDPSQKEPFVELNRILEALKVRVLRPALEWAVSNREMLIAQNSSLEFKLHRLYFISLLMGGTTNQREALQYAKNFQPFALNHQKDIQVLMGSLVYLRQGIENSPYVHLLDANQWADICDIFTRDACALLGLSVESPLSVSFSAGCVALPALINIKAVIEQRQCTGVWNQKDELPIEVDLGKKCWYHSIFACPILRQQTTDNNPPMKLVCGHIISRDALNKMFNGSKLCSSDSCLCCVVSTSVLSAFGTVALKAKSSWFVCPVEAAGRLH

SEQ ID NO: 20162 - protein, 553 aa, Rattus norvegicus
MIQRLWASRLLRHRKAQLLLVNLLTFGLEVCLAAGITYVPPLLLEVGVEEKFMTMVLGIGPVLGLVSVPLLGSASDQWRGRYGRRRPFIWALSLGVLLSLFLIPRAGWLAGLLCSDTRPLELALLILGVGLLDFCGQVCFTPLEALLSDLFRDPDHCRQAFSVYAFMISLGGCLGYLLPAIDWDTSALAPYLGTQEECLFGLLTLIFLICVAATLLVAEEAVLGPPEPAEGLLVSSVSRRCCSCHAGLAFRNLGTLFPRLHQLCCRMPRTLRRLFVAELCSWMALMTFTLFYTDFVGEGLYQGVPRAEPGTEARRHYDEGIRMGSLGLFLQCAISLFFSLVMDRLVQKFGTRSVYLASVMTFPVAAAATCLSHSVVVVTASAALTGFTFSALQILPYTLASLYHREKQVFLPKYRGDAGGGSSEDSQTTSFLLGPKPGAPFPNGHVGPGGSSILVPPPALCGASACDVSMRVVVGEPPEAKVVTGRGICLDLAILDSAFLLSQVAPSLFMGSIVQLSHSVTAYMVSAAGLGLVAIYFATQVVFDKNDLAKYSL

SEQ ID NO: 20163 - protein, 300 aa, Rattus norvegicus
MHRRHKVRAQGCNSDVRGSSQIEEIDGLNKKKDLPDDISTVQAEGVPYSLDSDSSEAIRWTAGPFSCSTLRQSSVLCQVGGVPTPQLRVQTPSECIHRVLWNRATWRSNQFLKIIQFLGDYPNCFIVGADNVGSMQMWQTHMSLQGKAVVLEGKERHDANVGFVFTKEDLTEIRGMLLAYNVLAATCAVAIAQDEVTVPAQNTEGVRHIASVPLSADWLPDCCFRGTLYRQWIQVDPAWSVETEYTFPLAEKVKAFLANPSAFVAAAPVAATTTAAAPAEAETKEVLEESDEDMGFGLFD

SEQ ID NO: 20164 - protein, 316 aa, Rattus norvegicus
MASYLELNSGTKMPTLGLGTWKSPPGQVTEAVKVAIDMGYRHIDCTRVFQNEKEVGVALQEKLKEQVVKRQDLFIVSKLWCTFHDQSMVKGACQKTLSDLQLDYLDLYLTHWPTGFKPGPDYFPLDALGNVIPSDTDFVDTWTAMEQLVDEGLVKAIGVSNFNPLQIERILNKPGLKYKPAVNQIECHPYLTQEKLIEYCHCKGIMVTAYSPLGSPDRPWAKPEDPSLLEDPRIKEIAAKYNKTTAQVLIWFPIQRNLVVIPKSVTPARIADNFKVFDFELSSEDMATLLSYNRNWRVCALMSCVKHKDYPFHAEV

SEQ ID NO: 20165 - protein, 275 aa, Rattus norvegicus
MAGPELLLDSNIRLWVVLPIVIITFFVGMIRHYVSILLQSDKKLTQEQVSDSQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASWVSSASWYFLNVFGLRSIYSLILGQDNGKKLSGLVSAASCEAADQSRMMQEQMTGAAMAMPADTNKAFKTEWEALELTDHQWALDDVEEELMARDLHFEGMFKKELQTSIF

SEQ ID NO: 20166 - protein, 128 aa, Rattus norvegicus
MAGGKAGKDSRKAKAKAVSRSQRAGLQFPVDRIHRHVKTHTTSHGRVGAPAAVYSAAILEYLTAEVLDLAGNASKDLKGKRITPRHLQLAIRGDEELDSLINATVAGGGVLPHIHKPLIGKKGQQKTA

SEQ ID NO: 20167 - protein, 1098 aa, Rattus norvegicus
MEMQAAKKLQGILFIKRDACGQYAQLKSGSQKGETKHSFKKVPGNWFAELHRYGSSFPMSSKWTKSVNNKHRGFSRCHHCLETSSKDTGTVPDPAKEAHEPCQWVDIKMEVCVTSETPRWASHSNLLGPSPVSQRSDVLSLLRRCGLIEGYRLKQGNSNGNLGPKEVKQCCEQFTFDIQLLTTAEASVLKRNPEVIAGHLAYIGQKEAKVAPSAHSTFLLVAKLTGPFLYTSTEDVLPNQSLRKRKRSQKDLETSKAVVQLWEHSAGLWKDGHCKAPRLLTALRNLLSTGRLMQWTCLSDWLVTVMSWIVRLQILIPVLNTVYAFAHDFRADKGRKVEFLRIQALLLGISVVKVLKSLHSDNSTLEKPSQRNKGSYSHEAFHSVPVKVTEIENPQEVWLSFKATSAFSRSLLSRIPKPLLALMGMKHSSRCLLLRRKMAENAVESTEGAEGATGERNPGRAQGPRPHSAPGTAPAPAAAEPTQAEGDACPGLQRETALTAAPYLPFLFSGVGPELQRAQRVFASRASVFFRLALTPLSSQWDCSLALGTCSHEGIGVGSPLTFTEELCAEVGAEWGTGCFWNKLRAKQCFQSGLLRGCIACTSWGGESTLVDVWSVAGDDNGSGQVSSRYPRGVRYCLTTFTSTVLTNSPKITRICPKSPKPKQLSLLHDQVPRVSSAPPQPPQPVIPAKPVQCVHHVSTQPSCPGRGKMSKLLNPEEMTSRDYYFDSYAHFGIHERWQSLYAQLPTSSSAPDSDLPSTLWEVMVKTVPGAGKSCSSPRKKQASGLLWVQDEMLKDEVRTLTYRNSMYHNKHVFKDKVVLDVGSGTGILSMFAAKAGAKKVFGIECSSISDYSEKIIKANHLDNVITIFKGKVEEVELPVEKVDIIISEWMGYCLFYESMLNTVIFARDKWLKPGGLMFPDRAALYVVAIEDRQYKDFKIHWWENVYGFDMTCIRDVAMKEPLVDIVDPKQVVTNACLIKEVDIYTVKTEELSFTSAFCLQIQRNDYVHALVTYFNIEFTKCHKKMGFSTAPDAPYTHWKQTVFYLEDYLTVRRGEEIYGTISMKPNAKNVRDLDFTVDLDFKGQLCETSVSNDYKMR

SEQ ID NO: 20168 - protein, 657 aa, Rattus norvegicus
MTVGGDWLRLCKSFISAKLCHSPFALVYFLHLVARGGFAKPPHPWQMQPRASSLSILLWWSSRLIISGLRELARRWTLFQVIEWFSNLPSSGKSCGLKVFVPYPSTIYFSAEQILLIPDPIDFRETEKPVAILKVKAVLLATPPPTPILVLPVAFEDETLRLRQLKLDNQRALLEKKQRKKRLEPLMVQPNPEARLRRLKPRGSEEHTPLRALLEKKQRKKRLEPLMVQPNPEARLRRLKPRGSEEHTPLVDPQTPCSDVILHGIDGPAAFLKPEAQDLESKPQVLSVGSSPTPEEGTEGSADGESPVETASKPDLQEILQKHGILSSVNYDEEPDEEAEDEGENLSSLPAQSEKESAGASQKAASDTGASGMTAQQGDAQLGEVENLEDFAYSPAPRGVTVKCRVTRDKKGMDRGLFPTYYMHLEKEENRKIFLLAGRKRKKSKTSNYLVSTDPTNLSREGESYIGKLRKLQIIMSVAFSPHTRSNLMGTKFTVYDHGVNPVKAQGLVEKAHTRQELAAICYETNVLGFKGPRKMSVIIPGMNMNHERIPFRPRNEHESLLSKWQNKSMENLIELHNKAPVWNDDTQSYVLNFHGRVTQASVKNFQIVHGNDPDYIVMQFGRVADDVFTLDYNYPLCALQAFAIGLSSFDSKLACE

SEQ ID NO: 20169 - protein, 708 aa, Rattus norvegicus
MLLLTGYKMNTGVVGKIRIRGLLLLPDSEELEPLFPFGGFNEECEHLYLQRARLAGTKLTVHSSVKLCPSGCVPVTDATFYGAGSLGSRSLEKRCEEMGLEQRLVQKCAAAAPRDSVQSPFSVIIWKENILSNIIKNSSDKARSLLRIIKQSVPVTMAMTAGATTTFPMSSHTRERVTVAKLTLENFYSNLILQHEERETRQKKLEVAMEEEGLADEEEMAFALKNVNTTYSIMGIWDRVQCWTPSTHASLDEQGRKKLRRSQHARKETEFLRLKRTRLGLDDFESLKVIGRGAFGEVRLVQKKDTGHIYAMKILRKADMLEKEQVAHIRAERDILVEADGAWVVKMFYSFQDKRNLYLIMEFLPGGDMMTLLMKKDTLTEEETQFYISETVLAIDAIHQLGFIHRDIKPDNLLLDAKACGEQRESPGLRLCRDVLRHPGSHSSSGLGSLGCGQFPALVTLCLVEISISEHELEAESRDVEEEQEAAVNQDVNIYNSESGFHSFPYTMPTVRSRPLCQHLSAQAYSTVGTPDYIAPEVFMQTGYNKLCDWWSLGVIMYEMLIGFPPFCSETPQETYRKVMSWKETLAFPPEVPVSEKAKDLILRFCTDSENRIGNGGVEEIKGHPFFEGVDWGHIRERPAAIPIEIRSIDDTSNFDDFPESDILQPVPNTTEPDYKSKDWVFLNYTYKRFEGLTQRGSIPTYMKAGKL

SEQ ID NO: 20170 - protein, 278 aa, Rattus norvegicus
MEDEVVRIAKKMDKMVQKKNAAGALDLLKELKNIPMTLELLQSTRIGMSVNAIRKQSTDEEVTSLAKSLIKSWKKLLDGPSTDKDSEEKKKEPALSSQICPEQEKKVVLAAITFDSVRLKCREMLAAALRTGDDYVAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 20171 - protein, 197 aa, Rattus norvegicus
MAPTCVFLASKVEEFGVVSNTRLIAATTSVLKTRFSYAFPKEFPYRMNHILECEFYLLELMDCCLIVYHPYRPLLQYVQDMGQEDVLLPLAWRIVNDTYRTDLCLLYPPFMIALACLHVACVVQQKDARQWFAELSVDMEKILEIIRVILKLYEQWKNFDERKEMATILSKMPKPKPPPNRSSLSDSPLMAGPEAAR

SEQ ID NO: 20172 - protein, 415 aa, Rattus norvegicus
MAENLYRTRSRVYSPSVLFLHPDMGIGGAERLVLDAALALQEYGCQVKIWTAHYDPNHCFIETRELSVQCAGDWLPRSLGWGGRGAAICSYVRMVFLALYVLFLSGEEFDVVVCDQVSACIPVFKLARRRKRVLFYCHFPDLLLTQRNSSLKKFYRAPIDWIEEYTTGMADRILVNSQYTASVFKETFKTLSHRNPDVLYPSLNIGSFDLAVPEKIDDLVPKGKQFLFLSINRYERKKNLPLALSSLVQLRARLPPQEWEKVHLFMAGGYDDRVLENVEHYKELKKIVQESDLERHVTFLRSFSDRQKISLLHGCLCVLYTPSNEHFGIVPLEAMYMQCPVIAVNSGGPLESIVHKVTGFLCEPDPVHFSEAMEKFIHKPSLKATMGLAGKARVAEKFSADAFADQLYQYVTKLV

SEQ ID NO: 20173 - protein, 208 aa, Rattus norvegicus
MGFVKVVKNKAYFKRYQVRFRRQREGKTDYHAQKRLVIQDKRHTHELPKHGVKVGLTNYASAYCTGLLLVRRLLNRFGMDRIYEDQVEVNGDEYNVESINSQPGAFTCYLDAGLARTTTGNKVFGTLKVAVDGGLSIPHSTKRFPGYDSKSKEFNAEVHLKHTMGQNVADYMSYLMEEDEDVYKKQFFQYIKNNITPDRMEEKAHAAI

SEQ ID NO: 20174 - protein, 159 aa, Rattus norvegicus
MVPPKISLLKLTQGETLRKLYEQHHVVQDMLVPMKCLSQALHTFQNDIHVYPIWLCPFILPSQPGLVHPKGDEAELYVDIGAYGEPRVKHFEARSCMRQLEKFVRSVHGFQMLYADCYMNREEFWEMFDGSLYHKLRKQLGCQDAFPEVYDKICKAARH

SEQ ID NO: 20175 - protein, 298 aa, Rattus norvegicus
MTDAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFWRYFAGNLASGGAAGATSLCFVYPLDFARTRLAADVGKAGAEREFKGLGDCLVKIYKSDGIKGLYQGFNVSVQGIIIYRAAYFGIYDTAKGMLPDPKNTHIFISWMIAQSVTAVAGLTSYPFDTVRRRMMMQSGRKGTDIMYTGTLDCWRKIARDEGGKAFFKGAWSNVLRGMGGAFVLVLYDEIKKYT

SEQ ID NO: 20176 - protein, 509 aa, Rattus norvegicus
MPTETEEELPTPTPKPSISEEGNFHSQYQVLGTSGQGGNAKVLLAHHRLTGTPVAVKVLRKDKQWFQPAMMEANIMRKINHPNIVSLIQVIEKETRIYLIMELVEGQELYQYIRESGHIEEDEARQIFEQILSAVSYCHGKGIVHRDLKLDNIMIDKNKKVKVIDFGLSTQFQPGKMLNHHCGTYSFGSPELLLGHRYDGPKNDMWIIGVVLYCMVVGKLPFDSVIIQELQRQVVAGVYPAPCGVSKELEDLLSKLLRVNPNFRPTARKAMKHPWFKEHWNGLIGPYEEMLPLTPDPAILDAMKSIGFQASVVKHSLKQRKYNEEMATYFFLQKQALQGDGCTAQAQQVSPVVAPFPSLDPAAAFRLEPKRSGSLPVLGTLRVSSSHGHVSHYGQNAHPKGGKRSTVAGRLRPLPMTPTQDHYHKCAVSVPCIQTTSIFTEKSSNKEIKEDNPLSHRTPFEDRPIPSRVRHRGFKGWTRNIANALIKLCCCMPRRKKPRLGQNRISPQK

SEQ ID NO: 20177 - protein, 462 aa, Rattus norvegicus
MKAGINVPRKRKRMLRKISTLAQGSPAEEHKDVLNYQSLVIPISEELGGLSQPGDPCKSSFPAGVKDFSVIAKSQDAEVGDGTTSVTLLASEFLKQKKPHPEKSKNPKSALLNVELERKAEKDDAEIRVHTGEDFQAMMDTKWSIRYDKLEKTHQSGAIVSKLPIGDVAIQYSADRDVFCADCKPEEDLKKTMTACGGSIQSSVDALTPDVLGYCQVFEETPIGGERHNFFTGCPKAKTCTSLLHGGAEQFMEEAERSLHDAIITLCDNAGFDATNILNKLQAGHAQGGMWYVVDINNKDIAQNLQAFVWEPASEAACLIVSVDETIKSPRSTVDAPGPAAGGTELMIQKAKLAEQAERYDDMATYIKTMTEQGAELSNEEHNLLSVAYKNMVGAPQILNNPELACTLANTAFDEAVEELDTLNKDSYKDSALITQLLRDNLTSWTSDSAGEGDDAAEGAEN

SEQ ID NO: 20178 - protein, 352 aa, Rattus norvegicus
MESGSRPSLGQVILLGTSSMVTAVLYSIYRQKAQVAQELKGAKKIHLGEDLKAILSEAPGKCVPYAVIEGAVRSVKETLNSQFVENCKGVIQRLTLQEHKMVWNRTTHLWNDYSKIIHQRTNTVPFDLVPHEDGVAMAVRVLKPLDSVDLGLETVYEKFHPSVQSFTDAIGHYISGERPKGVQETEEMLKVGATLTGIGELVLDNNSVRLQPPKQGMQYYLSSQDFDSLLHRQESSVRLWKVLVLVFGFATCATLFFILRKQYLQRQERLRQQQLQDEFLEHEAHLLSQASPEDRESLKSACVVCLSNFKSCVFLECGHVCSCRQCYLALPEPKRCPICRRGITRVIPLYNS

SEQ ID NO: 20179 - protein, 248 aa, Rattus norvegicus
MERASLIQKAKLAEQAERYEDMAAFMKSAVEKGEELSFEERNLLSVAYKNVVGGQRSAWRVLSSIEQKINEEGSEEKGPEVKEYREKVETELRGVCDTVLGLLDSHLIKGAGEAESRVFYLKMKGDYYRYLAEVATGDDKKRIIDSARSAYQEAMDISKKEMPPTNPIRLGLALNFSVFHYEIANRPEEAISLAKTTFDEAMADLHTLSEDSYKDSTLIMQLLRDNLTLWTAENAGEEGGEAPEEPQS

SEQ ID NO: 20180 - protein, 188 aa, Rattus norvegicus
MTIKLTVFKYIHPQCTLIPLGRISKCIVIPVPLDCKVYVGNLGNNGNKTELERAFGYYGPLRSVWVAQNPPGFAFVELEDPRDTADAVRALDGRTLCGCRERVELSNGEKRSRKRGPPPSWGRRPRDDYRSSPPPRHRSPRRRSFSQSRSRSLSRDRRRERSLSRERNHKRSRSFSRARSRSRSNERK

SEQ ID NO: 20181 - protein, 462 aa, Rattus norvegicus
MAEASPQPGRYFCHCCSVEIVPRLPDRPLCAVVVTAATQTPELLARNTCSGGVFTGPVLPTLLLLWSRFITGVRYIPEHTLGASAAHSLLLTPDNPSGVTLVTNGMPLHVFTAVQLWRCVCGGAAYKLPLVGAKLSVACAVKPVDYICPRCESGFIEELPEETRNTENGSAPSTAPTDQNRQPFEVRQGPWAQARPPVLQNVDQHLFTLPQGYSQFAFGIFDDSFEIPAFPPGAQADDGRDPESRREREHQSRHRYGARQPRARLTARRATGRHEGVPTLEGIIQQLVNGIISPAAVPSLGLGPWGVLHSNPMDYAWGANGLDAIITQVRLATQRLWGQEAGLLLNQFENTGPPPADKEKIQALPTVPVTEEHVGSGLECPVCKEDYALGERVRQLPCNHLFHDSCIVPWLEQHDSCPVCRKSLTGQNTATNPPGLTGVGFSSSSSSSSSSSPSNENATSNS

SEQ ID NO: 20182 - protein, 823 aa, Rattus norvegicus
MEKTCSSRAKAVKEKGPSEVDVCSAKSNKAKKEDEPQDLNACKSKTSQKKRSPLRRKQPMGKKNKTETKPRKFLKQRQTCPSPRRRKGKKLMRQGREEPRLKNVLSHSEPNSNSRDAPEEYELPQVERKASTKFEWIGLPSETNTESLQQRCHQTIGLCAPTAVGHFKRSAETRTEEKGAVETLAAALSPQIRDHISRPELKEQLGKNIDAKMKGMVFLKGKPEVCFDVCTEADTETQVKWHGWRCWQLTVATEEPELKGPPEGYQGGRGSRWQPWNSKEEVETSEDNEQEVTTKGTRSTIKGQKWSHSKGFGYCTSQLVFTRSQGTLSLMASNPNKKTLRSQYRMAFLLGQGSFGNVKLAWHRKTQALVAIKSVEICKKTIRGILSEMTILESLHHPNIISLFQVLLTSSQIHFILQYVPGGNLVELIREEGPLPEEQAKKMFGQVVSALRYCHSRGIVHRDIKPQNILIDAAGNVKLIDFGVAIKCRPGTLLKTQCGTRGFCAPEIVLGEPYDGKKADVWSLGVLLFFLTTGYFPFRGGTTDQIKQKVTTGTYTIPTHLSGQLENLIHQILTVSPELRPSIEEIENHPWIKKCEVNIPPMTDPDYKIIEMLCGMGYNANDILESLQQKRYDEPMGAYLSLRNHVIEGYEIGSITPAKPGDQCPPPPPSPAHPSVFGLPLRRRASEPNFGLLHRQPSKEQNTVALTLSGLKMSRCVSMPPIAVYYPKKERSTSTLALHSTPVASPCVYNNMSGVEIILPHKEDIEVNTSSPPQTMGWFKRLRKGIRDCLSRLCCLPRAPKKKPQHRSSKRVAPLKKAASRTK

SEQ ID NO: 20183 - protein, 501 aa, Rattus norvegicus
MASKSKEKTLGSHYKILSYLGQGSFGTVNLAWHLKTQALVAIKMLEISKETISSILSERAILETLHHPNIIRLFQVLITSSHVNFVLEYAPGGSLFELIKEGGPLQEEVAKKIFGQTVSAVKYCHNLDIVHRDIKPQNILTDAEGNGKLTDFGLATKFRPGTLLKELCGTKEFYAPELVLREPYNGKKTDVWSLGVLLYFISTGYCPFRGVTTKDMEKKIATGTYTIPTYFSGQLENLIHQILTVSPEMRPSIEDIEKHPWVRKCEVNIPTITCPDYKIVEMLCGMGYNANKILESLQKKKYDEPMAAYLILKDKVRQEIEHGTTTSDMPVDQGLGISRDSAKELGIVFQDFAASCGLQRYILQESGFPERGSKAEPNEKMVVHVRPGQSWIPEYKDSGSFLLKITSQINTELETQSKILLPQPGSLSSLVPTDFSTCLECSANSVFQYSSTSLSTVSLCEEVVGTLSLSSHGIPYSQLSLADPGAFPQEVAQCGYQAGQT

SEQ ID NO: 20184 - protein, 682 aa, Rattus norvegicus
MAAPSLLNWRRVSSFTGPVPRARHGHRAVAIRELMIIFGGGNEGIADELHVYNTVTNQWFLPAVRGDIPPGCAAHGFVCDGTRILVFGGMVEYGRYSNELYELQASRWLWKKVKPQPPPSGLPPCPRLGHSFSLYGNKCYLFAGLANESEDSNNNVPRYLNDFYELELQHGSGVVGWSVPATKGTVPSPRESHTAVIYCKRDSGSPKMYVFGGMCGARLDDLWQLDLETMSWSKPETKGTVPLPRSLHTASVIGNKMYIFGGWVPHKGENTENSPHDCEWRCTSSFSYLNLGYSVDDVVLIAGALKASVQQNYWQVIDAFETKGLCGYFSLEKPPAPSQVQLIKATTNSFHVKWDEVPTVEGYLLQLNTDLTHQAASPDASAAPNTLGGRTDPHRQGSNSILHNSVSDPANCTKPEHTAVAARGMSLKSKPDSRAADSSVALHSPLAPNTSNNNSCMADMLWKSEVDEICALPATKISRVEAHAAATPFSVGNADVPDYSLLKKQDLVPGTVYKFRVAAINGCGIGPFSKLSEFKTCIPGFPGAPSTVRISKNVEGIHLSWEPPTSPSGNILEYSAYLAIRTAQVQDNPSQLVFMRIYCGLKTSCIVTAGQLANAHIDYTSRPAIVFRISAKNEKGYGPATQVRWLQGAVVFYRCVPVQGICDTEFSSHLTPSSSVTTGLSN

SEQ ID NO: 20185 - protein, 253 aa, Rattus norvegicus
MVDREQLVQRAGLAKQASRALQQYGCNQEEHICRWQREEARDGLSLPGEDREGVGGCEPGRAEPAGQLINCSETQHQSKVFFLKMKGAYYHYLDEVAAGEERASVVESSEKAYSKAHETSKEPMQPTHPIGLRLVLNYYFLLRDPEHPGASTPPGQDRVLRCHRRSPNAGYQWQQKLQLRPQVDWQCTLMLLLQSLLFFPMSWGWGGGGKGRPDLPKDKPMTVLSLIASLTSFAKIPLVESQASYWYWSSSLT

SEQ ID NO: 20186 - protein, 549 aa, Rattus norvegicus
MAMPRNGSRLGNVLIGLLCLTVCLEDMRAGSCRAQEGRWGANTAESDASVSVHPEEWVPLQRASGHDRIITVQEVVTSWLVTLLPLCAFEISRKDTCEFVTNASFSDTDIVHENLKMGSDGESDQASGTSSDEVQSPTGVCLRNRIHRRISMEDLNKRLSLPADIRIPDGYLEKLQISSPPFDQPMSRRSRRASLSEIGFGKMETYIKLEKLGEGTYATVYKGRSKLTENLVALKEIRLEHEEGAPCTAIREVSLLKDLKHANIVTLHDIVHTDKSLTLVFEYLAWSAEVPYVSFQDKDLKQYMDDCGSIMSMHNVKLFLYQILRGLAYCHRRKVLHRDLKPQNLLINERGELKLADFGLARAKSVPTKTYSNEVVTLWYRPPDVLLGSSEYSTQIDMWGVGCIFFEMASGRPLFPGSTVEDELHLIFRLLGTPSQETWPGVSSNDEFKNYNFPKYKPQPLINHAPRLDSEGIELITKFLQYESKKRAPAEEAMKHVYFRSLGPRIHALPESVSIFSLKEIQLQKDPGFRNSSYPETGVFVINHFTCRS

SEQ ID NO: 20187 - protein, 600 aa, Rattus norvegicus
MAPMCLRATGPDLFPALCFLIDQEPTDPLASHGPCGSLWSNQLSLGHGTMEYHWSRPHCHHRAKSVKVTDKRGTRKDIGILVTAQSCAFIQKGSVPECKYKLHQNRDLTKWASGPAFLPPRKELGTQHGQEVTCGPFRSAFRTFRTWSYGTSGEVRARLCHNYITRNKARKRLQLSLPDFRRLCILKGIYPHEPKHKKKVNKGSTAARTFYLIKDIKFLLHEPMVKFREYKVFVRKFRKAYGKSDFPRMGKCHVQTTRLCRPLTAEFLHYVIAAGALHKVFLSIKGIYYQAGIESQAQAGTKVTEDTYALDSESSTEKLAALSASLGRLKADEFPTDREATGQEEDGREGLEIQEKHKKLFEGLKLFLNREVPGEALAFIIRSFGGDVSWDKSLCIGATYDVTDSGITHQIVDWLGQQTPIIDRYSYSPKYFPGVQLPQCLSPFVSEKEDYIPLEKLKLLGLQRGEDPGNLEEEEDDEDDDNEGDGGGAVENEKEDVEAESEKQKEAHLVGAAKAGRKEAPGYGRHCEPGRQAAAGLGGRNRGQAPGHHDDEETREVPLPKDHVWQAAQNPRGQQARREEESPCDDAVRSEKRAKRTRPV

SEQ ID NO: 20188 - protein, 711 aa, Rattus norvegicus
MASLADRVRGNGRIAAGLLFNLLVSICIVFLNKWIYVHHGFPNMSLTLVHFVVTWLGLYVCQKLDIFAPKSLPLSKLLLLALSFCGFVVFTNLSLQNNTIGTYQLAKAMTTPVIIAIQTFWYQKRFSIRIQLTLWVGAKQHELQVNSMQLLYYQAPMSSAMLLVAVPCFEPVFAEGGIFGPWSVSALGRTAGGHDHSRSNLDAVCRRAETDTPGTSPTTVLLLRASRPMCNTNMSVSTEGAAGTSQIPASEQETLVRPKPLLLKLLKSVGAQKDIYTMKEIIFYIGQYIMTKRLYDEKQQHIVYCSNDLLGDVFGVPSFSVKEHRKIYAMIYRNLVVVSQQDSGTSPSESRCQPEGGSDLKDPVQASQEEKPSSSDVVSRPSTSSRRRAISETEENTDELPGERQRKRHRALSFDESLGLCVLREICCERSSSSEATDTPSHQDLDDGVSDHSADCLDQDSVSDQFSVEFEVESLDSEDYSLSDEGHELSDEDDEVYRVTVYQAGESDADSFEGDPEISLADYWKCTSCNEMNPPLPSHCNRCWTLRENWLPDDKGKDKVEISEKAKLESSDQAEEGLDVPDGKKVTEDDAKESSAEDSEEKVAQMLLSQESDDYSQPSTSSSIVYSSQESGKELKEDTQDKEESMESSFSLNAIEPCVICQGRPKNGCIVHGKTGHLMSCFTCAKKLKKRNKPCPVCRQPIQMIVLTYFN

SEQ ID NO: 20189 - protein, 298 aa, Rattus norvegicus
MTDAAVSFAKDFLAGGVAAAISKMAVAPIERVKLLLRVQHASKQITADKQYKGITDCVVRIPKEQGVLSFWRGNLANVIRYFPTQALNFAFKDKYKQIFLGGVDKRTQFWQYFAGNLASGGAAGATSLCFVYPLDFACTCLAADVGKAGAERKFKGLGDCLVKIYKSDGIKVLYQGFNVSVQGIIIYRAAYYGIYDTAKGMLLDPKNTHIFISWIIAQSVTAVAGLTSYPFDMVRHRMMMQSGRKGTDIMYTGTLDCWQKIARDEGSTAFFKGAWSNVLRGMGGAFVLVLYVEIKKYT

SEQ ID NO: 20190 - protein, 801 aa, Rattus norvegicus
MAPQNADSESMQVQELPVPLPDPQKPRDPAAETQEETTSEASIDRIPTRLWVMHGAVMFGREFCYAMETALVTPILLQIGLPEKYYSLTWFLSPVLGLIFTPLIGSASDRCTLSWGRRRPFILVLCVGVLIGVALFLNGSAIGLALGDVPSRQPIGIVLTVLGVVVLDFSADATEGPIRAYLLDVVDSEEQDMALNIHAFSAGKDPCQAPGLGGAIGYVLGGLDWTQTFLGDWFQTQNQVLFFFAAVFFSVSVALHLFSIEEEQYNPQQDRGPEDATLPSTDEVQSEHELSLDYLDVDIVRSKSDSVLHMADSTLDMEPQLLFLHDIEPSIFQDASYPSTPQSTSQELLRAKLPRLSTFLRESTKEDDTLLDNHLNEAKVPNGRGSPPMNPLSHSKVDLKPSVTSSSMRRRRHMFHRQSSSTFSYYGKIGSHCYRYRRANAVVLIKPSRSMSDLYDLQQRQRSRHRNQSGATASSGDTESEEGETETTVRLLWLSMLKMPKELMWLCLCHLLTWFSVIAEAVFYTDFMGQVIFKGNPQVSTLGLPVLLPREFGSFRAGPPVSLHALPLHPRGRVDQAPSNSTKWHAYNAGVKMGCWGLVIYAATGAICSALLQKYLDNYDLSIRIIYMLGTLGFSVGTAVMAMFPNVYVAMVTISTMGVVSMSISYCPYALLGHYHDIKEYVHHSPGNSKRGFGIDCAILSCQVYISQILVASALGGVVDTVNTIVVIPIVASVGSFLGFLTATFLVIYPEVSEEAKEEQKGLSSGAAGEGESGAGTEKPTVLKLSRKGGLRGLMETESMV

SEQ ID NO: 20191 - protein, 264 aa, Rattus norvegicus
MTCINLEVLKDNHDFCVLVQIVPRLLYHPYEDILNYWDPDARDLDYPLASKDSTKQLLCGAATGTHENDKYKLEFLVLACVDVVVLNSSHGNSIFQINMIKYFKGKYTNSTKHLIDASVNSLRFNIGSGSICITQEVLAFRNPQTTALCKIFEYVYHFGVSVIVDWGIQNVGHIAKILALEDFTVMLSSLLAATTKDPGEKFFSDGVWMKKYIGMVLLMPWISILAARTDNLVKLTKIKVPRSSGGSVGQRAYQQICPLFDCSI

SEQ ID NO: 20192 - protein, 290 aa, Rattus norvegicus
MVHEYEVFVQKLHKAYGKSKWNAIECLKDNKPSYKLNHIVKEQYLTFINALQDLDDALSIRFLFSTFPWMGKCHVQTIQLCHHLTVLALCHCCLRAMQDVDYRVMATFTEFYTFLLDFINVCLYPLLNLHYPPSASPAQVVVPAVEEAGANEFLTDGEVTAQEGGRRKELEAQEKHKQTLEQQRLEEKKPQVMARTVKLEDKEWLTQEEESEAKHLAMMMMKRQEKSLYQEIMFGKQHKIQEANKLAEKKKAHDNNAVRGLIIDYLVHEHIQVDNAPRMSRSVCSLCHIP

SEQ ID NO: 20193 - protein, 1176 aa, Rattus norvegicus
MQPGAALQAMLLAVLLAKPRDSKGHLLSGQRFCWEGTRRPCYRVIYFHDTSQRRNFEEAKEACMKDGGQLASIETADEQRLIENFIESLQASDGDFWIGLKRLEEKQHNSTACQDLYAWTDGSLSQFRNWYMDEPSCESEVCVVMYHQPSAPPGIGGPYMFQWNDDRCNTKKNFICKYSDDKPSTTPSLSPGGEATEPAAPILPEETLEIDTKERRGTWEKKREQTDPPTKEQHTIWPTPHQENSPDLEVYNVIRKQSEADLAEPRPDLKNISFRVCSGEAMPDDTSCDYDNMVINPSESGNLVQLSLVQGTSPKGLLHSRPSEKASGFQLTLKSWCFPWSGLRIAHFRTTELSKEDRRFLEKTQDITKNSQLVPRFVIKSRGPVRVGFYDIEGTLGKGNFAVVKLGRHRITKTEVAIKIIDKSQLDAVNLEKIYREVQIMKMLDHPHIIKLYQVMETKSMLYLVTEYAKNGEIFDYLANHGRLNESEARRKFWQILSAVDYCHSRKVVHRDLKAENLLLDNSMNIKIADFGFGNFFKTGELLATWCGSPPYAAPEVFEGQQYEGPQLDIWSMGVVLYVLVCGALPFDGPTLPILRQRVLEGRFRIPYFMSEDCEHLIRRMLVLDPSKRLSIAQIKEHKWMLIEVPVQRPILYPQEQENEPSIGEFNEQVLRLMHSLGIDQQKTIESLQNKSYNHFAAIYFLLVERLKSHRSSFPVEQRLDGRQRRPSTIAEQTVAKASNVEAFSFPASSCPAEAAFMEEECVDTPKVNGCLLDPVPPVLVRKGCQSLPSSMMETSIDEGLETEGEAEEDPSQAFEAFQATRSGQRRHTLSEVTNQLVVLPRAGKVFSMSDSPSLDSVDSEYDMGSAQRDLNFPEDSPSLKDIMLANQPSPRMTPFISLRPANPAMQALSSQRREAHNRSPEEISQRQESVSALSASMHPQLSPQRSLETPYLQHRLQKPSLLPKAQNACPMYCKEPPRSLEQQLQEHSYPASCHYPVDGAQQSNLTGAECPRSSGLQEALSALPGLFDYEMVEAVDPQHNGYVLKEAQFLEEYIQDLEARPGPMGKALTLTVTPVSEGCSYLQIGFESFFLSSSYSFPNDGVTETECLRTLTPKMSHQADGMGYSRVTGSNLVAVPGSSYRPLLHHSHPSIIGPEDTAGAPVTAEGEFCIFFTWL

SEQ ID NO: 20194 - protein, 454 aa, Rattus norvegicus
MALRSPERERGLRRGPGRHHRDINEGGRLRLACKVVSFVMASCTCIPKLLFTDYYFVHVGFLFLFRFTVYLGSCVPLGRGVQTTSGKEEKSFRAVGGQEGAIDGVGLGKRHEQCAGNSSVFSLDRAYQYTTLTSVQVREGLDVFWLLCFLEEDMYLYKSYLAFIGKLCIRRSPEHSLNSPHPCLIRKAVMGVQASYGPQMMEEHMLKMNGNLLAASMLLDCFGIPVLMALSWFILRARYKVIHFIAVFVCLLGVGTMVGADILAGREDNSGSDVLIGDILVLLGASLYAVSNVCEEYIVKKLSRQEFLGMVGLFGTIISGIQLLIVEYKDIARIQWDWKIALLFVAFALCMFCLYSFMPLVMKVTSATSVNLGILTADLYSLFFGLFLFEYKFSGLYILSFTVIMVGFILYCSTPTRTAEPAESSVPPVTSIGIDNLGLKLEESGLSETHSAVL

SEQ ID NO: 20195 - protein, 253 aa, Rattus norvegicus
MGLLTLIEKLNEHILLSSQKATRSRMEPEAPCPASIPSVERKFHVLVGVTGSVAALKLPLLVSKLLDIPGRADFSNRVSWPILIGGAQDKGSGQLEVTVVTTERAKHFYSPQDVPVTLYSDADEWEMWKRRSDPVLHIDLRRWADLMVVAPLDANTLGKVASGICDNLLTCVIRAWDLNKPLLFCPAMNTAMWEHPLTAQQVGQLKAFGYVEIPCVSKKLVCGDQGLGAMAEVEIIVAKVKDVLFQHGGIQQS

SEQ ID NO: 20196 - protein, 428 aa, Rattus norvegicus
MGPPPGIGVYCRGGCGAARLLAWCFLLALSPHAPGSRGAEAVWTAYLNVSWRVPHPGVNRTVWELSEEGVYGQDSPLEPVSGVLVPPDGPGALNACNPHTNFTVPTVWGSTVQVSWLALIQRGGGCTFADKIHLAYERGASGAVIFNFPGTRNEVIPMSHPGAGDIVAIMIGNLKGTKILQSIQRGIQVTMVIEVGKKHGPWVNHYSIFFVSVSFFIITAATVGYFIFYSARRLRNARAQSRKQRQLKADAKKAIGRLQLRTLKQGDKEIGPDGDSCAVCIELYKPNDVVRILTCNHIFHKTCVDPWLLEHRTCPMCKCDILKALGIEVDVEDGSVSLQVPVSNEASNTASPHEEDNRSETASSGYASVQGADEPPLEEHAQSANENLQLVNHEANSVAVDVVPHVDNPTFEEDETPDQEMAVREVKS

SEQ ID NO: 20197 - protein, 190 aa, Rattus norvegicus
MGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHGLHSYEKRLF

SEQ ID NO: 20198 - protein, 881 aa, Rattus norvegicus
MPIGRQGKRTITASSGSKWGRVNITAQCTVSRLLGRSHRPSTCNLSPQSIGSLRPGYLGVKVPTRRSISRPSNVRAHEVGGPLMTHISSVEAVQRHRGPCDHSLKCLSSKISERKLPGSWLPSGRGPLEKPVLGPRGAVMPMFSPQSSLHSVRAEHSPLKPRVVTVVKLGVQPLRKATLLLNRRSVQTFEQLLSDISEALGFPRWKNDRVRKLFTLKGREVKSVSDFFREGDAFIAMGKEPLTLKSIQLAMEELYPKNRALALAPHSRVPSPRLRSRLPSKLLKGSHRCGEAGSYGEVMGNKAVIRHQGKTSTELAPEDKARAQKKWVGGKQESENGGLPSPREATQEETHASGEKHLGVEIEKTSGEIVRCEKCKRETELQLGLQRGQCPPGTSELDLGRGQKRDSEKLVRTKSCRRASEAKSTDGEEGWKGDSHRGSPRDPPQELRRPNNNSDKKESRGSEAQESHPQGVAKAQKDLMEGLPAVEEGAVDARRDSRHTCRIKHAAWLRREQQAEPPQLPRTRGEEKEAEHEKKSGGLGGRRMLEKESKTKPEENRPERPSGRKLRPTGIISADVEKHYDIGRVIGDGNFAIVKECKHRETRQAYAMKIIDKSQLKGKEDIVDSEILIIQSLSHPNIVKLHEVYETEAEIYLIMEYVQGGDLFDAIIESVKFPEPDAAVMITDLCKALVHMHDKKIVHRDLKPENLLHQLLTDQRMVQRNEDKSTTLKLADFGLAKHVVRPIFTVCGTPTYVAPEILSEKGYGLEVDMWAAGVILYILLCGFPPFRSPERDQDELFNIIQLGQFEFLSPYWDNISDAAKDLVRNLLVVDPKKRYTAHQVLHHPWIGMVGHPSTVNPQKEESPSSEGRFQSQHKKVAEHVS

SEQ ID NO: 20199 - protein, 183 aa, Rattus norvegicus
MVNMIIQLLDDYPKGFIVGADNVGSKQMQQIRMSLREKAVVLMGKNTMMRKAIRGHLENNRALKKLLPHIRGNLIKTGDKVGASEATLLSMLNISPFSFGLIIQQVFDNGSIYSPEGVCNVAGVCLQIGYPTVASVPHSIINGYKRVLALSVETDYTFSVAEKAEAKEESEEPDEDVGFGLFD

SEQ ID NO: 20200 - protein, 298 aa, Homo sapiens
MTDAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFWLYFAGNLASGGAAGATSLCFVYPLDFARTRLAADVGKAGAEREFRGLGDCLVKIYKSDGIKGLYQGFNVSVQGIIIYRAAYFGIYDTAKGMLPDPKNTHIVISWMIAQTVTAVAGLTSYPFDTVRRRMMMQSGRKGTDIMYTGTLDCWRKIARDEGGKAFFKGAWSNVLRGMGGAFVLVLYDEIKKYT

SEQ ID NO: 20201 - protein, 353 aa, Hypocrea virens
MGCGMSTEDKEGKARNEEIENQLKRDKMMQRNEIKMLLLGAGESGKSTILKQMKLIHEGGYSRDERESFKEIIFSNTVQSMRVILEAMESLELPLEDQRMEYHVQTIFIQPAQIEGDVLPPEVGGAIEALWKDHGVQECFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 20202 - protein, 553 aa, Rattus norvegicus
MVQKKKKNNVWILGVGLYFTVVFDAIVIQQFRRQVVTGSISTDKMPKETEEELPTPTPEPSISEEGNFHSQYQVLGTIGQGGNAKVLLAHHRLTGTPVAVKVLRKDKQWFQPAVMEANIMRKINHPNIVSLIQVIEKETRIYLIMELVEGQELYQYIRESGHIEEDEARQIFEQILSAVSYCHGKGIVHRDLKLDNIMIDKYKKVKVIDFGLSTQFQPGKMLNHHCGTYSFGSPELLLGHQYDGPKNDMWIIGVVLYCMVVGKLPFASVIIQELQRQVVAGVYPAPCGVSKELEDLLSKLLRVNPNFRPTARKAMKHPWFKEHWNGLIGPYEELLPLTPDPAILDAMKSIGFQASVVKHSLKQRKYNEEMATYFFLQKQALQGDGCTAQAQQVSPVAAPFPSLDPAAAFRLEPKRRGSLPVLGTLRVSSSHGHISHYGQNAHPKGGKRYTVAGRLRPLPMTPTKDHYHKCAVSVPCIQTTSIFSEKSSNKEIKEDNPLSHRAPLEDKPIPSRVRHRGFKGWTRNIANALIKLCCCMPRRKKPRLGQNRISPQK

SEQ ID NO: 20203 - protein, 509 aa, Rattus norvegicus
MPTETEEELPTPTPEPSISEEGNFHSQYQVLGTIGQGGNAKVLLAHHRLTGTPVAVKVLRKDKQWFQPAMMEANIMRKINHPNIVSLIQVIEKKTRIYLIMELVEGQELYQYIRESGHIEEDEARQIFEQILSAVSYCHGKGIVHRDLKLDNIMIDKNKKVKVIDFGLSTQFQPGKMLNHHCGTYSFGSPELLLGHRYDGPKNDMWIIGVVLYCMVVGKLPFDSVIIQELQRQVVAGVYPAPCGVSKELEDLLSKLLRVNPNFRPTARKAMKHPWFKEHWNGLIGPYEEMLPLTPDPAILDAMKSIGFQASVVKHSLKQRKYNEEMATYFFLQKQALQGDGCTAQAQQMSPVAAPFPSLDPAAAFRLEPKRSGSLPVLGTLRVSSSHGHVSHYGQNAHPKGGKRSTVAGRLRPLPMTPTQDHYHKCAVSVPCIQTTSIFTEKSSNKEIKEDNPLSHRAPLEDKPIPSRVRHRGFKGWTRNIANALIKLCCCMPRRKKPRLGQNRISPQK

SEQ ID NO: 20204 - protein, 264 aa, Rattus norvegicus
MMGSLVYLRLGLEKSPYCHLLDNSHWAEICETFTRDACSLLGLSVESPLSVSFASGCVALPVLMNIKAVIEQRQCTGVWSHKDELPIEIELGMKCWYHSVFACPILRQQTSDSNPPIKLICGHVISRDALNKLINGGKLKCPYCPMEQNPADGKPFTSIPYSWNCLHQSSTGDGKDAGSPSKNSCGAAWEDSHVKKSGRCGKAAPKSYTEGKKSCWERVTVYQPNLAYIHVPLVNMFAITYTKLSSHGLQANTEYSHMAYKVSL

SEQ ID NO: 20205 - protein, 839 aa, Rattus norvegicus
MHQCIEKSFYSFIDTGTAGYLADPWKQDAREKLEKQQQMHLVDMLSKEIHELQNKGDGSAEESDCLWTLMLEWQFQKRLKTIFLVFLPAHGSPCLAYPQGAFAVASPASPWHLVSMGLETDSPEDSTSLLIVMNCRSLCSIVGGCCGDYNTRMTVSWGLCSVEGFPGLVGSISTDKMPTETEEELPTPTPEPSISEEGNFHSQYQVLGTIGQGGSAKVLLAHHRLTGTPVAVKVLRKDKQWFQPAMMEANIMRKINHPNIVSLIQVIEKETRIYLIMELVEGQELYQYIRESGHIEEDEARQIFEQILSAVSYCHGKGIVHRDLKLDNIMIDKIKKVKVIDFGLSTQFQPGKMLNHHCGTYSFGSPELFLGHRYDGLKNDMWIIGVVLYCMVVGKLPFDSVIIQELQRQVVAGVYPAPCGVLKELEDLLSKLLRVNPNFRPTARKAMKHPWFKEHWNGLIGPYEEMLPLTPDPAILDAMKSIGFQASVVKHSLKQRKYNEEMATYFFLQKQALQGDGCTAQTQQVSPVAAPFPSLDPAAAFRLEPKRSGSLPVLGTLRVSSSHGHISHYGQNAHPKGGKRYTVAGRLRPLPMTPTKDHYHKCAVSVPCIQTTSILSEKSSNKEIKEDKPLSHRAPLEDKPIPSRVRHRGSISTDKMPTEIEKELSPPRPDPSISQEGTFHSQYKVLKTIGKGSHAKVLLAHHQLTGTPVAVKVLRKNKQWFRPAMTEANIMRKINHPNIVSLLQVIENKTRIYLIMELVEGQQVYQYIRESGHIEEDEARQIFEQILPAVSYCHGKGIVHRDLKVDNIMIDKNKKVKVIDFQLSTETQPGHMLNQHCGA

SEQ ID NO: 20206 - protein, 913 aa, Rattus norvegicus
MSSPLKDKAWIGSSRQGTLWAYSKETATFHGTLLTERPVTSALAFVGLIHRGMQLRELHPNLVHRNSFRCHLIVTGFCSVSKEGKPSPVPGSISTDKMPTETEEELPPSSPDPSISQEGTFHSQYKVLKTIGKGSYAKVLLAHHQLTGTPVAVKVLRKNKQWFQPAMTEANIMRKINHPNIVSLLQVIENKTRIYLIMELVEGQQLYQYIRESGHIEEDEARQIFEQILSAVSYCHGKGIVHLDLKVDNIMIYKNKKVKVIDFGLSTKTQPGQMLNHHCGAYSFGSPERFLGLLYDGMKNDMWTIGVVLYYMVVGKLPFDSVIIQELQKQVVAGVYPAPCGVSEDLENLLSQLLTVNPMYRPTASEVMKQAWFKEHGKGFTVRCEELLPHRPDPEILGGISTDKMPTETEEELPPSSPDPSISQEGTFHSQYKVLKTIGKGSYAKVLLAHHQLTGTPVAVKVLRKNKQWFRPAMTEENIMRKINHPNIVSLLQVIENKTRIYLIMELVEGQQLYQYIRESGHIEEDEARQIFEQILSAVSYCHGKGIVHRDLKVDNIMIDKNKKVKVIDFGLSTETQPGQMLNQHCGAYSFGSPERFLGLLYDGMKNDMWTIGVVLYYMVVGKLPFDSVIIQELQKQVVAGVYPAPCGVSEELENLLSQLLTVNPMYRPTASEVMKHVWFKEHGKGFTVRCEELLPLRPDPEILGAMKCMGFQASVIKYSLIKRKYNEEMATYCFLQQQALPGYGCTAQAQQVSPIAAPFPSLDPAAAFRLQRKRSGSLPVLGTLQVSFSQGNVSHYGQKVHPKGGRRSTVACRLRPLPMTPTQDHYHKCAMSVPYIQTTSIFSEKSSNKEIKEDNLLSHRAPLEDKPISSRVGHRGFNGWTRNIANALIKLCCCLPRRKKPRLGQNRISPQK

SEQ ID NO: 20207 - protein, 412 aa, Rattus norvegicus
MPTETEEELPPSSPDPSISQEGTFHSQYKVLKTIGKGSYAKVLLAHHQLTGTPVAVKVLRKNKQWFRPAMTEENIMRKINHPNIDSLFQVIENKTRIYLIMELVEGQQLYQYIRESGHIEEDEARQIFEQILSAVSYCHGKGIVHRDLKVDNIMIDKNKKVKVIDFGLSTKTQPGQMLNQHCGAYSFGFPERFLGLLYDGMKNDMWTIGVVLYYMVVGKLPFDSVIVQELQKQVVAGVYPAPCGVSEELENLLSQLLTVNPMYRPTASEVMKHAWFKEHGKGFTVRCEELLPLRPDPEILEGSSKRRKKVHCGWSSQATTDDTYTGPLCAVSVPCIQTTSNFSEKSSNKEIKEDNPLSHRAPLEDKPIPSRVRHRGFKGWTRNIANALIKLCCCLPRRKKPRLGQNRISPQK

SEQ ID NO: 20208 - protein, 2528 aa, Rattus norvegicus
METGQTEPSGIHSLRDLCPGVAATGSISTDKMPTETEEELPTPTPEPSISEEGNFHSQYQVLGTIGQGGNAKVLLAHHQLTGTPVAVKVLRKDKQWFQPAMMEANIMRKINHPNIVSLIQVIEKETRIYLIMELVEGQELYQYIRESGHIEEDEARQIFEQILSAVSYCHGKGIVHRDLKLDNIMIDKNKKVKVIDFGLSTQFQPGKMLNHHCGTYSFGSPELLLGHRYDGPKNDMWIIGVVLYCMVVGKLPFDSVIIQELQRQVVAGVYPAPCGVSKELEDLLSKLLRVNLNFRPTARKAMKHPWFKEHWNGLIGPYEEMLPLTPDPAILDAMKSIGFQASVVKHSLKQRKYNEEMATYFFLQKQALQGDGCTAQAQQVSSLAAPFPSLDPAAAFRLEPKRSGSLPVLGTLRVSSSHGHVSHYGQNAHPKGGKRSTVAGRLRPLPMTPTQDHYHKCAVSVPCIQTTSIFTEKSSNKEIKEDNPLSNRAPLEDKPIPSRVRHRGSISTDKMPTEIEKELPPPRPDPSISQEGTFHSQYKVLKTIGKGSHAKVLLAHHQLTGTPVAVKVLRKNKQWFQPAMTEANIMRKINHPNIVSLLQVIENKTRIYLIMELVEGQQLYQYIRESGHIEEDEAQQIFEQILSAVSYCHGKGIVHRDLKVDNIMINKNKKVKVIDFQLSTETQPGHMLNQHCGAYSFGSPELFLGLLYDGMKNDMWTIGVILYYMVVGKLPFDSVIIQELQIQVVAGVYPTPCGVSEELENLLTQLLTVNPTYRPTASSISTDKMPTEIEKELPPPRPDPSISQEGTSYSQHKVLKTIGKGSHAKVLLAHHQLTGTPVAVKVLRRNKQWFRPAMTEANIMRKINHPNIVSLLQVIENKTRIYLIMELVEGQQLYQYIRESGHIEEDEARQIFEQILSAVSYCHGKGIVHRDLKVDNIMIDKNKKVKVIDFRLSTKTQPGHMLNQHCVIIQELQIQVVAGVYPAPCGVSEELENLLSQLLTVNPMYRATASAFRLQRKRSGSLPVLDTLQVSFSHGQVSQYGQKAHPKGGRSFYGLNLISDSLELDLNPNHREALGTEDNKSNRQHLLHCFSLCSTRQGSSHTGGIQPNSQQGECEMSVDEPTLQYDSVGRHLVASGAAAAVRTHGTTVEVEEAENNRRGAQYVLSLDNKCLLNHTDSSRLSHPAKPETAHWWTSWFLKSFSLASCFHGSGDRLPRGQLLFTDSYELQIPVLNSGGLLRGLQHQNDCFLGLCSVEGFPGLVGVVKEEKEAGSISTDKMPTETEEELPTPTPEPSISEEGNFHSQYQVLGTIGQGGNAKVLLAHHRLTGTPVAVKVLRKDKQWFQPAMMEANIMRKINHPNIVSLIQVIEKETRIYLIMELVEGQELYQYIRESGHIEEDEARQIFEQILSAVSYCHGKGIVHRDLKLDNIMIDKNKKVKVIDFGLSTQFQPGKMLNHHCGTYSFGSPELLLGHRYDGPKNDMWIIGVVLYCMVVGKLPFDSVIIQELQRQVVAGVYPAPCGVSKELEDLLSKLLRVNPNFRPTARKAMKHPWFKEHWNGLIGPYEEMLPLTPDPAILDAMKSIGFQASVVKHSLKQRKYNEEMATYFFLQKQALQGDGCTAQAQQVSPVVAPFPSLDPAAAFRLEPKRSGSLPVLGTLRVSSSHGHVSHYGQNAHPKGGKRSTVAGHLRPLPMTPTQDHYHKYSVSVPCIQTTSIFTEKSSNKEIKEDNPLSHRAPLEDKPIPSRTEPSGIHSLRDLCPGVAATGSISTDKMPTETEEELPTPTPEPSISEEGNFHSQYQVLGTIGQGGSAKVLLAHHRLTGTPVAVKVLRKDKQWFQPAMMEANIMRKINHPNIVSLIQVIEKETRIYLIMELVEGQELYQYIRESGHIEEDEARQIFEQILSAVSYCHEKGIVHRDLKLDNIMIDKNKKVKVIDFGLSTQFQPGKMLNYHCGTYSFGSPELLLGHRYDGPKNDMWIIGVVLYCMVVGKLPFDSVIIQELQRQVVAGVYPAPCSISTDKMPTETEEELPTPTPEPSISEEGNFHSQYQVLGTIGQGGSAKVLLAHHRLTGTPVAVKVLRKDKQWFQPAMMEANIMRKINHPNIVSLIQVIEKETRIYLIMELVEGQELYQYIRESGHIEEDEARQIFEQILSAVSYCHEKGIVHRDLKLDNIMIDKNKKVKVIDFGLSTQFQPGKMLNYHCGTYSFGSPELLLGHRYDGPKNDMWIIGVVLYCMVVGKLPFDSVIIQELQRQLVAGVYPAPCGVSKELEDLLSKLLRVNPNFRPTARKAMKHPWFKEHWNRLIGPYEEMLPLTPDPAILDAMKSIGFQASVVKHSLKQRKYNEEMATYFFLQKQALQGDGCTAQAQQVSHVVAPFPSLDPAAAFRLEPKRSGSLPVLGTLRVSSSHGHVSHYGQNAHPKGGKRSTVAGRLRPLPMTPTQDHYHKCAVSVPCIQTTSIFTEKSSNKEIKEDNPLSHRAPLEDKPIPSRVRHRGFKGWTRNIANALIKLCCCMPRRKKPRLRQNRISPQK

SEQ ID NO: 20209 - protein, 1460 aa, Rattus norvegicus
MPFTDSFKTNTGHICNTALDNDLTYISSLYRPAPYAKTRLKDHGTQEQHQGPNTTPSAPWQPHDHQTASKEAMVPATHDQGRDNDDGRPPEQHLTSPSKSSLKDNSFMKTPENGDFSSSEQGLNMTDVYPRRQSCPVTPCHYQDGITTKRKRFPQDFSSSEQGLNMTDVYPRRQSCPVTPCLYQDGITTKRKRFPQGSISTDKMPTETEEELPTPTPEPSISEEGNFHSQYQVLGTIGQGGNAKVLLAHHRLTGTPVAVKVLRKDKQWFQPAMMEANIMRKINHPNIVSLIQVIEKKTRIYLIMELVEGQELYQYIRESGHIEEDEARQIFEQILSAVSYCHGKGIVHRDLKLDNIMIDKNKKTEPSGIHSLRDLCPGVAATGSISTDKMPTETEEELPTPTPEPSISEEGNFHSQYQVLGTIGQGGNAKVLLAHHRLTGTPVAVKVLRKDKQWFQPAMMEANIMRKINHPNIVSLIQVIEKETRIYLIMELVEGQELYQYIRESGHIEEDEARQIFEQILSAVSYCHGKGIVHRDLKLDNIMIDKNKKVKVIDFGLSTQFQPGKMLNHHCGTYSFGSPELLLGHRYDGPKNDMWIIGVVLYCMVVGKLPFDSVIIQELQRQVVAGVYPAPCGVSKELEDLLSKLLRVNPNFRPTARKAMKHPWFKEHWNGLIGPYEEMLPLTPDPAILDAMKSIGFQASVVKHSLKQRKYNEEMATYFFLPKQALQGDGCTAQAQQVSPVVAPFPSLDPAAAFRLEPKRSGSLPVLGTLRVSSSHGHVSHYGQNAHPKGGKRSTVAGRLRPLPMTPTQDHYHKCAVSVPCIQTTSIFTEKSSNKEIKEDNPLSHRTPFEDRPIPSRVRHRELEDLLSKLLRVNPNFRPTARKAMKHPWFKEHWNGLIGPYEEMLPLTPDPAILDAMKSIGFQASVVKHSLKQRKYNEEMATYFFLQKQALQGDGCTAQAQQVSPVAAPFPSLDPAAAFRLEPKRSGSLPVLGTLRVSSSHGHVSHYGQNAHPKGGKRSTVAGCLRPLPMTPTQDHYHKCAGECEMSVDEPTGDYRILWEEHLVASGAAAAARTHELQWRQGSSHTAGIQPNSQQGECEMSVDEPTGTTGFCGKTSGSISTDKMPTETEEELPPSSPDPSISQEGTFHSQYKVLKTIGKRSHAKVLLAHRRLTGTRVAVKVLRKNKQWFRPAMTEANIMRKINHPNIVSLLQLTGTPVAVKVLRKNKQWFRPVMTEANIMRKINHPNIVSLLQVIENKTRIYLIMELVEGQQLYQYIRESGHIEEDEARQIFEKILSAVSYCHGKGIVHRDLKVDNIMIDKNKKVKVIDFRLSTKTQPGHMLNQHCVRRSYNTQDLSRISEEVYFHCQYKDLRTMGHRSNTKVPIPHHQLPGSPMTIKLLLKKQWCQPLMTKAETMMMVDHLNSILFPQSFHREEEGAKEIFRQMLAGFIYGYGHCISSQ

SEQ ID NO: 20210 - protein, 509 aa, Rattus norvegicus
MPTETEEELPTPTPEPSISEEGNFHSQYQVLGTIGQGGNAKVLLAHHRLTGTPVAVKVLRKDKQWFQPAMMEANIMRKINHPNIVSLIQVIEKETRIYLIMELVEGQELYQYIRESGHLEEDEARQIFEQILSAVSYCHGKGIVHRDLKLDNIMIDKNKKVKVIDFGLSTQFQPGKMLNHHCGTYSFGSPELLLGHRYDGPKNDMWIIGVVLYCMVVGKLPFDSVIIQELQRQVVAGVYPAPCGVSKELEDLLSKLLRVNPNFRPTARKAMKHPWFKEHWNGLIGPYEEMLPLTPDPAILDAMKSIGFQASVVKHSLKQRKYNEEMATYFFLQKQALQGDGCTAQAQQVSPVVAPFPSLDPAAAFRLEPKRSGSLPVLGTLRVSSSHGHVSHYGQNAHPKGGKRSTVAGRLRPLPMTPTQDHYHKCAVSVPCIQTTSIFTEKSSNKEIKEDNPLSHRAPLEDKPIPSRVRHRGFKGWTRNIANALIKLCCCMPRRKKPRLGQNRISPQK

SEQ ID NO: 20211 - protein, 1843 aa, Rattus norvegicus
  unsure (1)..(1843): unsure at all Xaa locations
MMEANIMRKINHPNIVSLIQVIEKETRIYLIMEMVEGQELYQYIRESGHIEEDEAQQIFEQILSAVSYCHGKGIVHRDLKLDNIMIDKNKXXKVIDFGLSTQFQPGKMLNHHCGTYCFGSPELLLGHRYDGPKNDMWIIGVVLYCMVAGKLPFDSVIIQELQRQVVAGVYPAPCGVSKELEDLLSKLLRVNPNFRPTARKAMKHPWFKEHWNGLIGPYEELLPLTPDPAILDAMKSIGFQASVVKHSLKQRKYNEEMATYFFLQKQALQADGCTAQAEQIRTKEEWKPASPWHLAGVILPWSRISLWPECSSKRRQKIHCGWSSQASTDDTNTGPLSQMCQPSGIHSLRDSIPGLEATGSISTDKMPTEIEKVLPPPRPDPSISQEGTFHSQYKVLKTIGKGSHAKVLLAHHQLTGTPVAVKVLRKNKQWFRPVMTEANIMRKINHPNIVSLLQVIENKTRIYLIMELVEGQQLYQYIRESGHIEEDEARQIFEKILSAVSYCHGKGIVHRDLKVDNIMIDKNKKVKVIDFQLSTETQPGHMLNQHCVGKLPFDSVIIQELQIQVVAGVYPAPCGVLEELENLLSQLLTVNPMYRPTASEVMKHAWFKEHGKGFTGRCEELLPLSAPAVDSGNSEHHTENNLSDYRVKFLLVLQSHQRRNKIPKISDSHTQMHIQRQDKSGLSKVRQATHTPHGSEPISNRPEDYQGSKLDTRDSFIFRSEFLLGLIKYQKDHEFPMAKLAGAMFIPRELLEIPDLHFALPFTSNYSVECSISTDKMPTETEEELPPSSPDPSISQEGTFHSQYKVLKTIGKGSYAKVLLALHQLTGTPVAVKVLRKNKQWFRPAMTEENIMRKINHPNIVSLLQVIENKTRIYLIMELVEGQQLYQYIRESGHIEEDEARQIFEQILSAVSYCHGKGIVHRDLKVDNIMIDKNKKVKVIDFGLSTETQPGQMLNQHCGAYSFGSPECFLGLLYDGMKNDMWTIGVVLYYMVVGKLPFDSVIIQELQKQVVAGVYPAPCGVSEELENLLSQLLTVNPMYRPTASEVMKHAWFKEHGKGFTVRCEELLPLRPDPEILVSAQPHSSHHTVSAQQHYSHHTVSAQRHSSHHTVSAQQYSSHHTVSAQQHSSHNKLECRTPFTDSFKTNTGHICNTALDNDLTYISSLYRPAPYAKTRHLKPKNIVLYINGKVKITNFGLSIQFQSGHLKPKNIVLYINGKGGVLYFMAVRKFPFDSLFILELRRQVVARVCGASDFSSSEQGVNMTDVYPRLQSCPVTPCLYQDGITTKRKRFPQGSISTDKMPTETEEELPTPTPEPSISEEGNFHYQYQVLGTIGQGGNAKVLLAHHRLTGTPVAVKVLRKDKQWFQPAMMEANIMRKINHPNIVSLIQVIEKETRIYLIMELVEGQELYQYIRESGHIEEDEARQIFEQILSAVSYCHGKGIVHRDLKLDNIMIDKNKKVKVIDFGLSTQFQPGKMLNHHCGTYSFGSPELLLGHRYDGPKNDMWIIGVVLYCMVVGKLPFDSVIIQELQRQVVAGVYPAPCGVSKELEDLLSKLLRVNPNFRPTARKAMKHPWFKEHWNGLIGPYEEMLPLTPDPAILDAMKSIGFQASVVKHSLKQRKYNEEMATYFFLQKQALQGDGCTAKAQQIRTKEEWKPASPWHLAGVILPWSRISLWPECSSKRRQKIHCGWSSQATTDETYTGPLSQMCLIDFGLSTKTQPGHMLNQHCGAYSFGSPERFLGLLYDGMKNDMWTIGVVVYYMVVGKLPFDSVIIQELQKQVVGGVYPAPCGVSEDLENLLSQLLTVNPMYRPTASEVTYLIMARRFIQKEEEGPLWLVVSGHYR

SEQ ID NO: 20212 - protein, 1754 aa, Rattus norvegicus
MGNDMEQTLTHSADKITPSPYSQTYFINSCCNSADPATVEALKKRRFCDSEGPLKVEALRSWRSIYLQGSCCTIEGSATVEAETLETLGSGVTVPDSKTEPSGIHSLRDLCPGVAATGSISTDKMPTETEEELPTPTPEPSISEEGNFHSQYQVLGTIGQGGNVKVLLAHHRLTGIPVAVKVLRKDKQWFQPAMMEANIMRKINHPNIVSLIQVIEKETRIYLIMELVEGQELYQYIRESGHIEEDEARQIFEQILSAVKVIDFGLSTQFQPGKMLNHHCGTYSFGSPELLLGHRYDGPKNDMWIIGVVLYCMVVGKLPFDSVIIQELQRQVVAGVYPAPCGVSKELEDLLSKLLRVNPNFRPTARKAMKHPWFKEHWNGLIGPYEELLTLTPDPAILDAMKSIGFQASVVKHSLKQRKYNEEMATYFFLQKQALQGDGCTAQAQQIRTKEEWKPASPWHLAGVILPWSRISLWPECSSKRRQKIHCGWSSQATTDDTYTGPLSQMCRSISTDKMPTEIEKVLPPPRPDPCISQEGTFHSQYKVLKTIGKGSHAKVLLAYHQLTGSPVAVKVLRKDKQWFQPAMTEANIMRKINHPNIVSLLQVIENKTRIYLIMELVEGQQLYQYIRESGHIEEDEARQIFEQILSAVSYCHGKGIVHRDLKLDNIMIDINKKVKVIDFGLSTKTQPGHMLNQHCGAYSFGSPELFLGLLYDGMKNDMWTIGVVLYYMVVGKLPFDSVIIQELQIQVVAGVYPTPCGVSEELENLLSQLLTVNPMYRPTDSEVMKYAWFKEHGKGFTGRHEELLPLRTDPEILGAMKCMGFQASVIKYSLIKRKYNEEMATYCFLQQQALPGYGCTAQAQQVPPVTVPFPSLDTAAAFRLEPKGSESLPVLGTLRVSSSHGQVSHYGQKGHPKAGKRTTVAGHLRPLPMTPTQDLYHKCAMSVPCIQTSIFSEKSSNEEIKEDNSLSYRAPLEDKPIPSRVRHRGFKGPGFLGCPSFLVYPVPHGVCSFYGLNLISDTLELDLNPNHREALGTEDNKSNRKHLLHCFSLCSTRQGSSHTGGIQPNSQQGECEMSVDEPTLQYDSVGRHLVASGAAAAVRTHGTTVEPRRSRVIKQVQSMGSDMVHGSISTDKMPTETEEELPTPTPEPSISEEGNFHSQYQVLGTIGQGGNAKVLLAHHRLTGTPVAVKVLRKDKQWFQPAMMEANIMRKNNHPNIVSLIQVIEKETRIYLIMELVEGQELYQYIRESGHIEEDEARQIFEQILSAVSYCHGKGIVHRDLKLDNIMIDKNKKVKVIDFGLSTQFQPGKMLNHHCSTYSFGSPELLLGHRYDGPKDDMWIIGVVLYCMVVGKLPFDSVIIQELQRQVVAGVYPAPCGVSKELEDLLSKLLRVNPNFRPTARKAMKHPWFKEHWNGLIGPYEEMLPLTPDLAILDAMKSIGFQASVVKHSLKQRKYNEEMATYFFLQKQALQGDGCTAQAQQIRTKEELKPASPWHLAGVTLPWSRISLWPECSSKRRQKIHCGWSSQASTDDTYTGPLSQMCRSISTDKMPTETEEELPPSSPDPSISQEGTFHSQYKVLKTIGKGSHAKVLLAHHQLTGTPVAVKVLRKNKQWFRPAMTEENIMRKINHPNIVSLLQVIENKTRIYLIMELVEGQQLYQYIRESGHIEEDEARQIFEQILSAVSYCHGKGIVHRDLKVDNIMIDKNKKVKVIDFGLSTETQPGQMLNQHCEDLENLLSQLLTVNPIIDQQPAR

SEQ ID NO: 20213 - protein, 1152 aa, Rattus norvegicus
MVDKNNKVKIIDIGHSTQDKPEQMLNLYYGANTFDAPELFLGYTYDDFSSSEQGLNMTDVYPRLQSCPVTPCLYQDGITTKRKRFPQGSISTDKMPTETEEELPTPTPEPSISEEGNFHSQYQVLGTIGQGGNAKVLLAHHRLTGTPVAVKVLRKDKQWFQPAMMEANIMRKINHPNIVSLIQVIEKEMRIYLIMELVEGQELYQYIRESGHIEEDEARQIFEQILSAVSYCHGKGIVHRDLKLDNIMIDKNKKVKVIDFGLSTQFQPGKMLNHHCGTCSFGSPELLLGHRYDGPKNDMWIIGVVLYCMVAGKLPFDSVIIQELQRQVVAGVYPAPCGVSKELEDLLSKLLRVNPNFRPTARKAMKHPWFKEHWNGLIGPYEELLPLTPDPAILDAMKSIGFQASVVKHSLKQRKYNEEMATYFFLQKQALQGDGCTAQAQQVSPVAAPFPSLDPAAAFRLEPKRSGSLPVLGTLRVSSSHGHVSHYGQNAHPKGGKRSTVAGRLRPLPMKPTQDHYHKCAVSVPCIQTTSIFSEKSSNKEIKGDNPLSHRAPFEDKPIPSRLLRAEFTSVILELDHNHTTGKPWALRTLRAADNISSAASDSAPQAKAAPTQQASSLTPSRESVRCLWMSPQGLQDSVGRHLVASGAAAAARTHELQWRISPEVLDTEIREEANTNSNRLVYRNKNTTEAKTGNDMEQTLTHSADKITPSPYSQTYFINSVHSAGAYSFGSPELFLGLLYDGTKNDMWTIGVVLYYMVVGKLPFDSVIIQELQKQVVSGVYPAPCGVSEELENLLSQLLTVNPMYRPTDSEEPPRDLHRSVVHANQNAGLEIKFWVEEAENKRRGAQYVLSLDNKCLFNHTDSPRLSHPAKPETAHWWTSWFLKSYLNSIDYGSQVGHVEAKKLAAEHGIVAQGISTPRILMRWTALTCDTGVAEPSGIHSLRDSIPGLEATGTRVAVKVLRKDKQWFWPAMTEANIMRKINHPNIVSLLQVIENKTRIYLIMELVEGQQLYQYIRESGHIEEDEARQIFEQILSAVSYCHGKGIVHRDLKLDNIMIDKNKKVKVIDFGLSTETQPGQMLKQQCGAYSFGSPELFLGLLYDGMKNDMWKIGVVLYYMVVGKLPFDSMIFQELQKQLVAGVYPAPCGVSEEL

SEQ ID NO: 20214 - protein, 634 aa, Rattus norvegicus
MATYCFLQQQALQGDGCTAQAQQTGSLTGLQLPKYLGWLTSRSQAFGSISTDKMPTETEEELPTPTPEPSISEEGNFHSQYQVLGTIGQGGNAKVLLAHHRLTGTPVAVKVLRKDKQWFQPAMMEANIMRKINHPNIVSLIQVIEKETRIYLIMELVEGQELYQYIRESGHIEEDEARQILEQILSAVSYCHGKGIVHRDLKLDNIMIDKNKKVKVIDFGLSTQFQPGKMLNHHCGTYSFGSPELLLGHRYDGPKNDMWIIGVVLYCMVVGKLPFDSVIIQELQRQVVAGVYPAPCGVSKELEDLLSKLLRVNPNFRPTARKAMKHPWFKEHWNGLIGPYEEMLPLTPDPAILDAMKSIGFQASVVKHSLKQRIYNEEMATYFFLQKQALQGDGCTAQAQQMSPVAAPFPSLDPAAAFRLEPKRSGSLPVLGTLRVSSSHGHVSHYGQNAHPKGGKRSTVAGRLRPLPMTPTQDHYHKCAVSVPCIQTTSIFTEKSSNKEIKEDNPLSHRAPLEDKPIPSRVRHRDPAILDAMKSIGFQASVVKHSLKQRKYNEEMATYFFLQQQALQGDGCTAQSQQVEEAENDRRGDQYVLSLDNKCLLNHTDSPRLSHPAKPETTHWWTSWFLKRLALSMA

SEQ ID NO: 20215 - protein, 885 aa, Rattus norvegicus
MPTETEEELPTPTPEPSISEEGNFHSQYQVLGTIGQGGNAKVLLAHHRLTGTPVAVKVLRKDKQWFQPAMMEANIMRKINHPNIVSLIQVIEKKTRIYLIMELVEGQQLYQYIRESGHIEEDEARQIFEQILSAVSYCHGKGIVHRDLKLDNRMIDKNKKVKVIDFGLSTQFQPGKMLNHHCGTYSFGSPELLLGHRYDGPKNDMWIIGVVLYCMVVGKLPFDSVIIQELQRQVVAGVYPAPCGVSKELEDLLSKLLRVNPNFRPTARKAMKHPWFKEHWNGLIGPYEEMLPLTPDPAILDAMKSIGFQASVVKHSLKQRKYNEEMATYFFLQKQALQEDGCTAQAQQMSPVAAPFPSLDPAAAFRLEPKRSGSLPVLGTLRVSSSHGHVSHYGQNAHPKGGKRSTVAGRLRPLPMTPTEDHYHKCAYLFEGTFHSQYKVLKTIGKGSHAKVLLAHRRLTGTPVAVKVLRKNKQWFRPAMTEANIIRKINHPNIVSLLQVIENKTRIYLIMELVEGQQLYQYIRESGHIEEDEARQIFEQILSAVSYCHGKGIVHRDLKVDNIMIGKNKKVKVIDFGLSTETQPGKMLNQHCGVYSFGFPERFLGLLYDGMKNDMWTIGVVLYYMVVGKLPFDSVIIQELQKQVVAGVYPAPCGVSEDLENLLSQLLTVNPMYRPTASEVMKHAWFKEHGKGFTVRCEELLPLRPDPEILQALPGYGCTAQAQQVSPIAAPFPSLDPAAAFRLQRKRSGSLPVLGTLQVSFSQGHVSHYGQKVHPKGGRRSTVAGRLRPLPMTPTQDHYHKCAMSVPYIQTTSIFSEKSSNKEIKEDNLLSHRAPLEDKPISSRVGHRGFKGWTRNIANALIKLCCCLPRRKKPRLGQNRISPQK

SEQ ID NO: 20216 - protein, 575 aa, Rattus norvegicus
MEDNGWPHDHQTASKDAMVPATHDQGRDNDDGRPPEQHLISPSKSSLKDNSFMKTPENGGSISTDKMPTETEEELPTPTPEPSISEEGNFHSQYQVLGTIGQGGNAKVLLAHHRLTGTPVAVKVLRKDKQWFQPAMMEANIMRKINHPNIVSLIQVIEKETRIYLIMELVEGQELYQYIRESGHIEEDEARQIFEQILSAVSYCHGKGIVHRDLKLDNIMIDKNKKVKVIDFGLSTQFQPGKMLNHHCGTYSFGSPELLLGHRYDGPKNDMWIIGVVLYCMVVGKLPFDSVIIQELQRQVVAGVYPAPCGVSKELEDLLSKLLRVNPNFRPTARKAMKHPWFKEHWNGLIGPYEEMLPLTPDPAILDAMKSIGFQASVVKHSLKQRKYNEEMATYFFLQKQALQGDGCTAQAQQVSPVVAPFPSLDPAAAFRLEPKRSGSLPVLGTLRVSSSHGHVSHYGQNAHPKGGKRSTVAGRLRPLPMTPTQDHYHKCAVSVPCIQTTSIFTEKSSNKEIKEDNPLSHRAPLEDKPIPSRVRHRGFKGWTRNIANALIKLCCCMPRRKKPRLGQNRISPQK

SEQ ID NO: 20217 - protein, 596 aa, Rattus norvegicus
MILRECLAAGFTAGVSPETAEAQLGQGSHTRYNVCIVAYGQTGIEKSYTMLELHFEEESGLLSGVEEDSGSSPEQLRNSSGSISTDKMSTETEEELPPPSPDPSISEEGTFHSQYKVLKTIGKGSHAKVLLAHHRLTGTPVAVKVLRKNKQWFRPAMTEANIMRKINHPNIVSLLQVIENKTRIYLIMELVEGQQLYQYIRESGHIEEDEARQIFEQILSAVSYCHGKGIVHRDLKLDNIMIDKNKKVKVIDFGLSIQTQPGEMLNQHCGAYSFGSPELFLGLLYDGMKNDMWTIGVVLYYMVVGKLPFDSVIIQELQKQVVAGVYPAPCGVSEELENLLSQLLTVNPMYRPTASEVMKHAWFEEHGKGFTGRYEELLPLTPDLAILDAMKSMGFQASVIKYSLMKRKYNEEMATYCFLQQQALQGYGCTAQAQQVSPVAAPFPSLDPAAAFRLEQKRGGSLPVLGTLRVSSSHGQVSHYGQKAHPKAGKRTTVAGHLRPLPMTPTQDHYHKCAMSVPCIQTTSIFSKKSSNKEIKEDNLLSHRAPLEDKPIPSRVRHRGFKGWTRNIANALIKLCCCLPRRKKPRLGQNSISPQK

SEQ ID NO: 20218 - protein, 1230 aa, Rattus norvegicus
MKRGEKPEGYRQMRPKTFPASNYSGSSRQMLQEIRESLRNLSKPSDAAKAEHNLNKMSTEDPRQVRNPPKFGTHHKALQEIRNSLLPFANETSSSRIPSEVNPQMFQDLQAAGFDEDMVIQALQKTNNRSIEAAVEFISKMSYQDPRREQMAAAAARPINATMKPGNVQHSISRKQSWKGSKESLVPQRHGPSLGENVVYRSESPNSQADVGRPLSGSGITAFAQAHPSNGQRVNPPPPPQVRSVTPPPPPRGQTPPPRGTTPPPPSWEPNSQTKRYSGNMEYVISRISPVPPGAWQEGYPPPPLNTSPMNPPNQGQRGISSVPVGRQPIIMQSTSKFNFTPGRPGVQNGGGQTDFIMHQNVVPTGAVNRQPPPPYPLTPANGQSPSALQAGGPAAPPSFSNGNVPPTMMVPNRNSHNMELYNINVPGLQTTWPQSSSAPVQSSPSSGHEIPTWQPNIPVRSNSFNNPLGSRASHSANSQPSATTVTAITPAPIQQPVKSMRVLKPELQTALAPTHPSWMPQPVQTVQPSPFSEGAASNVPVIPPVAEAPSYQGPPPPYPKHLLHQTPSVPPYESASKPCKDDQPSSAKEEDSEKSLDSVDSGDKEKKQITTSPITVRKNKKDEERRESRIQSYSPQAFKFFMEQHVENVLKSHQQRLHRKKQLENEMMRVGLSQDAQDQMRKMLCQKESNYIRLKRAKMDKSMFVKIKTLGIGAFGEVCLARKVDTKALYATKTLRKKDVLLRNQVAHVKAERDILAEADNEWVVRLYYSFQDKDNLYFVMDYIPGGDMMSLLIRMGIFPENLARFYIAELTCAVESVHKMGFIHRDIKPDNILIDRDGHIKLTDFGLCTGFRWTHDSKYYQSGDHPRQDSMDFSSEWGDPSNCRCGDRLKPLERRAARQHQRCLAHSLVGTPNYIAPEVLLRTGYTQLCDWWSVGVILFEMLVGQPPFLAQTPLETQMKVINWQTSLHIPPQAKLSPEASDLIIKLCRGPEDRLGKNGADEIKAHPFFKTIDFSSDLRQQSASYIPKITHPTDTSNFDPVDPDKLWSDGNEEENINDTLNGWYKNGKHPEHAFYEFTFRRFFDDNGYPYNYPKPIEYEYVSSQGSEQQSDEDDQHTGSDVNNRDLVTAKVLPPPHNRVSSGHSLRCLRGSVHICDMVITITRTEGNFTRDKLHGENLLEDTGQNRVQQILETSCHLEEEMNGTCFLGHISLAVRQKKERIQSRSLSPT

SEQ ID NO: 20219 - protein, 190 aa, Rattus norvegicus
MEEKVESTTVPDGSCVVSVQETEKWMEEAMRMAKEALENIEVPVGCLMVYNNEVVGKGRNEVNQTKNATRHAEMVAIDQVLDWCHRHGQSPSAVFEHTVLYVTVEPCIMCAAALRLMIMNVVWSPFITVYTAVGHGTHIRSWPILTSCSSLQCIPGYRAEEAVELLKTFYKQENPNAPKSKVRKKDCQKS

SEQ ID NO: 20220 - protein, 257 aa, Rattus norvegicus
MYEQLKDEWNRKSPNLSKCGEELGRLKLVLLELNFLPTTGTKLTKQQLILARDILEIGAQWSILCKDIPSFERYMAQLKCYYFDYKEQLPESAYMHQLLGLNLLFLLSQNRVAEFHTELERLPAKDIQTNVYIKHPVSLEQYLMEGSYNKVFLAKGNIPAESYTFFIDILLDTIRDEIAGCIEKAYEKILFAEATRILFFSTPKKMTDYAKKRGWLLGPNNYYSFASQQQKPEDSTIPSTELARQVIEYARQLEMIV

SEQ ID NO: 20221 - protein, 301 aa, Rattus norvegicus
MTRHGKNCTAGAVYTYHEKKKDTAASGYGTQNIRLSRDAVKDFDCCCLSLQPCHDPVVTPDGYLYEREAILEYILHQKREIARQMKAYEKQRGARREEQKELQRAAAQDQVRGFLEKESAIVSRPLNPFMPKAATLPNTDGEQPGPSVGPLGKDKDKALPSFWIPSLTPEAKATKLEKPSRTVTCPMSGKPLRMSDLTSVRFTQLDDSVDRVGLITRSERYVCAVTRDSLSNATPCAVLRPSGAVVTLECVEKLIRKDMVDPVNGDTLTERDIIVLQRGGTGFAGSGVKLQAEMSRPVMQA

SEQ ID NO: 20222 - protein, 122 aa, Rattus norvegicus
MTVILPGMDSRKQRMKVQPQNDQDSILSRVQKGARHGLLLLQNKAPSWSDESGAYVLNFHGRVTRASVKNFQIVHPDEPDHLVLQFGRVAPNIFTMDFRYPLCPLQAFAICLSSFDGKLACE

SEQ ID NO: 20223 - protein, 277 aa, Rattus norvegicus
MTALHCPLPFTEFITSSRSIAAMSDKLPYKVTDIGLAAWGQKALDRAENEMPGLMRMREKYSASKPLMSTCTAGCLHLIVKTAILIETVVALGAEVQRSRCNIFCTQDHAAAAIAKAGIPMLHFKDEPLNMILDDGGDFTNLIHTKYPQLLSGILGISEETMTEVHNHYKMMANGILKVPAINVNNSVTKNKFDNFYGCWESLIDGIKGATDVMISNRVVVVTGYGDVAAMKGYEVTTIDEACKEGNIFVTTIGCVDIILGWHFEQIKASATASSSN

SEQ ID NO: 20224 - protein, 1173 aa, Rattus norvegicus
MAGAQPGVHALQLKPVCVSDSLKKGTKFVKWDDDSTIVTPIILRTDPQGFFFYWTDQNKETELLDLSLVKDARCGKHAKAPKDPKLRELLDVGNIGHLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPDVYRVFLNNLCPRPEIDNIFSEFGAKSKPYLTVDQMMDFINLKQRDPRLNEILYPPLKQEQVQVLIEKYEPNSSLAKKGQMSVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSVFEPSSPGAGEADTESDDDDDDDDCKKSSMDEGTAGSEAMATEEMSNLVNYIQPVKFESFETSKKRNKSFEMSSFVETKGLEQLTKSPVEFVEYNKMQLSRIYPKGTRVDSSNYMPQLFWNAGCQMVALNFQTVDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPSLACLRIAAYEEGGKFIGHRILPVQAIRPGYHYICLRNERNQPLMLPAVFVYIEVKDYVPDTYADVIEALSNPIRYVNLMEQRAKQLAALTLEDEEEVKKEADPGETSSEAPSETRTTPAENGVNHTATLAPKPPSQAPHSQPAPGSVKAPAKTEDLIQSVLTEVEAQTIEELKQQKSFVKLQKKHYKEMKDLVKRHHKKTTELIKEHTTKYNEIQNDYLRRRAALEKSAKKDSKKKSEPSSPDHGSSAIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKGEGSSSVLSESCHEDPSVPPNFTPPNPQALKW

SEQ ID NO: 20225 - protein, 447 aa, Maackia amurensis
SLVLLLLGVVVTTPVLANYKPPIYEPPPTEKPPTYEPPEIEKPPPVYQPPPVHYPPPHVKPPPEYEPPPEYQPPPEYQPPHEKPPPEYQPPHEKPPPEYQPPHEKPPPEYPPPHEKPPPEFPPPYEKPPPEYQPPYEKPPPLYPPPHEKPPIEYPPPHEKPPPVYQPPYEKPPIEYPPPHEKPPPVYQPPYEKPPPVYPPPHEKPPIEYPPPHEKLPPVYQPPYEKPPPTYPPPHEKPPIEYPPPHEKPPYEKPPPEYQPPYEKPPPLYPPPHEKPPIEYPPPHEKPPPVYQPPYEKPPIEYPPPHEKPPPVYQPPYEKPPPVYPPPHEKPPIEYPPPHEKLPPVYQPPYEKPPPTYPPPHEKPPIEYPPPHEKPPYEKPPPLYPPPYEKPPPLYPPPHHHKPPHHEKPPFYKPPVYEPPPLEKPPPVEKPPSYKPPPYRHYPPSKN

SEQ ID NO: 20226 - protein, 469 aa, Rattus norvegicus
MINGQMVKLKYCFTCKMFRPPRTSHCSVCDNCVERFDHHCPWVGNCVGRRNYRFFYAFILSLSFLTAFIFACVVTHLTLRPTVLELVICFFSIWSILGLSGFHTYLVASNLTTNEDIKGSWSSKRGGEASVNPYSHKSIITNCCAVLCGPLPPSPFTFKVEPERVWREEEEAGPRPAQATPNPAQGHTTPAKRPAQSKGAAESSIGLKAASSSACLSILGVMERASLIQKAKLAEQAERYEDMAAFMKSAVEKGEELSCEERNLLSVAYKNVVGGQRAAWRVLSSIEQKSNEEGSEEKGPEVKEYREKVETELRGVCDTVLGLLDSHLIKGAGEAESRVFYLKMKGDYYRYLAEVATGDDKKRIIDSARSAYQEAMDISKKEMPPTNPIRLGLALNFSVFHYEIANSPEEAISLAKTTFDEAMADLHTLSEDSYKDSTLIMQLLRDNLTLWTADNAGEEGGEAPEEPQS

SEQ ID NO: 20227 - protein, 527 aa, Rattus norvegicus
MTTPSEGRREPLGVTESLWPSEPITLGPETSARQLVLKKIQDLSISGHQDPFMVADLDVLASRHQTFLQALPRVWPFYAVKCNNRPSLLLVLAALGTGFDCASQGELEQVLGLGVAPSRIIFANPCKAVSHIQYAARCGVQLLTFDSEEELTKLARHHPGARLILRIQTLGGRSTFPLHTKFGARLLACGRLLQVARELGLAVVGASGPVSSWHWLAQVWKPVGGWVFLGVSPLTLTSVFTCVSSTPMATLSFHVGSDCHTPQSYRQAIADCHRVFEMGCKAGHQMSLLDLGGGFPGIEGSEAKFEEMARVVNAALAQYFPEGTGVEVIAEPGRFYAESVCTAAVNIIAKKASLEPGGHRKLAYYLNEGHYGAFRIFLRDPVPRIPIVVKELPSDPHLFPCTLYGPTCDAFDRLFSTEVQLPELDVGDWLVFPDMGAYRSTMSSTFNGFPITTVYDAMSPQLSSGTKGISSRQRREGRSVVSMAAEVRRDEVGKRELRGCQWALVHVSKKPCGDLETFLDPLYLLRV

SEQ ID NO: 20228 - protein, 117 aa, Rattus norvegicus
MKYRNRVRSRISNLKDPRNPGLRRNVLSGTISPELIAKMTAEEMASDELRELRNAMTQEAIREHQMAKTGGTTTDLLRCSKCKKKNCTYNQVQTRSADEPMTTFVLCNECGNRWKFC

SEQ ID NO: 20229 - protein, 271 aa, Rattus norvegicus
MTPVAGQQRSLSRLTIKGVSVNRMVLKTQQPAVSVTVTGMSSLILQIQLPWKQAIRCLYSIQKHFEPSTLCFTEALKTTPLLCRLIPNLGVLSHVPLWKVSDLAHIYAESGELGAHILLPWTSEYMKLSRTVLTQEPEIRLLQNHVISCHIDCGGICFQEEGMCYEEMLKEGYRCLLCKHSALDMTRYWRQLDNQVAPTPMPSEYRNVTVDILCNDCTGRSTVQFHILVMKCKLRDSYNTAQAGRPQSFRGSTVRSLSLAGEQLCDIDETL

SEQ ID NO: 20230 - protein, 627 aa, Rattus norvegicus
MALARDAKLESDIFQALQDVANRLRIHSIRATCASSSGHPTSCCSAAEIMAVLFFHTMRYKQADPEHPDNDRFVLSKGHAAPILYAVWVEVGRICESDLLNLRKIHCDLEGHPTPRLSFVDVATGSLGQGLGAACGMAYTGKYFDKASYRVFCLMGDGESSEGSVWEALAFASHYKLDNLLAIFDVNRLGQSGTAPLEHCTDIYETRCQAFGWNTYVVDGHDVEALCQAFWKAAQVKNKPTALIAKTFKGRGIPNVEDAENWHGKPMPKDRVDGIVKLIESQIQTNRNLTPKPPVEDSPRISISNTKMTSLPAYKLGDMIATREAYGVALAKLGHSNQRVIVLDGDTKNSTFSEVFKKEHPERFIECFIAEQNMVSVALGCATRGRTIAFVSTFAAFLTRAFDQIRMGAISQTNVNFVGSHCGVSIGEDGPSQMALEDLAMFRSIPNCTIFYPSDAVSTEHAIYLAANTKGMCFIRTTRPKLAVIYTSEENFVIGQAKVIRHSADDKVTVVGAGVTLHEALEAADELSQQGISIRVIDPFTIKPLDASTIIQSAKATGGQIITVEDHYREGGIGEAVCAAISREPDIVVHQLAVTEVPRSGKPSELLDMFGISARHIIAAVKDTVMK

SEQ ID NO: 20231 - protein, 617 aa, Rattus norvegicus
MEVVEAAAQLQTLKFGGSGPGSAASPPPEERPDAEQAEQAPPAGEQPPPAPSSDAGENPPPPSGPCATAPDAAEPLPELQDSDSSDSDSDSETDSDSSSSSSSSSSSSSSCGSLPPVLSDGEEDVQVEKENKNFPLKTKDELLLNELPSVEELTVTLPEDIALKPLGKVSSIIEQLGITYYGVYVLNITIGYCVKALGHRVFLLREERYAVAITGDLSLCFHLFKRSCFRDLVKAYQYSVIEVLRLDDDILVIIESMTNIPPVNEDTVIFKSDRQAAGKIFEIFGPVAHPFYVLRFNSSEHIESKGIKIKDTMYFAPSMKDFTQYIFTEKLKQDRGSDASWKNDQEPPPEALDFSDDEKEKEAKQRKKSQIQGRKKLKSELNESGEDFGEVHQNWNANSSSEHSKGYHNREFTRGFPRGRYSRGSHGRPPPQHELEMYNCLVYWKKGTNVCIVEQIDLVHVVKAFILLRIEEPKAFSNKRCDPKDNLAQIQRDRPVSRYSPLNCGKEMMAVSLVMCFVSDMFGTIRLNYGSCFSVFDEDNFNALNFDCIIIGIFVGNNTVQMKEEETEFRVAACSRNKVLRSVLQKSRTSSCKLKQVRTEASEGNCFSETGKKYGKQ

SEQ ID NO: 20232 - protein, 424 aa, Mus musculus
MGCGTSKVLPEPPKDVQLDLVKKVEPFSGTKNDVYKHFITEVDSVGPLKAGFPATSQYAPPCPGVPNTGHTAPPSEPPRRARVAKYRAKFDPRVTAKYDIKALIGRGSFSRVVRVEHRATRQPYAIKMIETKYREGREVCESELRVLRRVRHANIIQLVEVFETQERVYMVMELATGGELFDRIIAKGSFTERDATRVLQMVLDGVRYLHALGITHRDLKPENLLYYHPGTDSKIIITDFGLASARKKGDDCLMKTTCGTPEYIAPEVLVRKPYTNSVDMWALGVIAYILLSGTMPFEDDNRTRLYRQILRGKYSYLGEPWPSVSNLAKDFIDRLLTVDPGARMTALQALRHPWVVSMAASSSMKNLHRSISQNLLKRASSRCQSTKSSQSTRSSRSTRSNKSRRVRERELRELNLRYQQQYNG

SEQ ID NO: 20233 - protein, 645 aa, Homo sapiens
MERQSRVMSEKDEYQFQHQGAVELLVFNFLLILTILTIWLFKNHRFRFLHETGGAMVYGLIMGLILRYATAPTDIESGTVYDCVKLTFSPSTLLVNITDQVYEYKYKREISQHNINPHQGNAILEKMTFDPEIFFNVLLPPIIFHAGYSLKKRHFFQNLGSILTYAFLGTAISCIVIGLIMYGFVKAMIHAGQLKNGDFHFTDCLFFGSLMSATDPVTVLAIFHELHVDPDLYTLLFGESVLNDAVAIVLTYSISIYSPKENPNAFDAAAFFQSVGNFLGIFAGSFAMGSAYAIITALLTKFTKLCEFPMLETGLFFLLSWSAFLSAEAAGLTGIVAVLFCGVTQAHYTYNNLSSDSKIRTKQLFEFMNFLAENVIFCYMGLALFTFQNHIFNALFILGAFLAIFVARACNIYPLSFLLNLGRKQKIPWNFQHMMMFSGLRGAIAFALAIRNTESQPKQMMFTTTLLLVFFTVWVFGGGTTPMLTWLQIRVGVDLDENLKEDPSSQHQEANNLDKNMTKAESARLFRMWYSFDHKYLKPILTHSGPPLTTTLPEWCGPISRLLTSPQAYGEQLKEDDVECIVNQDELAINYQEQASSPCSPPARLGLDQKASPQTPGKENIYEGDLGLGGYELKLEQTLGQSQLN

SEQ ID NO: 20234 - protein, 926 aa, Homo sapiens
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGGMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 20235 - protein, 330 aa, Shigella flexneri
MSQNTLKVHDLNEDAEFDENGVEVFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRRLREILQTQGLNIEALFRK

SEQ ID NO: 20236 - protein, 805 aa, Arabidopsis thaliana
MASFFDLVYISWIGFLNKFLSFWVFWVCLVRYVAQGKGILQSHQLIDEFLKTVKVDGTLEDLNKSPFMKVLQEAIVLPPFVALAIRPRPGVREYVRVNVYELSVDHLTVSEYLRFKEELVNGHANGDYLLELDFEPFNATLPRPTRSSSIGNGVQFLNRHLSSIMFRNKESMEPLLEFLRTHKHDGRPMMLNDRIQNIPILQGALARAEEFLSKLPLATPYSEFEFELQGMGFERGWGDTAQKVSEMVHLLLDILQAPDPSVLETFLGRIPMVFNVVILSPHGYFGQANVLGLPDTGGQVVYILDQVRALENEMLLRIQKQGLEVIPKILIVTRLLPEAKGTTCNQRLERVSGTEHAHILRIPFRTEKGILRKWISRFDVWPYLETFAEDASNEISAELQGVPNLIIGNYSDGNLVASLLASKLGVIQCNIAHALEKTKYPESDIYWRNHEDKYHFSSQFTADLIAMNNADFIITSTYQEIAGSKNNVGQYESHTAFTMPGLYRVVHGIDVFDPKFNIVSPGADMTIYFPYSDKERRLTALHESIEELLFSAEQNDEHVGLLSDQSKPIIFSMARLDRVKNLTGLVECYAKNSKLRELANLVIVGGYIDENQSRDREEMAEIQKMHSLIEQYDLHGEFRWIAAQMNRARNGELYRYIADTKGVFVQPAFYEAFGLTVVESMTCALPTFATCHGGPAEIIENGVSGFHIDPYHPDQVAATLVSFFETCNTNPNHWVKISEGGLKRIYERYTWKKYSERLLTLAGVYAFWKHVSKLERRETRRYLEMFYSLKFRDLANSIPLATDEN

SEQ ID NO: 20237 - protein, 397 aa, Xenopus laevis
MSLRITRNMMANTENNVKTTLAGKRVVATKPGLRPRTALGDIGNKAELKVPAKKELKPAVKAVKKTKPIDKVLEPLKVSEENVCPKPTPVEPSSPSPMETSGCLPDELCQAFSDVLIQVKDVDADDDGNPMLCSEYVKDIYGYLRSLEDAQAVRPNYLHGREVTGNMRAILIDWLVQVQMKFRLLQETMFMTVGIIDRFLQEHPVPKNQLQLVGVTAMFLAAKYEEMYPPEIGDFTFVTDHTYTKAQIRDMEMKILRVLKFAIGRPLPLHFLRRASKIGEVTAEQHSLAKYLMELVMVDYDMVHYAPSQIAASASRLSLKILNAGDWTPTLHHYMAYSEEDLVPVMQHMAKNIIKVNKGLTKHLTVKNKYASSKQMKISMIPQLKSDVVVAMARPLV

SEQ ID NO: 20238 - protein, 166 aa, Xenopus laevis
MSDEGKLFIGGLNFETNEDCLEQAFTKYGRISEVVVVKDRETKRSRGFGFVTFENVDDAKDAMMAMNGKSVDGRQIRVDQAGKSSGERRGGYRGGSSGGRGFFRGGRGRGGGDRGYGSSRFDNRSGGYGGSSGSRDYYGSGRSQGSYGDRSGGSYRDSYDSYATHE

SEQ ID NO: 20239 - protein, 401 aa, Solanum tuberosum
MAFSAGKSYAFSTNFDPLQQNLWGSKPPISSLSIKDIDFKQCDKHNILSKKPLYISAVLSGFGHADESKEFKSRDPLVQCNAYEASQPQSIPIDIEFGQEAQAAATQKLKIGLYFATWWALNVVFNIYNKKVLNAFPFPWLTSTLSLAAGSLMMLVSWATKIAETPKTDFDFWKALFPVAVAHTIGHVAATVSMSKVAVSFTHIIKSGEPAFSVLVSRLLGETFPLPVYLSLLPIIGGCGLAAITELNFNLIGFMGAMISNLAFVFRNIFSKKGMKGKSVGGMNYYACLSMMSLLILIPFAIAVEGPQVWALGWQNAVSQIGPNFIWWVVAQSVFYHLYNQVSYMSLNEISPLTFSIGNTMKRISVIVSSIIIFQIPIQPINALGAAIAILGTFLYSQAKQ

SEQ ID NO: 20240 - protein, 113 aa, Arabidopsis lyrata subsp. petraea
STGKRSEREEDTDPQGSRGISDDEDGDNSRKKLRLSKDQSVILEETFKDHSTLNPKQKQALAKQLGLRARQVEVWFQNRRARTKLKQTEVDCEFLRRCCENLTEENRRLQKEV

SEQ ID NO: 20241 - protein, 526 aa, Coprinellus congregatus
MFKFAVLSQFVALALAAIGPQADLFIGNANVAPDGFQRSAALAGTDANSMVFPGPVIQAFKGETFNINVRNRLADPSMLRTTSIHWHGFFQAGSAWADGPVGVTQCPIAPNRDFLYTFATARQAGTFWYHSHHRSQYCDGLRGAMVVYDPEDPHRSLYDVDNEDTIITLADWYHPPGPVLETLNVATANSTLINGKGRYPTGPTTPLAVVGVTAGKRYRFRLVSISCSPFFTFSIDGHRMTIIEADGESTQPLVVDSIDIHAGQRYSFVLEANQPVANYWIRSNPNRGNRGFAGGLNTAILRYVGAPDADPVKPSDVDVPVPALPLVETNLHPLENPAAPGPPALGGEGVTAIELQIGLQGREWTVNGATFHEPNEPILLQTLNGKQMNELLPNQGSLFPIPRNSVIELTMPGGGAGSPHPMQLHGHMFSVIRSASNSTPNFVNPVRRDVVSLGSNTADRVTVRFVTDNAGPWIMHCHIDWHLVHGLSVVFVEDIEGISDSQRVAEDHPWRQLCPIYEQEKPDNEP

SEQ ID NO: 20242 - protein, 755 aa, Mus musculus
MASTRSIELEHFEERDKRPRPGSRRGAPSSSGGSSISGPKGNGLIPSPAHSAHCSFYRTRTLQALSSEKKAKKARFYRNGDRYFKGLVFAISNDRFRSFDALLIELTRSLSDNVNLPQGVRTIYTIDGSRKVTSLDELLEGESYVCASNEPFRKVDYTKNVNPNWSVNIKGGTTRTLAVASAKSEVKESKDFIKPKLVTVIRSGVKPRKAVRILLNKKTAHSFEQVLTDITEAIKLDSGVVKRLCTLDGKQVTCLQDFFGDDDVFIACGPEKYRYAQDDFVLDHSECRVLKSSYSRASAAKYSGSRSPGFSRRSKSPASVNGTPSSQLSTPKSTKSSSSSPTSPGSFRGLKISAQGRSSSNVNGGPELDRCLSPEGVNGNRCSESFPLLEKYRIGKVIGDGNFAVVKECVDRYTGKEFALKIIDKAKCCGKEHLIENEVSILRRVKHPNIIMLVEEMETATDLFLVMELVKGGDLFDAITSSTKYTERDGSAMVYNLANALRYLHSLSIVHRDIKPENLLVCEYPDGTKSLKLGDFGLATVVEGPLYTVCGTPTYVAPEIIAETGYGLKVDVWAAGVITYILLCGFPPFRSENNLQEDLFDQILAGKLEFPAPYWDNITDSAKELISQMLQVNVEARCTAGEILSHPWVSDDASQENNMQAEVTGKLKQHFNNALPKQNSTTTGVSVIMNTALDKEGQIFCSKLCQDSSRPSREQTSPVPPSAQEAPPPLESPRPPGPPATSGCDLAGTWRRHRD

SEQ ID NO: 20243 - protein, 191 aa, Mus musculus
MEEKVESTTTPHGPCVVSVQETEKWMEEATRMANEALENIEVPVGCLMVYNNEVVGKGTNEVNQTKNATRHAEMVAIDQVLDWCHQHGQSPSTVFEHTVLYVTVEPCIMCAAALRLMKIPLVVYGCQNERFGGCGSVLNIASADLPNTGRPFQCIPGYRAEEAVELLKTFYKQENPNAPKSKVRKKDCQKS

SEQ ID NO: 20244 - protein, 188 aa, Arabidopsis thaliana
NSFDEGNKKAWVDKRTGGLCLCTSAKGLSITGIDDRRYWSHIPSDDSRFASVAYVQQIWWFQVDGEIDFPFPAGTYSVYFRLQLGKPGKRFGWKVVDTEQVHGWNIKPVRFQLSTEDGQHSSSQCMLTEAGNWSHYHAGDFVVGKSKSSSTKIKFSMTQIDCTHTKGGLCVDSVVVYPSSCKDRLMQI

SEQ ID NO: 20245 - protein, 435 aa, Arabidopsis thaliana
VVIKFRDEKDSKEFCDSFEECKKDDAVKQGSALPNGTVVSANKSKFDDKIEAASAKMYFHYYGQLLHQQNMLQDYVRTGTYHAAVMENRSDFSGRVVVDVGAGSGILSMFAALAGAKHVYAVEASEMAEYARKLIAGNPLLAERITVIKGKIEDIELPEKADVLISEPMGTLLVNERMLETYVIARDRFLSPNGKMFPTVGRIHMAPFADEFLFVEMANKALFWQQQNYYGVDLTPLYVSAHQGYFSQPVVDAFDPRLLVAPSMFHVIDFTMMTEEQFYEIDIPLKFTASVCTRIHGLACWFDVLFDGSTVQRWFTTAPGAPTTHWYQIRCVLSQPIHVMAGQEITGRLHLIAHSAQSYTINLTLSAKMWGPGANQGGILQTSSCKLDLKEPYYRMSQPQVYPTQEPPAQSQDIHIHSDDLEELELLQQNANAQL

SEQ ID NO: 20246 - protein, 717 aa, Burkholderia cepacia
MEARFSAHRPVWRMLRHVLATMLLTGSVGTGAATACWKPIFTDEERRWIGDHPVVHIAVEANWHPIEYMRNGRHAGLVAGYLSAISRMTGLSFQTVPGTERGHAYDALAAGKVDLLPGVWRELVPDRIGAGALVSAPYLVGRLTVVTRNNSAMIFGLQRLKGRRIAIKGRGAVEYFVRHSGVPLHVLTFDSEELALAAVANGEADAALGVDVTILPIMRRQFTGQLYMSGMLADRPVSLAMLTRADLPILASIIDKSLAAIPVSETAEITRDSIELGDYGKPTIRSIVHYRAPVVLGVALALLTFAALAYLMWKSRAAAIRSKRDKAMFLAFVSHEIRTPMQTVLSSLEFLQRSRLSVQQGGRVDAAASAAETLLTLLDDILDYSRLESRKVTLSPQTVELDVWARQTVDLVRWRADRKTLALTLDVAGPPSVHVSIDPVRVRQIVLNLLVNAINFTAAGAVTLRVRYVAARHGRNGTLCLEVRDTGIGIAPDRLGHVFETYWQADRAPQPGSGGSGLGLAICRELVELMHGSITVDSTPYVETVFTVQLPVPAADGAPLAKSAAAAQALADATAAPVYRGAPRVLIVDDHETVRAALQDQCDALGCVGIVAGSGEDALRHLAQGRIDMVLLDCNLPDIDGYALARMIRQEEAARKARRVSIIAISAESGDMHRMLCLESGMDGVLGKPLRLDTLRQAIARWYPTDADNTLEVSTVP

SEQ ID NO: 20247 - protein, 227 aa, Momordica charantia
MGRGKIEIKRIENTTNRQVTFCKRRNGLLKKAYELSVLCDAEVALIVFSSRGRLYEYSNNSIKTTIGRYKKACSDSSATSSVTELNTQYYQQESAKLRQQIQMLQNSNSNLVRHLMGDSLSALTVKELKQLENRLERGITRIRSKKHEMLLAEIEYLQKREIELENENVCIRTKIAEVERLQQANMVSGQELNAIQALASRNFFTPNMMEGGAVTFSHQDKKMLHLG

SEQ ID NO: 20248 - protein, 399 aa, Chlamydomonas reinhardtii
MSSLLKTRVVPSLAARDVAFCHPLVFTTSSQRVARASGQSSAFPLRSAVSGVSSRRPFTCLAVAASAGDVSDGSSHTEMMQTLVLGSMFAGWYAANIAFNIYNKQLLKAFAFPLTITEAQFLVGSCVTLVAWGSGLQRAPKITWSTIKNVLPLAVVHTLGNLLTNMSLGAVAVSFTHTIKAMEPIFSVALSALFLGDQPSPLVLATLLPIIGGVAMASMTEATFNWFGFLSAMGSNLTFQSRNVLSKKLMLKKKDKDGNAEAPLDNMALFSVITLLSAALLLPATLLFEGWKLSPVGLAEMGVRSPNGVLAHAAMAGLCFHLYQQVSYMILSRVSPVTHSIGNCVKRVVVIAASVLFFRNPVSLQNALGTALALAGVFLYGTVKRQQAIAAGKKIAASE

SEQ ID NO: 20249 - protein, 372 aa, Marthasterias glacialis
MAAFGSSASDKQPAVSASDNMPEVVRGQIFDVGPRYTGLAYIGEGAYGMVCSATDTKNLSKVAIKKISPFEHQTYCQRTLREIKILTRFRHENIINIQDIIHANSIDEMKDVYIVQSLMETDLYKLLKTQKLSNDHICYFLYQILRGLKYIHSANVLHRDLKPSNLLLNTTCDLKICDFGLARIADPVHDHTGFLTEYVATRWYRAPEIMLNSKGYNKSIDIWSVGCILSEMLNGKPIFPGKHYLDQLNHILNVLGSPSSEDLGCIHNDKARGYMQSLPFKPRVPWSRLYPVGDAKSLQLLDRMLTFNPDKRITVEDALKHDYLDQYHDPTDEPVAEEPFKFETELDDLPKEELKELIFEEAKKFALGGEMS

SEQ ID NO: 20250 - protein, 628 aa, Chlamydomonas reinhardtii
MDVFQYTTLDKGAGSALFRAPRLTYIGAADVQTRRARMSTGVDYLGHGAVKATEGPPVNPSGRKYPYELDSEGKAKSIPVWRFTNPHMGAFHLSWFAFFISFLATFAPASLLPIIRDDLFLTKAQLGNAGVAAVCGAIAARVLMGVFVDIVGPRYGTAATMLMTAPAVFCMALVTDFATFAAVRFFIGLSLCMFVCCQFWCGTMFNVQIVGTANAIAGGWGNMGGGACHFIMPLIYQGIKDGGVPGYQAWRWAFFVPAVFYIATALATLALGIDHPSGKDYRDLKKEGALKSKGAMWPVIKCGLGNYRSWILALTYGYSFGVELTVDNIIVEYMFDQFGLSLTVAGALGGMFGMMNLFSRASGGMISDLIAKPFGMRGRICALWIIQTLGGIFCVILGRVHNSLTSTIVIMIIFSIFCQQACGLHFGITPFVSRRAYGVVSGLVGAGGNTGAAITQAIWFAGTAPWQLTLTKYQGLEYMGYQTIGLTLALFFIWFPMWGSMLTGPREGATEEDYYIKEWSAEEVADGLHHTSLRFAMESRSQRGTRTSTQTKVMSVGDGAGSNKAEVVVVAAAQQGAVPMASVEEGSSGRSSSSGGHQQQDAHILHCIRTVVQKAPRVGERESERERD

SEQ ID NO: 20251 - protein, 632 aa, Podospora anserina
MNQQQQYQQPSRRTDAYSSQHDELHLPSSSSMAHQGQHPLQQQQQQLPTRQYSSGPGVPPHIKLEQSPNPQQHHHQSAGVVPNVLQPGGLQTRPPVISSNTAPVLPTMQQQQPPDYQPHQTPTKSNSMNLSHNYPRSSPAAPYEGGSGYSAYAPNTPGGAGSSSQYMSPTDSKYSQSSGSQRIPSNAPLGLADIRPRADSSLSDGIPGTTSYEHANTQSRTSNYMAPWALYAFDWCKWAPQGNSAGKVAIGSYLEDGHNYIQILDAQVSPTPSDVYSPAGSRYTMDFTRIAEATHSYPVTRLLWEPPSSQKQSTDLLATSGDHLRLWSLPSDPQVQTPGSSITSRNGRDMPITKLTPLALLSNSKTPDHTAPLTSLDWNTVTPSLIITSSIDTTCTIWDIPSLTAKTQLIAHDKEVYDVRFCANSVDVFVSCGQDGSVRMFDLRSLEHSTIIYEPTGKEERDANGGRISPTLAQQTMSHPPPLLRLATSPHDQHLLATFAQDSNVIRILDVRQPGQALLELRGHGGALNCVEWSPLRRGTLASGGDDCQVLIWDLLNNNNTSNAATISTNGAAPPTGAQAAASTDNVRSPVAAWQCEYEVGNLGWVPHLAGGEYGDWLGVSAGRGVWGVKLG

SEQ ID NO: 20252 - protein, 543 aa, Podospora anserina
MTLLSLKEDRPTPKAVYNWRVYTCAAVASFAACTIGYDSAFIGGTLALPSFEEEFDFASYSESGRALLKANIVSVYQAGAFFGSLFAYVTSHFGGRRISLFIFSVVFCIGAGIMLAANGDRGMAPIIAGRVLAGIGVGGCSNMVPIYISELSPPAVRGRLVGIYELGWQMGGLVGFWINYGVNTTLAPSHKQWIIPFAVQLIPAGLLLIGAFWLRESPRWLFANGKKEEGLKVLCWMRNLEPTDTYILEEVSYIEADLERFEREVGKGFWKPFLSLKQRKVQWRFFIGGILFLFQNGSGINAINYYSPTVFRSIGIDGVNTGLLTTGIFGVVKTVLTIIWLLWLVDLAGRRRMLFIGATGGSLCMWYIGAYIKLAKPEQSASGELTSAGISAVFFFYLWTAFYTPSWNGTPWVINSEMFDQNTRSLGQASAAANNWFWNFLISRFTPQMFLKMEYGVYFFFASLMILSIIFIFFFVPETKSIPLEAMDRLFEIKPVHRANKLLMAELQQTSDMGHGAEESVGKDSSSTDEKMRQAGFVQAENV

SEQ ID NO: 20253 - protein, 94 aa, Podospora anserina
MKVKIKRWNAVATWRWDLPEDDLCGICQNPFDNTCPACKYPGDDCILCEFHTACGYQRNGHCILEWMKQDSAKGQCPMCRQSKLVGCPFLQQFV

SEQ ID NO: 20254 - protein, 488 aa, Pisum sativum
MILEMGSMWVVLMAIGGALLVLRSILKNVNWWLYESKLGVKQYSLPPGDMGWPFIGNMWSFLRAFKSKDPDSFISSIVSRYGSSGIYKALMFGNPSVIVTTPEGCKRVLTDDEKFTTGWPQSTIELIGKNSFIAMTYEEHKRLRRLTSSSINGMEALSLYLKYIEENVIISLEKWSNMGQIEFLTEIRKLTFKIIMHIFLSSESEPVMEALEKEYTILNHGVRAMQINVPGFAYYKALKARKNLVGIFQSIVDDRRNIRKVYSQKKAKDMMDSLIDVEDDNGRKLNDEDIIDIMLMYLNAGHESSGHITMWATYFLQKHPEYLKKAKEEQEEIIKRRPSTQKGLTLKEIRGMDFLYKVIDETMRVITFSLVVFREAKSDVTINGYTIPKGWKVLTWFRSVHLDPEIYPNPKEFNPNRWNKEHKAGEFLPFGAGTRLCPGNDLAKMEIAVFLHHFTLNYRLEQLNPKCPIRYLPHTRPMDNCLGRVKKC

SEQ ID NO: 20255 - protein, 490 aa, Pisum sativum
MASLWFIFGAIAGALLVLRSLLKNVNWFLYEAKLGDKQYSLPPGDMGWPIIGNMWSFLRAFKSSKPDSFMDSIVKRFGNTGIYKVFMFGFPSVIVTSPEACKKVLTDDENFEPGWPQSTVELIGEKSFIKMPFEEHRRLRRLTSASINGYEALSVYLKYIEEIVISSLEKWTQMGEIEFLTQMRKLTFKIIIHIFLGSESEPVMEALEREYTVLNLGVRAMRINIPGFAFHKSLKARKNLVAIFQSIVDKRRNERRGKEPAPGKKAKDMMDSLIDAVDENGRKLGDDEIIDIMLMYLNAGHESSGHITMWATYFLQRHPEFFRKAKEEQVEMLKRRPPSQKGLKLEDVRKMEYLSKVIDETMRVVTFSLMVFRQARNDVKVNGYLIPKGWRVLTWFRSVHFDSELYPDPREFNPENFSVVRKAGEFLPFGAGTRLCPGNDLAKLEISVFLHHFLLKYELEQLNPKSPIRFLPHTRPLDNCLARIKKQEAA

SEQ ID NO: 20256 - protein, 298 aa, Homo sapiens
MTEQAISFAKDFLAGGIAAAISKTAVAPIERVKLLLQVQHASKQIAADKQYKGIVDCIVRIPKEQGVLSFWRGNLANVIRYFPTQALNFAFKDKYKQIFLGGVDKHTQFWRYFAGNLASGGAAGATSLCFVYPLDFARTRLAADVGKSGTEREFRGLGDCLVKITKSDGIRGLYQGFSVSVQGIIIYRAAYFGVYDTAKGMLPDPKNTHIVVSWMIAQTVTAVAGVVSYPFDTVRRRMMMQFGRKGADIMYTGTVDCWRKIFRDEGGKAFFKGAWSNVLRGMGGAFVLVLYDELKKVI

SEQ ID NO: 20257 - protein, 514 aa, Xenopus laevis
MADYLISGGTCYIPDDGLTAQQLFGAGDGLTYNDFLILPGYIDFTADQVDLTSALTKKITLKTPMVSSPMDTVTEANMAIAMALTGGIGVIHHNCTPEFQANEVRKVKKYEQGFITDPVVLSPKHCVRHVFEAKARHGFCGIPITENGKMGSKLAGIISSRDIDFLKAEDHDLALSEIMTRREDLVVAPAGVTLKEANEILQRSKKGKLPIVNGDDELVAIIARTDLKKNRDYPLASKDAKKQLLCGAATGTHEDDKYRLDLLVQAGVDAVVLDSSQGNSIFQINMIKYIKEKYPDLQVIAGNVVTAAQAKNLIDAGADALRVGMGSGSICITQEVLACGRPQATAVYKVSEYARRFGVPVIADGGIQTVGHIAKALALGASTVMMGSLLAATTEAPGEYFFSDGIRLKKYRGMGSLDAMDKNVSSQKRYFSEADKIKVAQGVSGAVQDKGSIHKFIPYLIAGIQHSCQDIGAKSLTQVRAMMYSGELKFEKRTMSAQVEGGVHGLHSYEKRLF

SEQ ID NO: 20258 - protein, 594 aa, Streptomyces viridifaciens
MSTSSASSGPDLPFGPEDTPWQKAFSRLRAVDGVPRVTAPSSDPREVYMDIPEIPFSKVQIPPDGMDEQQYAEAESLFRRYVDAQTRNFAGYQVTSDLDYQHLSHYLNRHLNNVGDPYESSSYTLNSKVLERAVLDYFASLWNAKWPHDASDPETYWGYVLTMGSSEGNLYGLWNARDYLSGKLLRRQHREAGGDKASVVYTQALRHEGQSPHAYEPVAFFSQDTHYSLTKAVRVLGIDTFHSIGSSRYPDENPLGPGTPWPTEVPSVDGAIDVDKLASLVRFFASKGYPILVSLNYGSTFKGAYDDVPAVAQAVRDICTEYGLDRRRVYHDRSKDSDFDERSGFWIHIDAALGAGYAPYLQMARDAGMVEEAPPVFDFRLPEVHSLTMSGHKWMGTPWACGVYMTRTGLQMTPPKSSEYIGAADTTFAGSRNGFSSLLLWDYLSRHSYDDLVRLAADCDRLAGYAHDRLLTLQDKLGMDLWVARSPQSLTVRFRQPCADIVRKYSLSCETVYEDNEQRTYVHLYAVPHLTRELVDELVRDLRQPGAFTNAGALEGEAWAGVIDALGRPDPDGTYAGALSAPASGPRSEDGGGS

SEQ ID NO: 20259 - protein, 815 aa, Homo sapiens
MVLRSGICGLSPHRIFPSLLVVVALVGLLPVLRSHGLQLSPTASTIRSSEPPRERSIGDVTTAPPEVTPESRPVNHSVTDHGMKPRKAFPVLGIDYTHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLMYAVCLVGGEQINNIGLLDNLLFGSIISAVDPVAVLAVFEEIHINELLHILVFGESLLNDAVTVVLYHLFEEFANYEHVGIVDIFLGFLSFFVVALGGVLVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSLPSERILPALSKDKEEEIRKILRNNLQKTRQRLRSYNRHTLVADPYEEAWNQMLLRRQKARQLEQKINNYLTVPAHKLDSPTMSRARIGSDPLAYEPKEDLPVITIDPASPQSPESVDLVNEELKGKVLGLSRDPAKVAEEDEDDDGGIMMRSKETSSPGTDDVFTPAPSDSPSSQRIQRCLSDPGPHPEPGEGEPFFPKGQ

SEQ ID NO: 20260 - protein, 299 aa, Mus musculus
MDLVLSAADYYFFTPYVYPATWPEDNIIRQTISLLIVTNLGAYILYFFCATLSYYFVYDHSLMKHPQFLKNQVSREIVFTVKSLPWISIPTVSLFLLELRGYSKLYDDIGDFPNGWIHLMVSVVSFLFFTDMLIYWIHRGLHHRLVYKRIHKPHHIWKIPTPFASHAFHPVDGFLQSLPYHIYPFVFPLHKVVYLGLYVLVNVWTISIHDGDFRVPQILRPFINGSAHHTDHHMFFDYNYGQYFTLWDRIGGSFKHPSSFEGKGPHSYVKNMTEKESNSFAENGCKGKKVGNGEFTKNK

SEQ ID NO: 20261 - protein, 388 aa, Lupinus albus
MVDQVQRPTIMEKVSSQLHLRSGVSSDIQSYDAAFRRPAVYQRRSFGNYSNAALQYPVMPSCRATTDLSSVATASPVFAAAPAEKGHFLIDFLMGGVSAAVSKTAAAPIERVKLLIQNQDEMIKSGRLSEPYKGIGDCFKRTMADEGVVALWRGNTANVIRYFPTQALNFAFKDYFKRLFNFKKDRDGYWKWFAGNLASGGAAGASSLFFVYSLDYARTRLANDSKAAKKGGERQFNGLVDVYKKTLASDGVAGLYRGFNISCVGIIVYRGLYFGMYDSLKPVLLTGSLQDSFFASFGLGWLITNGAGLASYPIDTVRRRMMMTSGEAVKYKSSLDAFSQILKNEGAKSLFKGAGANILRAVAGAGVLAGYDKLQVIVFGKKYGSGGA

SEQ ID NO: 20262 - protein, 110 aa, Lolium perenne
MGRSPCCEKMGLKRGPWTAEEDKILVAHITSFGHGNWRALPKQAGLLRCGKSCRLRWINYLRPDIKRGNFSDEEEQSIIQLHQLLGNRWSAIAARLPGRTDNEIKNYWNT

SEQ ID NO: 20263 - protein, 408 aa, Magnaporthe grisea
MAAALAHSSGMIPSMVGVPPSTSYENGSGGNSSTTAGHGSVNDGSRTSRNALQGDLKSDAASAQSQNRKLQLSDFKKVRTLGTGTFARVCLVRPSNPQNETERNKVFALKILRKSEVVKLKQIDHVRHERAILADVSGFPFITNMLASFSDHDFLYIVLDYVPGGELFSYLRKYRRFDEDMARFYAAEIVLVLEYLHEAQDGVAYRDLKPENLLLDGQGHIKLVDFGFAKRLGGRRDGDNSGTQETYTLCGTPEYLAPEVIHNKGHTTAVDWWALGILIYEFLTGYPPFWHQNPIEIYKQIVEKPVVFPQDPPISPNAQDIIRQFCTVDRSRRLGNISGGAARVKEHPFFEGVDWEAIYSRKFPGPILPPIRYPGDAQCFDIYPEEDVGKDPYTDEMAQKYDHYFQDF

SEQ ID NO: 20264 - protein, 631 aa, Danio rerio
MAGAKPGVHALQLKPVSVNEVLKRGSKFIKWDEEAEILDMSHIRDTRTGKFAKTPKDQRIREMLFSGKADGNSDSRLLTVVYGNDLVNISFLNFQAVQDGYCKLWTDELFKLATNMLSQNASRNTFLLKAYTKLKLQVTQDGKIPVKNILKMFSDKKRVEMALEHCGLIFNRVDGIKPDDFTWEMFQNFLNKLSPRPEVERIFVDLGSKGKPFLSLDQLMDFINRKQRDSRLNEVLYPPLKRDQVRQLMEKYETNTSQLERDQISLMSFTKYLGGEENTVVPPERLDIIDDMNQPLSHYFINSSHNTYLTVGQLTGLSSVEMYRQVLLTGCRCIELDCWKGRPPEEEPIITHGFTMTTEIPFKDVIEAIAESAFKTSPYPLILSFENHVDSAKQQAKMAEYCRSMFGDALLIDPLDKYPLVPGQQLPSPQELLGKILIKNKKKHHHRASNGGSIRRKDGTDEQSSPLNDCPLSDGDVGQLMSNGGEKLAERMAKDHDNSKSIDRGDGESDEEEEEEPIPDPKKHNNTDEGTAYSEVNATEEMSTLVNYIEPVKFKSFEVAAKRKKFFEMSSFVETKGMDTLKNSPTEFVEYNKKQMSRIYPKGTRVDSSNYMPQLFWNVGCQMVALNFQTL

SEQ ID NO: 20265 - protein, 135 aa, Podospora anserina
MTGGGKSGGKASSGKNAQSRSSKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQNLLPKKTGTKPGKNASQEL

SEQ ID NO: 20266 - protein, 353 aa, Podospora anserina
MSNAQARGGARKISFNVSEQYDIQDVVGEGAYGVVCSAIHKPSGQKVAIKKITPFDHSMFCLRTLREMKLLRYFNHENIISILDIQKPRSYESFNEVYLIQELMETDMHRVIRTQELSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPNTSDMALDLLEKLLAFNPVKRITVEEALKHPYLEPYHDPEDEPTAPPIPEEFFDFDKHKDNLSKEQLKQLIYQEIMR

SEQ ID NO: 20267 - protein, 636 aa, Podospora anserina
MLEDPSYNSVVRWSPEGDSFVVLEKFTKTILPKHFKHSNFASFVRQLNKYDFHKVRHNEESGEAPYGRDAWEFKHPEFRADRKDQLDNIRRKAPAPRKPPPTEDAFPASQQIVVLSESLNATNVQIQTLQEQYLELDRTNRLLVAEVLSLQKMLRAQSQASNELISHLNNMEDRRRNSRHSAQSSHSSHSGTNYHQGTLGLLPDGTDEPAPELRRAREILNGVSPDSQADRELERLSMAYHQNGSPAESAGSSVMFTHAGPQTSMNVVHDPFSDPRHLVYPVGQTQGIDPFHADHIHNIPYSRPLSNPNVMTEAPSQISPPPGKEQNGSLWRGKKPQILLVEDDKTCARIGSKFLTNMDCSVETARDGLEAVEKINTDADRFDLVFMDIIMPNLDGVSATAMIRMVTPQIPIIAMTSNIRQEDIQTYFQFAKPFTRDGMVRILKKHLTRMLKDPQSAGVLNDPNDPTSAGNGGGGQQTAGGPGPPTGGYANANMAASMQAAINQAAQVQVKYEQTPIPSPSTTASWHSPGTTMQQVQHQQVQQQQQHASPRLDQGGYMNAVGSGQGVGGMVLTPGGSQRGPGPGQQQQQQYAGYMQAGPGPVTRLPEMGGMGGGAGDDRPEKRQRLYGPGQGGYVG

SEQ ID NO: 20268 - protein, 347 aa, Podospora anserina
MPTVNSNSYVHGNHGAPPPPPQAPQHFGYGAPQGYAFQYSQCTGKRKALLIGINYFSQRGQLRGCINDVRNMSSYLVERFGYKREDMVILTDDQQNPMSQPTKQNILRAMHWLVKDARPNDSLFFHYSGHGGQTKDLDGDEEDGYDEVIYPVDFRQVGHITDDEMHRIMVRPLQAGVRLTAIFDSCHSGTALDLPYIYSTQGILKEPNLAKEAGQGLLGVISAYSQGDLSGVASNIMGFFKKASNGEDAHARTLATKTSRADVVMLSGSKDDQTSADATIASQATGAMSWAFINSLKKNPQQSYVQLLNSIRDELQTRYTQKPQLSCSHPLGEIAPYLVTTFKARPD

SEQ ID NO: 20269 - protein, 1042 aa, Podospora anserina
MNNNNFYTTQLAQEEAQRRGQQQNAGRNLGMISTTGLSGVSDSLDEIVRQNNNELQRRRRSIPQSFQGGAMLTTDTDRRLSMMDFGSPDHYQDFQFGNMNSPQMAGFGAMPTSMPGSSGPYSQPGLMAMSDQNDFASLSPDIMGNMMAFSSLNMEAMGTDPASLNLFNSPGLGHQYPPTTMDSVTPDFSMDMGMGTTPLTLTSDDMSGVEDAFGNRPQQRPHNLTLESQMNQFQPSMPPPLTREISGTTAYRSPASGTSHTLSGMGAAQPSAVATVSTPQTPATTVGPALPDSLHASKEKSIYSKSGFDMLRALWYVATRKNAQLQIGAVDMSCAFVVCDVELQDCPIIYVSDNFQNLTGYVRHEIVGQNCRFLQSPTGKVEAGTKREFVENHAVFKLKNAIAEGREIQQSLINYRKGGKPFLNLLTMIPIPWDDPNTIRYFIGFQIDLVECPDAISGQESGGAMHVNYVHSDIGQYIWTPPSSTQWEPENGQTLAIDDVSSLLQQFNPKGAVSDWHRQSWDKMLLENADDVVHVLSLKGLFLYLSPSCKKILEYDTNDLMGNSLASICHPSDIVPVTRELKEAQANVPVNIVFRIRRKNSGYTWFESHGTLFSEQGKGRKCIILVGRKRPIFALSKRNLDQHGGIGDSEIWSKVSTSGMFLYVASNVRSLLDLERKDLEGTSMQDLMRKESRVEFGRTIEKSRRGKIASCKHEIQNKRGQVLQAHTTFYPGDAEEGQKPTFLLAQTKLLKASSRAIAPAGKTGASVASVSDDGQQMTGIVMGHTKTISTEGALISQPAGQLIGGTQDIALASDDNIFDELKTTRCTSWQYELRQMEKVNRLLAEELAQLLSNRKKRKRRKGGGNMVRDCANCHTRNTPEWRRGPSGQRDLCNSCGLRWAKQRDAQTGRVSPRNSNRGGDAQSKKSNSPSHASPLQREVNSNSTKPATTDTPPTEPGSKSTTATPTNVLTPSDNGSSGFPTPTAGGNGSSKTGATSSASPDIKSENGGGGPPQSQPMLEGGSGLGGSGMEMTSIREEREMSA

SEQ ID NO: 20270 - protein, 273 aa, Podospora anserina
MADRQLTTLLTQLRTPSLPFPQSTTLLSKAKLLLLQLSALTPSPTILPANLTLAREVYELGALHSLRAKNPDSFTRYVSQLQPFYELPPSAFSSPSQNQNKVTALWLLFLLTQGRYTEFHSDLEGLSTRGSVAEVENDKFLGYPIKLERWLMEGAYDRVWKAMKKGEVPSENANINKKVLTPQIRREIASSSERAYPSLPFLSAQSLLFLDSEGAVVDFAHSRGWVIKDRTIYFPTAAELNADEEGEQEQEKEVGQMVIENTLGYARQLETIV

SEQ ID NO: 20271 - protein, 551 aa, Acremonium sp. HI-25
MLLGTLFTLLAQCLLIEATSCLVKHDGGFVPDHVLRVSSRNISIACTSRQSAVVNGTSPGPELRVPAGQRTWIRVYNDLEQENLTMHWHGLAQRMAIFADGSPQGSQWPIPPGHFFDYELQTTVEDAGTYFYHSHVGMQALTASGALIVEGCERPPYQYDDERTLHWSDFFPQTDHEIEVGLQSVPLVWPGEVRAVLLNGKGIGIGHEADVSPSGDCSLPVIDVDPGKTYRFRFIGATGLSLVSMGFEGHQNLTIIQVDGGEWTKPASVDRIQLASGQRFDALFKAKTEEELASEGRQTYFIQFETRDRPEVYRGYAVIRYSKASTTPHVPTIPPLTLPNNTYDWLEYELRPLIETVTQPTLGEVTRRVIINASQLTDPQNQHVVWRLANLSWTEAVRQTPLLVDIYKFGDLAIPNYDAALANYGWDPETRAFPAKVGEVLEIVFQNTGSLVGSDGAVDIHPFHAHGEHFYDIGSGDGVYDAEANEAKLVAMNYTAVKRDTTMLYHYAATTTPGAPAGWRAWRLRVTQPGVWMIHCHILQHMVMGKSADAV

SEQ ID NO: 20272 - protein, 246 aa, Chrysanthemum x morifolium
MGRGKVQLRRIENKINRQVTFSKRRGGLLKKAHEISVLCDAEVALIVFSNKGKLFEFSTDSCMESILERYERYSYTERQLVATDATPRSWTLEYNKLKSRADLLQRNHRHYMGEDIESLSLKEIQNLEQQLDTGLKNIRTRKNQLLHESISELQKKGKAIQEQNTTLTKKIKEKEKDKTITENVQWEQHNYVDHDTSFLMPQPPPGLNMGGNYNQSGGGAGERADGMTNELDLSLQYSCHMRCFPS

SEQ ID NO: 20273 - protein, 243 aa, Chrysanthemum x morifolium
MGRGRVQMKRIENKISRQVTFSKRRTGLLKKAHEISVLCDADVALIVFSTKGKLFEYSTHSSMESILERYERYSYAEKLLTAPENETQASWTLESSRLKAKIEVLERNIRHYGGEDLEPLSLRDLQSVEQQLDTALKRIRTKKNQLMHESISELHKKEKTLQERNNSLSKKLKENEKNSEQQNERVELPQPPPPPPQPQPYSVPSFATSRPFIGAAMREEELARAHHVSTTMMPLWMIRHLNQ

SEQ ID NO: 20274 - protein, 237 aa, Chrysanthemum x morifolium
MGRGRVTLKRIENKINRQVTFSKRRSGLLKKAHEISVLCDADVALIVFSTKGKLCEYSTDSSMDRILERYERYSYAEMQLTSTHNESQGSWTLEHAKLKARIELLQKSKRHLMGEELDSLTLKELQGLEQQLDTALKHVRLRKNQLMFESISALQKKDKDMQERNNILSKQIKEKEKDAAHHDKEPQIHAAVPSLHLGILNNCDAHQAGSDWEVEDIPRPAQPLTFMPPWMVQHMSK

SEQ ID NO: 20275 - protein, 249 aa, Chrysanthemum x morifolium
MGRGRVELKRIENKINRQVTFAKRRNGLLKKAYELSVLCDAEVALIIFSNRGKLYEFCSSSSMLKTLERYQKCNYGAPETNVSAREALELSSQQEYLKLKARYEALQRSQRNLLGEDLGPLNCKELESLERQLDTSLKQIRSARTQFMLDTLTDLQKKEHALNDANRTLKQRLMEGHQVTSLHWNPHVQQEMGYDQQHEPQHQNGEAFFHPLDCGPTLQMGYPSDSLTAEAAASVAGPSCSNYMPGWYQ

SEQ ID NO: 20276 - protein, 246 aa, Chrysanthemum x morifolium
MGKGRLELKRIENKINRQVTFAKRRNGLLKKAYELSVLCDAEVALIIFSTRGKLYEFSSTSSMLKTLERYEKSSFGPPEQRRPAKEDLQEQSSYQEYMRLKERYDALKQLERNYYGEEIDNLSTNELESLERQLHCSLKQIRTIRTQSLVDRLYEQQKMEHHLYESNKTLRLKFEEESQAEALQWEAHARANGMVYGHPQHQLSQTTHDAFYHPTGCETTLQIGYQTDMSAVTSTSMNHQMQGWPA

SEQ ID NO: 20277 - protein, 229 aa, Chrysanthemum x morifolium
MARGKIQIKKIENSTNRQVTYSKRRNGLFKKASELTVLCDAKVSIIMVSCTDKLHEYISPSITTKQFFDQYQKASGIDLWNSHYEKMQEVLRQLKDVNKKLRTHIRQRLGDCLDHLGFEELLDLEKESQEAVYVIRERKLKVIGNKLETSKKKVRSAQDVYKKLMHEFDIRGEDPQFGMIEDAGEYETIYGYPPHIATQRILTLRLQPNHPDNLHAATASDLTTYSLLG

SEQ ID NO: 20278 - protein, 196 aa, Chrysanthemum x morifolium
MGTGKIEIKRIENTSNRQVTYSKRKNGIIKKAKEITVLCDANVSLVIYGSSGKMYEYCSPKTNLIDMLDRYQRLSGNKLWDAKHENLQNEIDRIKKENESMQIELRHLKGEDITSLNYEELIAYEDALENGLTNIREKKDDIPKIMRKHEQVLEEENKHLMYLVQQSEMAAMGDYQAHEPFSFRVQPMQPNLHERM

SEQ ID NO: 20279 - protein, 250 aa, Chrysanthemum x morifolium
MGRGRVELKRIENKINRQVTFSKRRNGLLKKAYELSVLCDAEVGLIIFSSRDKLYEFGSVGVMKTLERYQRCCFNPQDNNNERETQSWYQEVSKLKAKFESLQRTQRHLLGEDLGPLSVKELHNLEKQLEGALTQARQRKTQILVEQMEELRCKERELGDMNKHLKIKVSHELSTFETEGQGYRTHQLPCPWNSSNNNTFLMHPSQSNPMGCQQEQPILQIGDNQFMQGEGSSGQRNMVDETNIHGNWVI

SEQ ID NO: 20280 - protein, 232 aa, Chrysanthemum x morifolium
MRGKIQIKKIENSTNRQVTYSKRRNGLFKKASELTVLCDAKVSIIMVSCTDKLHEYISPSITMKQFFDQYQKTTGIDLWNSHYQKMQEELRQQKEVNRNLRKQIRQRLGDCLEDLGFEELLALEKDSQEAVYIIRERKLKVIGNKVETSKKKVRSAQDVYKKLMHEFDIRGEDPQYGMIEDGVDYENVYGYPHMGAQHILTLRLQPDHPNNLHAIATGATTSSDLTTYGLFG

SEQ ID NO: 20281 - protein, 216 aa, Chrysanthemum x morifolium
MVRGKTQMRRIENATSRQVTFSKRRNGLMKKAFELSVLRDAEVALIIFSPRGKLYEFANSSMQETIERYRSHVKDIQTDTSSVEDVQNLKHETAAMAKKVEALEVAKRKLLGEGLGTSTIDELVQIEQQLERSVRIIRARKMQVYNEQIEQLHAKEKMLAAENAILTEKCIIKTDKATEEMGVDLNVLESGENSDVETELFIGLPETRMKQLSWPK

SEQ ID NO: 20282 - protein, 166 aa, Brassica rapa subsp. pekinensis
VEEYEEHMKKLASKLMWLALNSLGVSEEDIEWASLSSDLNWAQAALQLNHYPVCPEPDRAMGLAAHTDSTLLTILYQNNTAGLQVFRDDLGWVTVPPFPGSLVVNVGDLFHILSNGLFKSVLHRARVNQTRARLSVAFLWGPQSDIKISPVPKLVSPVESPLYQSV

SEQ ID NO: 20283 - protein, 166 aa, Brassica rapa subsp. pekinensis
HFTANQAILEAFEGKKRVHVIDFSMNQGLQWPALMQALALREGGPPVFRLTGIGPPAADNSDHLHEVGCKLAQLAEAIHVEFEYRGFVANSLADLDASMLELRPSEIEAVAVNSVFELHKLLGRTGGIEKVLGVVKQIKPVIFTVVEQESSHNGPVFLDRFTESLH

SEQ ID NO: 20284 - protein, 109 aa, Brassica rapa subsp. pekinensis
GTESDEEIRRVPEFGGEATGKEISGSVTGQDQTQATVGGESQRKRGRTPAEKETKRLKRLLRNRVSAQQARERKKAYLGELENRVKDLENRNSELEERLSTLQNENQML

SEQ ID NO: 20285 - protein, 70 aa, Brassica rapa subsp. pekinensis
VCYENPSPTAGIHRVVFILFRQLGRQTVYAPGWRQNFNTREFAEIYNLGLPVAAVFYNCQRESGCGGRRL

SEQ ID NO: 20286 - protein, 135 aa, Brassica rapa subsp. pekinensis
TNQVFRYAKKSGASYINKPKMRHYVHCYALHCLDEEASNALRRAFKERGENVGSWRQACYKPLVNIACRHGWDIDAVFNAHPRLSIWYVPTELRQLCHLERNNAVAAAAALVGGISCTGSSTSGRGGCGGDDLRF

SEQ ID NO: 20287 - protein, 392 aa, Oryza sativa (indica cultivar-group)
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 20288 - protein, 322 aa, Mesocricetus auratus
  unsure (1)..(322): unsure at all Xaa locations
XXXXXXXXXXXDGHCIPALGFGTYKPIEVPKSKAMEAANLAIGVGYRHIDTAYAYQIEEEIGQAIQSNIKAGIVKREDMFITTKLWCTCFQPELVRPSLEKXXXKLQLEHVDLFIMHYPVPMKAGDNDFPLDEQGKLLLDTVDFCATWEALEKXXDAGLVKSIGVSNFNMRQLERILNKPGLKYKPVCNQVECHVYNNQSKLLDYCKSKDIVLVAFGALGTQRYKEWVDQDSPVLLNDPVLCGGAKXXXRSPALIALRYLVQRGVVPLAQSFYESEMKENLQVFEFQLSPEDMKILDGLNKNFRYLPAQFFADHPEYPFSEE

SEQ ID NO: 20289 - protein, 353 aa, Bos taurus
MACCLSDEVKESKRINAEIEKQLRRDKRDARRELKLLLLGTGESGKSTFIKQMRIIHGAGYSEEDKRGFTKLVYQNIFTAMQAMIRAMETLKILYKYEQNKANALLIREVDVEKVTTFEHRYVSAIKTLWNDPGIQECYDRRREYQLSDSAKYYLTDVDRIATSGYLPTQQDVLRVRVPTTGIIEYPFDLENIIFRMVDVGGQRSERRKWIHCFENVTSIMFLVALSEYDQVLVESDNENRMEESKALFRTIVTYPWFQNSSVILFLNKKDLLEDKILHSHLVDYFPEFDGPQRDAQAAREFILKMFVDLNPDSDKIIYSHFTCATDTENIRFVFAAVKDTILQLNLKEYNLV

SEQ ID NO: 20290 - protein, 355 aa, Bos taurus
MAGCCCLSAEEKESQRISAEIERQLRRDKKDARRELKLLLLGTGESGKSTFIKQMRIIHGSGYSDEDRKGFTKLVYQNIFTAMQAMIRAMDTLKIQYVCEQNKENAQLIREVEVDKVSTLSRDQVEAIKQLWQDPGIQECYDRRREYQLSDSAKYYLTDIDRIAMPAFVPTQQDVLRVRVPTTGIIEYPFDLENIIFRMVDVGGQRSERRKWIHCFESVTSIIFLVALSEYDQVLAECDNENRMEESKALFKTIITYPWFLNSSVILFLNKKDLLEEKIMYSHLISYFPEYTGPKQDVKAARDFILKLYQDQNPDKEKVIYSHFTCATDTENIRFVFAAVKDTILQLNLREFNLV

SEQ ID NO: 20291 - protein, 354 aa, Bos taurus
MGCTLSAEDKAAVERSKMIDRNLREDGEKAAREVKLLLLGAGESGKSTIVKQMKIIHEAGYSEEECKQYKAVVYSNTIQSIIAIIRAMGRLKIDFGDSARADDARQLFVLAGAAEEGFMTAELAGVIKRLWKDSGVQACFNRSREYQLNDSAAYYLNDLDRIAQPNYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIKKSPLTICYPEYAGSNTYEEAAAYIQCQFEDLNKRKDTKEIYTHFTCATDTKNVQFVFDAVTDVIIKNNLKDCGLF

SEQ ID NO: 20292 - protein, 354 aa, Bos taurus
MGCTLSAEERAALERSKAIEKNLKEDGISAAKDVKLLLLGAGESGKSTIVKQMKIIHEDGFSGEDVKQYKPVVYSNTIQSLAAIVRAMDTLGIEYGDKERKADAKMVCDVVSRMEDTEPFSPELLSAMMRLWGDSGIQECFNRSREYQLNDSAKYYLDSLDRIGAADYQPTEQDILRTRVKTTGIVETHFTFKNLHFRLFDVGGQRSERKKWIHCFEDVTAIIFCVALSGYDQVLHEDETTNRMHESLMLFDSICNNKFFIDISIILFLNKKDLFGEKIKKSPLTICFPEYTGSNTYEDAAAYIQAQFESKNRSPNKEIYCHMTCATDTNNIQVVFDAVTDIIIANNLRGCGLY

SEQ ID NO: 20293 - protein, 354 aa, Bos taurus
MGSGASAEDKELAKRSKELEKKLQEDADKEAKTVKLLLLGAGESGKSTIVKQMKIIHQDGYSPEECLEYKAIIYGNVLQSILAIIRAMPTLGIDYAEVSCVDNGRQLNNLADSIEEGTMPPELVEVIRKLWKDGGVQACFDRAAEYQLNDSASYYLNQLDRITAPDYLPNEQDVLRSRVKTTGIIETKFSVKDLNFRMFDVGGQRSERKKWIHCFEGVTCIIFCAALSAYDMVLVEDDEVNRMHESLHLFNSICNHKFFAATSIVLFLNKKDLFEEKIKKVHLSICFPEYDGNNSYEDAGNYIKSQFLDLNMRKDVKEIYSHMTCATDTQNVKFVFDAVTDIIIKENLKDCGLF

SEQ ID NO: 20294 - protein, 552 aa, Bos taurus
MVDMGGLDNLIANTAYLQARKSSDADSKELQRRRRSLMLPGPQSCEQLRQALATDFHSLCEQQPIGRRLFRDFLATVPAYQEARGFLEEVQSWELAEEGPAKGSALQGLVTTCAAAPVPGRPHPFFSPALVTKCQAATTDDDRASLVELAKAEVMAFLQDQPFREFLASPFYDKFLQWKVFEMQPVSDKYFEEFRVLGKGGFGEVCAVQVKNTGKMYACKKLDKKRLKKKNGEKMALLEKEILERVSSPFIVSLAYAFESKSHLCLVMSLMNGGDLKFHIYSVGEPGLDMSRVIFYSAQITCGVLHLHSLGIVYRDMKPENVLLDDLGNCRLSDLGLAVQIQDGKPITQRAGTNGYMAPEILMEKASYSYPVDWFAMGCSIYEMVAGRTPFRDYKEKVSKEDLKQRTLKEEVRFQHSNFTEEAKDICRLFLAKTPEQRLGSREKSDDPRKHHFFKTINFPRLEAGLVEPPFVPDPSVVYAKDINEIDDFSEVRGVEFDDNDKQFFQRFATGAVPIAWQEEIIETGPFAELNDPNRPAGCGEGSSRSGVCLLL

SEQ ID NO: 20295 - protein, 1291 aa, Bos taurus
MAGAASPCANGCGPSAPSDAEVVHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIRGLTWLMEDTLQAATPLQIERWLRKQFYSVDRNREDRISAKDLKNMLSQVNYRVPNMRFLRERLTDLEQRTSDITYGQFAQLYRSLMYSAQKTMDLPFLEASALRAGERPELCRVSLPEFQQFLLEYQGELWAVDRLQVQEFMLSFLRDPLREIEEPYFFLDEFVTFLFSKENSIWNSQLDEVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVDIAADGLPSPNQLKRKILIKHKKLAEGSAYEEVPTSVMYSENDISNSIKNGILYLEDPVNHEWYPHYFVLTSSKIYYSEETSSDQGNEDEEEPKEASGSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFTKSAIIQNVEKQEGGWWRGDYGGKKQLWFPSNYVEEMVSPAALEPEREHLDENSPLGDLLRGVLDVPACQIAVRPEGKNNRLFVFSISMASVAHWSLDVAADSQEELQDWVKKIREVAQTADARLTEGKMMERRKKIALELSELVVYCRPVPFDEEKIGTERACYRDMSSFPETKAEKYVNKAKGKKFLQYNRLQLSRIYPKGQRLDSSNYDPLPMWICGSQLVALNFQTPDKPMQMNQALFLAGGHCGYVLQPSVMRDEAFDPFDKSSLRGLEPCAICIEVLGARHLPKNGRGIVCPFVEIEVAGAEYDSIKQKTEFVVDNGLNPVWPAKPFHFQISNPEFAFLRFVVYEEDMFSDQNFLAQATFPVKGLKTGYRAVPLKNNYSEGLELASLLVKIDVFPAKQENGDLSPFGGASLRERSCDASGPLFHGRAREGSFEARYQQPFEDFRISQEHLADHFDGRDRRTPRRTRVNGDNRL

SEQ ID NO: 20296 - protein, 398 aa, Bos taurus
MALLRRPTVSTDLENNDTGVNSKPKSHVTIRRAVLEEIGNRVTTRAIQVAKKAQNTKVPVPPTKTTNVNKHPKPTASVKPVQMDVLAPKGPSPTPQDISMKEENLCQAFSDALLCKIEDIDTEDWENPQLCSDYVKDIYQYLRQLEVLQSINPHFLDGRDINGRMRAILVDWLVQVHSKFKLLQETLYMCVAVMDRYLQVQPVSRKKLQAVGITALVLASKYEEMFSPNIEDFVYITDNAYTSSQIREMETLILKELKFELGRPLPLHFLRRASKAGEVDVEQHTLAKYLMELTLVDYDMVHYHPSKVAAAASCLSQKVLGQGKWNLKQQYYTGYTESEVLEVMRHMAKNVVRVNENMTKFTAIKNKYASSKLLKISTIPQLNSKAIQELASPLLGRS

SEQ ID NO: 20297 - protein, 505 aa, Bos taurus
MSSGQQQPPPPRRVTNVGSLLLTPQENESLFTFLGKKCVTMSSAVVQLYAADRNCMWSKKCSGVACLVKDNPQRSYFLRIFDIKDGKLLWEQELYNNFVYNSPRGYFHTFAGDTCQVALNFANEEEAKKFRKAVTDLLGRRQRKSEKRRDPPNGPNLPMATVDIKNPEITTNRFYGPQINNISHTKEKKKGKAKKKRLTKADIGTPSNFQHIGHVGWDPNTGFDLNNLDPELKNLFDMCGISEAQLKDRETSKVIYDFIEKTGGVEAVKNELRRQAPPPPPPSRGGPPPPPPPPHSSGPPPPPARGRGAPPPPPSRAPTAAPPPPPPSRPGVGAPPPPPNRMYPPPLPALPSSAPSGPPPPPPPLSVSGSVAPPPPPPPPPPPGPPPPPGLPSDGDHQVPTPAGSKAALLDQIREGAQLKKVEQNSRPVSCSGRDALLDQIRQGIQLKSVTDAPESTPPAPAPTSGIVGALMEVMQKRSKAIHSSDEDEDEDDDEDFEDDDEWED

SEQ ID NO: 20298 - protein, 297 aa, Bos taurus
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQFMDSSLVKSYLYQILQGIVFCHSRRVLHRDLKPQNLLIDDKGTIKLADFGLARAFGIPIRVYTHEVVTLWYRSPEVLLGSAGYSTPVDIWSIGTIFAELATKKPLFHGDSEIDQLFRIFRALGTPNNEVWPEVESLQDYKSTFPKWKPGSLASHVKNLDENGLDLLSKMLIYDPAKRISGKMALNHPYFNDLDSQIKKM

SEQ ID NO: 20299 - protein, 492 aa, Bos taurus
MEPTSKKLTGRLMLAVGGAVLGSLQFGYNTGVINAPQKVIEEFYNQTWVQRYGEPIPPATLTTLWSLSVAIFSVGGMIGSFSVGLFVNRFGRRNSMLMMNLLAFVSAVLMGFSKLGKSFEMLILGRFIIGVYCGLTTGFVPMYVGEVSPTELRGALGTLHQLGIVVGILIAQVFGLDSIMGNQELWPLLLSVIFIPALLQCILLPFCPESPRFLLINRNEENRAKSVLKKLRGTADVTRDLQEMKEESRQMMREKKVTILELFRSAAYRQPILIAVVLQLSQQLSGINAVFYYSTSIFEKAGVQQPVYATIGSGIVNTAFTVVSLFVVERAGRRTLHLIGLAGMAGCAVLMTIALALLERLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 20300 - protein, 494 aa, Bos taurus
MGTTKVTAPLIFAISVATIGSFQFGYNTGVINAPEAIIKDFLNYTLEERSEPPPSSVLLTSLWSLSVAIFSVGGMIGSFSVGLFVNRFGRGNSMLIVNLLAIAGGCLMGFCKIAESVEMLILGRLIIGLFCGLCTGFVPMYIGEISPTALRGAFGTLNQLGIVIGILVAQIFGLKVILGTEDLWPLLLGFTILPAIIQCAALPFCPESPRFLLINRKEEEKAKEILQRLWGTEDVAQDIQEMKDESMRMSQEKQVTVLELFRAPNYRQPIIISIMLQLSQQLSGINAVFYYSTGIFKDAGVQEPVYATIGAGVVNTIFTVVSVFLVERAGRRTLHLIGLGGMAFCSILMTISLLLKDNYSWMSFICIGAILVFVAFFEIGPGPIPWFIVAELFGQGPRPAAMAVAGCSNWTSNFLVGLLFPSAAFYLGAYVFIVFTVFLVIFWVFTFFKVPETRGRTFEEITRAFEGQTQTGTRGEKGPIMEMNSIQPTKDTNA

SEQ ID NO: 20301 - protein, 350 aa, Bos taurus
MPGPAARSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRKEPFFHGQDNYDQLVRIAKVLGTDELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 20302 - protein, 410 aa, Bos taurus
MVLSQRQRDELNRAIADYLRSNGYEAAYSVFKKEAELDMNEELDKKYAGLLEKKWTSVIRLQKKVMELESKLNEAKEEFTSGGPLGQKRDPKEWIPRPPEKYALSGHRSPVTRVIFHPVFSVMVSASEDATIKVWDYETGDFERTLKGHTDSVEDISFDHSGKLLASCSADMTIKLWDFQGFECIRTMHGHDHNVSSVAIMPNGDHIVSASRDKTIKMWEVQTGYCVKTFTGHREWVRMVRPNQDGTLIASCSNDQTVRVWVVATKECKAELREHEHVVECISWAPESSYSSISEATGSETKKSGKPGPFLLSGSRDKTIKMWDVSTGMCLMTLVGHDNWVRGVLFHSGGKFILSCADDKTLRVWDYKNKRCMKTLNAHEHFVTSLDFHKTAPYVVTGSVDQTVKVWECR

SEQ ID NO: 20303 - protein, 270 aa, Bos taurus
MAMGTRYAGKVVIVTGGGRGIGAGIVRAFVESGAQVVICDKDEARGRAVERELPGTVFLLCDVTREEDVRTLVSETIRRFGRLDCIVNNAGYHPPPQWPEETSAQGFRQLLELNLLGTYTLTKLALPHLRKSRGNVINISSLVGAIGQSQAVPYVATKGAVTAMTKALALDESQYGVRVNCISPGNIWTPLWEELAASTPDPTATIREGTLAQPLGRMGQPAEVAAAAVFLASEATFCTGTELLVTGGAELGYGRKAGQAAPAEAPTTPS

SEQ ID NO: 20304 - protein, 817 aa, Bos taurus
MLLWPGASGLPPPRIFPSLLVVVALVGLLPVLRSYGLQISPTASTIRGSEPPRERSIGDVTTAPPELAPESRPVNHSFAEHSPKARKAFPVLGIDYQHVRIPFEIALWILLACLMKIGFHVIPTISSIVPESCLLIVVGLLVGGLIKGVGETPPILQSEVFFLFLLPPIILDAGYFLPLRQFTENLGTILIFAVVGTLWNAFFLGGLMYAVCLVGGEQINNIGLLENLLFGSIISAVDPVAVLAVFEEIHINELLHILVFGESLLNDAVTVVLYHLFEEFANYDRVGIVDIILGFLSFFVVSLGGVFVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHHWNWTFVISTLLFCLIARVLGVLGLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKSLPAERILPALSKDKEEEIRKILRNNLQKTRQRLRSYNRHTLVADPYEEAWNQMLLRRQKARQLEQKISNYLTVPAHKLDSPTMSRARIGSDPLAYEPKADLPVITIDPASPQSPESVDLVNEELKGKVLGLSRDPGRLAEEEEDDNGPRWLTMRTKEPSSPGTDDVFTPAPSDSPSSQRIQRCLSDPGPHPEPGEGEPFIPKGQ

SEQ ID NO: 20305 - protein, 260 aa, Bos taurus
MASCGMARRNPLDNKVALVTASTDGIGFAIARRLAQDGAHVVVSSRKQQNVDRAVATLKGEGLSVTGTVCHVGKAEDRERLVATAVKLHGGVDILISNAAVSPFFGSLMDVPEEVWDKILDVNVKATALLTKAVVPEMAKRGGGSIVIVSSIAAYSPFPSLGPYNVSKTALLGLTKNLALELAESNVRVNCLAPGLIRTSFSRVLWEDPARQESIKATFQIKRIGKPEECAGIVSFLCSEDASYITGETVVVAGGSLSHL

SEQ ID NO: 20306 - protein, 1216 aa, Bos taurus
MAGAQPGVHALQLKPVCVSDSLKKGTKFVKWEDDSTVVTPIILRTDPQGFFFYWTDQNKETELLDLSLVKDARCGKHAKAPKDPKLRELLDVGNIGRLEHRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLAKKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLDKYPLESGVPLPSPMDLMYKILVKNKKKSHKSSEGSGKKKLSEQASNTYSDSSSVFEPSSPGAGEADTESDDDDDDDDCKKSSMDEGTAGSEAMATEEMSNLVNYIQPVKFESFEISKKRNRSFEMSSFVETKGLEQLTKSPVEFVEYNKMQLSRIYPKGTRVDSSNYMPQLFWNAGCQMVALNFQTVDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPIWEEEPIVFKKVVLPSLACLRIAVYEEGGKFIGHRILPVQAIRPGYHYICLRNERNQPLMLPALFVYIEVKDYVPDTYADVIEALSNPIRYVNLMEQRAKQLAALTLEDEEEVKKEADPGETPSEAPSEARPTPAENGVNHTTSLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKTAKKDNKKKSEPSSPDHVSSTIEQDLAALDAEMTQKLVDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQVELEQEYQDKFKRLPLEILEFVQEAMKGKISEDSNHSSAPPLMTSDSGKLNQKPPSSEELEGENPGKEFDTPL

SEQ ID NO: 20307 - protein, 247 aa, Bos taurus
MVDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQIESKVFYLKMKGDYYRYLAEVATGEKRATVVESSEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 20308 - protein, 244 aa, Bos taurus
MDKSELVQKAKLAEQAERYDDMAAAMKAVTEQGHELSNEERNLLSVAYKNVVGARRSSWRVISSIEQKTERNEKKQQMGKEYREKIEAELQDICNDVLQLLDKYLIPNATQPESKVFYLKMKGDYFRYLSEVASGDNKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 20309 - protein, 519 aa, Oryza sativa (japonica cultivar-group); identical to SEQ ID NO: 4029

SEQ ID NO: 20310 - protein, 686 aa, Dryopteris filix-mas
TPSEFQVQDLAEWLLGSSEEIASSGVTCTDSLAEAGYPGATALGDAVCGMAAARITPNSDFLFWFRSHTAKEVFWGGAEHDPQARDDDSRLLPRSSFKAFLEIVKRRSLPWEEVEVDAIRSLQLILREDLEEFCAAAAGADVEDVDSLVPLSIKLSLKESEEMGGAEDSKKLERATSAAAGGTGGGGWEKMSLPSSLAQEWMEAIRGTGDGGASGGVPFDWDAISVFQQTSFVVVDALKPDLPIIFASTGFFNLTGYTSREVIGGNCRFLQGPDTNPEDVASIRDAVVPRGTGTFCGRLLNYRKDGSNFWNLLTIAPIKDDTGTIVKLVGVQLEVSKYTEGSRANRLRPNGLPQSLIKYDVRHQDKVSALVAQIVAALTKPYKVEPPRPSYAMRASLTGQTIQPLSPGRAAAARPYSASDVPQTAAIPREGGGRRRHRSSTFLSLLGMEEKDSEEDQFPEPELIMMDNASVGRPGSLDDRERTRRGIDLATTLERIGHSFVITDPRLPDNPIIFASDQFLELTEYSREEVLGENCRFLQGRDTDLKAVQLIRDAVKEGRDITVQLLNYTRGGRPFWNLFHLQAMRDKKGNLQYFIGVQQETDTLDRVEQEKAEVVRATAQNVDVAARELPDANLTPDHLWERHSKVVTPLPHSKINSPCWYAIRKVQRRLRRGERLGLKHFRPIKP

SEQ ID NO: 20311 - protein, 657 aa, Hypolepis punctata
TPLEFQIQELAEWLLGSSEEIASTGVTCTDSLAEAGYPGAAALGDAVCGLAAARITPNSDFLFWFRSHTAKEVFWGGAEHDPEARDDDSRMLPRSSFKAFLEIVKKRSLPWEEVEVDAIRSLQLILREELEKFCAAAAAAATASASDRDDVDSLVPSSKKLSLKENEEMGTGGGWGKMSLPPSLVQEWMEAIRGGAGDGRASGGGGGDFNWDPTCMFQQTSFVVVDALKPDLPIIFASTGFFNLTGYTSTEVIGANCRLLQGPDTNPEDVASIREALAQDTGTFCRKLLNYRKDGSSFWNLLTIAPIKDDRGSIVKLIGVQLEVSKYTEGSRANRLRPNGLPQSLIKYDVRHRDKVSVFVAELVAALTKPDKVELTKPSSTMQFSLTGQTIKPLSKTAAMPREGGGRRRHGSNTFLSLLGVEKKDPVEDQFPEPRLIMVDDNSVGRPESLDDPERTRRGIDLATTLERIGQSFVITDPRLPNNPIIFASDQFLELTEYSREEVLGNNCSFLQGRDTDANTVQLIRDAVAEQRDVTVQLLNYTRGGRPFWNLFHLHAMRDEKGELQYFIGVQQETVAPRVPEDMPDRVKQVHTTAQNVDVAARELPDANLSPDHLWVRHSKVITPLPHSKMNNSSWYAIRRVQRRVRLGLKHFRPIKP

SEQ ID NO: 20312 - protein, 692 aa, Onoclea sensibilis
TPSEFQIQDLVEWLLGSSEDIASSGVTCTDSLAEVGYPGAAALGDAVCGMAAARITPNSDFLFWFRSHTAKEVFWGGAEHDPQARDDDSRLLPRSSFKAFLEIVKRRSLPWEEVEVDAIRSLQLILREDLEEFCAAAAAGADGEDVDSLVPSSKKLSLKEREGSGAENSKKLERATSAAVGAAGGTGGRWEKMLLPSSLAQEWMEAIRGTGDGGASGGGGGVPFDWDAISVFQQTSFVVVDALKLDLPIIYASTGFFNLTGYTSREVIGGNCRFLQGPETNPAVIDSIREALVPQGTGTFCGRLLNYRKDGSSFWNLLTIAPIKDDSGTIVNLIGVQLEVSKYTEGSRENRLRPNGLPQSLIKYDVRHQDKVSALIAQLVAALTKPHKVEPPRPSYTMRFSLTGQTIEPLSPGQAAAAARPCSTSDVPQTTSIPREGRGRRRHRSSTFLSLLGMEEKDSEEDQFPEPELIMVADASVGRLRSSDDPERTRRGIDLATTLERIGHSFVITDPRLPGNPIIFASDQFLELTEYSREEVLGENCRFLQGRDTDRKAVQLIRDAVEEGRDVTVQLLNYTKGGRPFWNLFHLQAMRDKKGNLQYFIGVQQETDTPDRVEHEKAKVVRATAQNVDVAARELPDANLTLDHLWERHSKEVTPLPHSKINSPCWYAIRRVQRRLRRGERLGLKHFRPIKP

SEQ ID NO: 20313 - protein, 390 aa, Arabidopsis thaliana
MLLTPKMFSSWLRQDVKKILKRKDSDAGERGKALEDLRASLFNRFRSPETPKRQQQQQHRICGPTVALTFNFVVAISIIFMNKWVLKNIGFEFPVFLTFIHYIVAYLLMALLKSFSFLPASPPSTKSSLLPLYTLGIVMSLSTGLANVSLKYNSVGFYQMAKIAVTPSIVFAEFLWYRKRVSFMKVVSLTVVSVGVAVATVTDLQFSLFGACVAFAWIIPSATNKILWSNMQQRENWTALALMWKTTPITLLFLVSMIPFLDPPGALSFNWSLTNTSAILVSALLGFFLQWSGALALGATSAITHVVLGQFKTCVLLLGNYYIFGSNSGFISVGGAFVAIMGTSLYTYLNTRGQSLKTSSSSSALSEKKSRFSDLKDDDKNLEPYGSEAV

SEQ ID NO: 20314 - protein, 259 aa, Bacteroides fragilis
MNRFENKIIIITGAAGGIGASTTRRIVSEGGKVVIADYSREKADQFAAELSNSGADVRPVYFSATELKSCKELITFTMKEYGQIDVLVNNVGGTNPRRDTNIETLDMDYFDEAFHLNLSCTMYLSQLVIPIMSTQGGGNIVNVASISGITADSNGTLYGASKAGVINLTKYIATQTGKKNIRCNAVAPGLILTPAALNNLNEEVRKIFLGQCATPYLGEPQDVAATIAFLASEDARYITGQTIVVDGGLTIHNPTINLV

SEQ ID NO: 20315 - protein, 302 aa, Capsella rubella
MADDWDLHAVVRGCSAVSSSATTSTTTVFSGGVSSHTNPTFTVGRQSNAVSFGEIRDLYTPFTQESVVSSFSCLNYPEEPRKTKNQKRPLSLSASSGSVTSKPTGSTTSRSKRRKIQHKKVCHVAAEALNSDVWAWRKYGQKPIKGSPYPRGYYRCSTSKGCLARKQVERNRSDPKMFIVTYTAEHNHPAPTHRNSLAGSTRQKPSDQPMTTKSPTTTIATYSSSPVTSADEFVLPVEDLAVGEGLDGDEDLLSLSDTVVSDDFFDGLEEFAAGDSFSGNSAPACFDLSWVVNSAATTTGGI

SEQ ID NO: 20316 - protein, 600 aa, Oryza sativa (japonica cultivar-group)
MAAAAAVAAVVVAAVVAAAASAAAPASAGEPTRDVRWEVGYMTVAPLGVSQKVIAINNQFPGPLLNVTTNWNVRVNVQNNLDEPLLLTWDGIQMRMNSWQDGVAGTNCPIPPGWNWTYQFQLKDQIGSFFYFPSLGLQRAAGGFGPVTVNNRAVVPVPFAQPDGDITLFIGDWYTKSHVELRKMLDDGKDLGIPDGILINGKGPYSYDNTLIPEGLQHETVGVEPGKTYRFRVHNVGTSTSLNFRIQNHNMRLVEAEGTYTYQQNYTNLDIHVGQSYSFLVTMDQNASTDYYIVASPRFVTNESRWHDVNGVAVLQYSNSKGRASGPLPDGPNDFYYKSYSMDQARSIKMNTTAGAARPNPQGSFRYDSINITQTFVLKNELPLLINGKRRRTINGVSYSPPETPLRLADLHNLTGVYKTDFPTMPGNAPPKMASSTLNASYKGFLEIVFQNNDTGVQTYHLDGYSFFVVGMDNGDWTPDCRSRYNKWDAISRSTTQVFPGGWTAVLVSLDNVGIWNLRSEKLDNWYNGQEVYVKVADPLGYNITEMIMPDNALYCGLLKDLQKPQIHQVNSKSSAQAADRWGARVLAMVLLIIAAVVSI

SEQ ID NO: 20317 - protein, 641 aa, Oryza sativa (japonica cultivar-group)
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWYFTFFSHPALIFIYDPSMALMNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWEILYSIKPELIDYPSSFKSPVSSGTKTVLLPEARARVFKSNYSQSLGELKILRSSWLVASFSESGKAGFSSFWLLVHFLDFTTTASQNLDQKLDCLGELLIMGEAAAARSSPNRPFVSLYQQPW

SEQ ID NO: 20318 - protein, 460 aa, Drosophila melanogaster
MSGINSRNQKMEQQRQLMEAYIRQKRASPGMVQASDLQINRPMSGMRSNSRELHAYDGPMQFISSPQNPDQILTNGSPGGINPVAMNTSRNHSNNMRSLSTINQEADLIEEISSHELEDEESSPVTVIEQHQQSASHSANSTQSQKPRARQHSFSDNLDEDDYTNRNVAGAAPVRPAGMASSPYKDATLDGSSNGTGNGTGGESEGDVIGNIDQFVMQPAPQGVLYKCRITRDRKGMDRGLFPIYYLHLERDYGKKIFLLGGRKRKKSKTSNYIVSCDPTDLSRNADGFCGKLRSNVFGTSFTVFDNGNKESTESPRLDLAVIIYDTNILGFKGPRNMTVILPGMTEDDQRVKISSADPKQQGILDLWKMKNMDNIVELHNKTPVWNDETQSYVLNFHGRVTQASVKNFQLVHDSDPEYIVMQFGRTSEDVFTMDYRYPLCAMQAFAIALSSFDGKIACE

SEQ ID NO: 20319 - protein, 1095 aa, Drosophila melanogaster
MTKKYEFDWIIPVPPELTTGCVFDRWFENEKETKENDFERDALFKVDEYGFFLYWKSEGRDGDVIELCQVSDIRAGGTPKDPKILDKVTKKNGTNIPELDKRSLTICSNTDYINITYHHVICPDAATAKSWQKNLRLITHNNRATNVCPRVNLMKHWMRLSYCVEKSGKIPVKTLAKTFASGKTEKLVYTCIKDAGLPDDKNATMTKEQFTFDKFYALYHKVCPRNDIEELFTSITKGKQDFISLEQFIQFMNDKQRDPRMNEILYPLYEEKRCTEIINDYELDEEKKKNVQMSLDGFKRYLMSDENAPVFLDRLDFYMEMDQPLAHYYINSSHNTYLSGRQIGGKSSVEMYRQTLLAGCRCVELDCWNGKGEDEEPIVTHGHAYCTEILFKDCIQAIADCAFVSSEYPVILSFENHCNRAQQYKLAKYCDDFFGDLLLKEPLPDHPLDPGLPLPPPCKLKRKILIKNKRMKPEVEKVELELWLKGELKTDDDPEEDASAGKPPEAAAAPAPAPEAAAAAEGAAEGGGGAEAEAAAANYSGSTTNVHPWLSSMVNYAQPIKFQGFDKAIEKNIAHNMSSFAESAGMNYLKQSSIDFVNYNKRQMSRIYPKGTRADSSNYMPQVFWNAGCQMVSLNFQSSDLPMQLNQGKFEYNGGCGYLLKPDFMRRADKDFDPFADAPVDGVIAAQCSVKVIAGQFLSDKKVGTYVEVDMFGLPSDTVKKEFRTRLVANNGLNPVYNEDPFVFRKVVLPDLAVLRFGVYEESGKILGQRILPLDGLQAGYRHVSLRTEANFPMSLPMLFVNIELKIYVPDGFEDFMAMLSDPRGFAGAAKQQNEQMKALGIEEQSGGAARDAGKAKEEEKKEPPLVFEPVTLESLRQEKGFQKVGKKQIKELDTLRKKHAKERTSVQKTQNAAIDKLIKGKSKDDIRNDANIKNSINDQTKQWTDMIARHRKEEWDMLRQHVQDSQGAMKALMLTVQAAQIKQLEDRHARDIKDLNAKQAKMSADTAKEVQNDKTLKTKNEKDRRLREKRQNNVKRFMEEKKQIGVKQGRAMEKLKLAHSKQIEEFSTDVQKLMDMYKIEEEAYKTQGKTEFYA

SEQ ID NO: 20320 - protein, 344 aa, Homo sapiens
MGRWALDVAFLWKAVLTLGLVLLYYCFSIGITFYNKWLTKSFHFPLFMTMLHLAVIFLFSALSRALVQCSSHRARVVLSWADYLRRVAPTALATALDVGLSNWSFLYVTVSLYTMTKSSAVLFILIFSLIFKLEELSTQFNVEGFALVLGASFIGGIRWTLTQMLLQKAELGLQNPIDTMFHLQPLMFLGLFPLFAVFEGLHLSTSEKIFRFQDTGLLLRVLGSLFLGGILAFGLGFSEFLLVSRTSSLTLSIAGIFKEVCTLLLAAHLLGDQISLLNWLGFALCLSGISLHVALKALHSRGDGGPKALKGLGSSPDLELLLRSSQREEGDNEEEEYFVAQGQQ

SEQ ID NO: 20321 - protein, 397 aa, Xenopus laevis
MSRRSGRLQARHGSAETGNDCQLAVATKKRKSEETSTTFECHQDAKRHNYEIQGCWSEITTGTVTPCILIETPHKEMPVSTDLSQFSRYRFKNLFISRSPLPELSWGNSKDVWMKMISKESRYVHSSRLLQNHPTLNPDMRSILLDWLIEVSEVYTLHRETFYLAQDFFDRFMLTQTCVNKSMLQLIGVTALFIASKLEEIYPPKLYEFAYVTDGACTEDDILQMELIILKALKWELCPVTAISWLNLYLQVSSLKDHPKLLLPQYSQEQFIHVAQLLDMCILHHTSLEFQYRILAAAALYHCTSIEVVTKATGLDMDSISECVHWMTPFASVVKKSFPLKLKVFKRISPEDMHNIQTHTNYIDMLDDVKIPDRVLGESPVFIGGILTPPKSTEKTF

SEQ ID NO: 20322 - protein, 574 aa, Xenopus laevis
MGGLEKKKYERGSATNYITRNKARKKLQLSLPDFRRLCILKGIYPHEPKHKKKVNKGSTAPRTFYLLKDIKFLLHEPIVGKFREYKVFVRRLRKAYGKREWDSVDRIRDNKPSYKLDHIIKERYPTFIDAVRDLDDALSMCFLFSTFPRTGKCHVQTIQLCRRLSVEFLNYVIDSRSLRKVFLSIKGIYYQADILGQTLTWITPYAFSHDHPTDVDYRVMATFTEFYTTLLGFVNFHLYQTLNLQYPPKLDSFSEVDLKSDGEDKYALETEVYMEKLAALSASLSRVIPSEPNDDTEVDEFPADPENAGLEEEQKRQLQEEEKHKSLFVGLKFFLNREVPRDALAFIIRSFGGEVSWDASVCIGATYNSTDPSITHHIVDRPSIQTQIINRYYLQPQWVFDCVNARLLLPVEDYFPGVLLPPHLSPFVHEKEGDYIPPEKLRLMAMQKGENLGLDEEDDDDDDDDEEEDDDDDEEEEDKKLRQLENKKVGQKNLNVKVTAGKVKVEDRTQVAEQEKNEEKRLAIMMMKKKEKYLYNKIMFGKKRKVREANKLALKRKAHDEAVKVERKKKAKKH

SEQ ID NO: 20323 - protein, 377 aa, Danio rerio
MLLSLGMLMLSATQIYTIFTVQIFAFLNLLPVEADISAYSFDNKTENFDDLPARFGYRLPSEGLKGFLIGARPENACVPIEPPPQRENLSSAFIVLIRRFDCNFDIKVLHAQKAGYKAAIVHNVDSDDLISMGSEDLDILKQIDIPSVFIGEEAANSLKEDYIYEKGGHVILMPDFSLPLEYYLIPFLIIVGICLILIVVFMITKFVQDRHRARRSRLRKDQLKKLPIHKFKKGDSYDVCAICLDEYEEGERLRVLPCSHAYHCKCVDPWLTKTKKTCPVCKQKVVPSDGDSESDSDSVDSGGEDNEVSENTPLLRSLASTSAHSFGSMSASLSQHDAGSSDYDERSDSSDSEEEVTVETVVVQLQQGRPDDTEANA

SEQ ID NO: 20324 - protein, 463 aa, Danio rerio
MAMTGGMAAPLPMSNHTRERVTVAKLTLEHFYSTLLTQHEEREMRQKKLEKVMDEEGLPDEEKSMRRSLHARKETEFLRLKRTRLGLDDFESLKVIGRGAFGEVRLVQKKDTGHIYAMKILRKADMLEKEQVAHIRAERDILVEADGAWVVKMFYSFQDKRNLYLIMEFLPGGDMMTLLMKKDTLSEEATQFYIAETVLAIDSIHQLGFIHRDIKPDNLLLDSRGHVKLSDFGLCTGLKKAHRTEFYRNLTHNPPSDFSFQNMNSKRKAETWKKNRRQLAYSTVGTPDYIAPEVFMQTGYNKLCDWWSLGVIMYEMLIGYPPFCSETPQETYRKVMNWRETLTFPPEVPISERAKELILRYCTDAENRIGSGSVDEIKSHPFFESVDWEHIRERPAAISIDIKSIDDTSNFDDFPESDILQPANVTESDFKSKDWVFLNYTYKRFEGLTQRGTIPTYMKAGKA

SEQ ID NO: 20325 - protein, 695 aa, Danio rerio
MKTFCGRANPTTGALDWVEESEEYDYHQEIARSCYADMLHDKDRNEKYYEGIRAAVRRIKARGERPVVLDIGTGTGLLSMMAVTAGADFCYAIEVFKPMAQAASCIVERNGFSDKIKIINKHSTEVTVGPDGDMQERANILVTELFDTELIGEGALPSYEHAHMHLVQTGCEAVPHRATIYAQLVESDMLWKWAQMRPIDVDGHRLMPPGAVQECAGAPSVCDIQLSQVPTDAFTAISPVCTMFSVDFSKPVSSAAQSYTVRFKSQTGGRAQVVLSWWDIDMDPEGNIVCTMAPSWSYADPHAYPWRDHWMQSVYFLPAEENVSEGEELMLMVSHDDYSLWYSLTHSKQNDVRVAPFRPCCTCQAHLVWTRPRFGELNDEQRTESYVSALRSMLKPDSVCLSVSDGSLLPVFAHLLGSKKVFSLESSGMAKQVIEQVLHTNSLKDGVQLLGIRAEQLSLADLDGNQISVLMGEPYFSTSLLPWHSLFFWYCRTAVAQLLQPDATILPRAATLYAVAVEFQDLWRIRFPCGTCEGFDVSPMDEMIQRSLDFRESWEAEPHPLWEYPCRALTKPCPVMTFDFTQCVPEQPISSDGAVPFTGRGRCHGVALWMEYQLTDDISVSMGLTKAVSQEGACEWNPHRKQGVFFFRSAKETSGDGREDLSYSLTFEPHSGDIKMDFSITEKKKKKKKKKKKKK

SEQ ID NO: 20326 - protein, 252 aa, Xenopus laevis
MGSPELLLDSSIRLWVVLPIVFITFLTGLLRHHVTRLLQGEKRPELEALSDSQVLIRSRILRENGKYIPRQSFLMRKSYFNDNETGFFKKTKRKVIQRNPMTDPTMMTDMMKGNLTNVLPMILIGGWINWAFSGFLTTKVPFPLTLRFKPMLQRGIELESLDASWVSSASWYFLNVFGLRSMYTLLLGQDNAADQSRIMQDQMTGAALSVPPDTNKAFKAEWEAMEITEHHWALETIEEDLISQDLALASEQ

SEQ ID NO: 20327 - protein, 395 aa, Danio rerio
MSGPVPSRSRVYPDVNTQRPREYWDYESHVVDWGNQDDYQLVRKLGRGKYSEVFEAINITNNEKVVVKILKPVKKKKIKREIKILENLRGGPNIITLLDIIKDPVSRTPALVFEHVNNTDFKQLYQTLSDYDIRFYMYEILKALDYCHSMGIMHRDVKPHNVMIDHEHRKLRLIDWGLAEFYHPNQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSTEALDFLDKLLRYDHQARLTAREAMDHSYFYPIVKDQGRGAPAAGMAASSTPVSSSSLMAGIASMTPSTQPNIANISAGSPVIPAPNTMATQVPTAAGAQP

SEQ ID NO: 20328 - protein, 334 aa, Danio rerio
MGNPLLDICAVVDKDFLDKYGLKPNDQILAEDKHKEMFEEMVKKFKVEYRAGGATQNSVKVAQWMIQEPHNVGTFFGCIGKDKFGKILKEKAEEAHVDGHYYEQSEEPTGSCAACITGDNRSLVANLAAANCYKKEKHLDLEENWKLVEKAQVYYIAGFFLTVSLESILKVAKHASENNKIFCLNLSAPFICEFFKEALMKVMPYVDILFGNETEAAAFAREQGFETEDIEEIAKKAQSLPKENKKRQRIVVFTQGKEGTVMAKGDKVETFPVLEIDQSEIVDTNGAGDAFVGGFLSQLVQDKTFEQCIRAGHYAANVIIRHAGCTFPEKPDFH

SEQ ID NO: 20329 - protein, 674 aa, Danio rerio
MAWHNTSPFRYGFDLGAQYQDLRPLGTGASGLVLSALDRRSGLRVAVKKLVMRDAVSVKHALREVKITRRLQHENVVRVYDVLGSSGHPLPRDLTHVAAIYIVQECMETDLARLLEQGPLPAEHATLLFYQLLRGLKFIHSANVLHRDLKPANIFINTEQMLLKIGDFGLARIVDPHYSHKGYLSEGMVTKWYRSPRLLLSPNNYTKAIDMWAAGCILAEMLTGRMLFAGAHELEQMQLILDTVPVIREEDRQELLRVMPSLVGHGWQIRRSFRDLMPEVEDKAIDFLESILTFNPMDRLTAEAALCQPFLQRYSCPQDEPVSLQPFRIEDELEDSLVTESTHTHGLRSHWDRYDSSLSSDVYWPTQDQCGCMQSVSELGEAEDEEVQRDPRASSASHIEEAQVDPRKYSHSSSAERFLEQSHPSLERICGHFSELDCGRSCDYKVGSPSYLDKIAWREGKPQHYSEPKLILDLSNWRNNSMAAPRQNSAEKLLTEPGDLFQEISRWVETTQSGLHSPGSPQEPPSSPCSPPLPLSPTLMPQSQIQIPAPLTLPSPLSRRSPTPFFSAPPSLLPSSPSSPHHGSSNYPSSSIGCENYEEPSQMRPSGEEHFDLDVFISQALQICSQSEIMESSDDLKSDNISDVCNVSDDHRPSRTQTPTPEMVKAHGCHKEHW

SEQ ID NO: 20330 - protein, 318 aa, Homo sapiens [sequence omitted]

SEQ ID NO: 20331 - protein, 130 aa, Xenopus laevis
MAAAVGLRASYHRALGRIEMMLPPKLRPIYNHPAGPKTVFFWAPIMKWGLVFAGLADMTRPADKLSTGQSAVLTATGLIWSRYSLVIIPKNWSLFAVNFFVGCAGGSQLFRIWKHNQELKAIDVQQEVKP

SEQ ID NO: 20332 - protein, 342 aa, Xenopus laevis
MSLHGKRKEIYKYEAPWTVYAMNWSVRPDKRFRLALGSFVEEYNNKVQLVGLDEESSEFICRNTFDHPYPTTKLMWIPDTKGVYPDLLATSGDYLRIWRVGETETRLECLLNNNKNSDFCAPLTSFDWNEVDPNLLGTSSIDTTCTIWGLETGQVLGRVNLVSGHVKTQLIAHDKEVYDIAFSRAGGGRDMFASVGADGSVRMFDLRHLEHSTIIYEDPQHHPLLRLCWNKQDPNYLATMAMDGMEVVILDVRVPCTPVARLNNHRACVNGIAWAPHSSCHICTAADDHQALIWDIQQMPRAIEDPILAYTAEGEINNVQWASTQPDWIAICYNNCLEILRV

SEQ ID NO: 20333 - protein, 206 aa, Danio rerio
MASKCPKCEKTVYFAEKVSSLGKDWHKFCLKCERCSKTLTAGGHAEHDGKPYCHKPCYAALFGPKGVNIGGAGSYVYEAPTNTSPPPNNGDSVPKAQEKWVPVSSRPPSKAGSITTFSGEANLCPRCSEKVYFAEKVTSLGKDWHRPCLRCERCSKTLAAGSHAEHDGQPYCHKPCYAVLFGPKGVNTGGVGSYIYDKEPNAEAQP

SEQ ID NO: 20334 - protein, 245 aa, Danio rerio
MDRTELIQKAKLAEQAERYDDMASCMKSVTEAGSELSNEERNLLSVAYKNVVGARRSAWRVISSIEQKTEGNDKKLQMVKEYREKVESELRDICNDVLELLNKYLIENSSNPESKVFYLKMKGDYYRYLAEVAAGDDKKATIENSQDAYQKAFDISKTEMQPTHPIRLGLALNFSVFFYEILNSPEKACSLAKQAFDEAIAELDTLNEESYKDSTLIMQLLRDNLTLWTSDNAPDEGEGGEGGEN

SEQ ID NO: 20335 - protein, 468 aa, Danio rerio
MAMTSQTTCSSMSNHTKERVTMAKVTLENFYSNLISQHEEREMRQQKLEKVMDQEGLADEEKRLRRSEHARKETEFLRLKRTRLGLEDFESLKVIGRGAFGEVRLVQKKDTGHVYAMKILRKADMLEKEQVGHIRAERDILVEADSLWVVKMFYSFQDKMNLYLIMEFLPGGDMMTLLMKKDTLTEEATQFYIAETVLAIDSIHQLGFIHRDIKPDNLLLDSRGHVKLSDFGLCTGLKKAHRTEFYRNLNHSLPSDFTFQNMNSKRKAETWKRNRRQLAFSTVGTPDYIAPEVFMQNGYNKLCDWWSLGVIMYEMLIGYPPFCSETPQETYRKVMNWRETLIFPPEVPISEKAKDLILRFCCEGEHRIGATGVEEIKTNAFFEGVDYDHIRERPAAIPIEIKSIDDTSNFDEFPDSDILQPSATTVVSNHTEADLKSKDWVFINYTYKRFEGLTARGGIPSYMKTGKR

SEQ ID NO: 20336 - protein, 378 aa, Danio rerio
NHTVTAKRREQNKCVLHELCCSRGCVQFIEMAETADRMEVSQGESSAKPAAEDMTSKDYYFDSYAHFGIHEEMLKDEVRTLTYRNSMFHNKHLFKDKVVLDVGSGTGILCMFAAKAGAKKVIGIECSSISDYAVKIVKANKLDHIVTIIKGKVEEVELPVENVDIIISEWMGYCLFYESMLNTVIYARDKWLKPDGLIFPDRATLYVTAIEDRQYKDYKIHWWENVYGLDMSCIKEVAITEPLVDVVDPKQLVSTACLIKEVDIYTVKIEDLSFTSPFCLQVKRNDYIHALVTYFNIEFTRCHKRTGFSTSPESPYTHWKQTVFYLDDYLTVKTGEEIFGTISMKPNVKNNRDLDFTVDIDFKGQLCEVSKTSEYRMR

SEQ ID NO: 20337 - protein, 370 aa, Xenopus laevis
PAYKVSGGVFRLVREPDTRMAEATTCNMEVNSAPPEGGVKTNAEDMTSKDYYFDSYAHFGIHEEMLKDEVRTLTYRNSMFHNRHLFKDKVVLDVGSGTGILCMFAAKAGAKKVIGIECSSISDYAIKIVKANKLDHVVTIIKGKVEEVELPVEKVDIIISEWMGYCLFYESMLNTVIYARDKWLTPDGLIFPDRATLYITAIEDRQYKDYKIHWWENVYGFDMSCIKDVAIKEPLVDVVDPKQLVSNACLIKEVDIYTVKVDDLSFTSPFCLQVKRNDYIHALVAYFNIEFTRCHKRTGFSTSPESPYTHWKQTVFYMEDYLTVKTGEEIFGTIGMKPNAKNNRDLDFTFDIDFKGQLCELSCSTDYRMR

SEQ ID NO: 20338 - protein, 226 aa, Ictalurus punctatus
MGFVKVVKNKAYFKRYQVKFRRRREGKTDYFARKRLVIQDKNKYNTPKYRMIVRFSNRDIVCQIAYAKIEGDAIVCAAYSHELPRYGVSVGLTNYAAAYCTGLLLARRLLNKFNLDKVYEGQVEVTGEEFNVESVDGQPGAFTCYLDAGLTRTTTGNKVFGALKGAVDGGLSSHTALSGSRATTPRAKSSAVRSTGSTSGLERVEYMSSLIEEDEDAYKKQFSRFI

SEQ ID NO: 20339 - protein, 88 aa, Ictalurus punctatus
RHEVTESIQACKLAQKNGWGVMVSHRSGETEDTFIADLVVGLCTGQIKTGAPCRSERLAKYNQLMRIEEQLGDKAKFAGKDFRHPKVN

SEQ ID NO: 20340 - protein, 1312 aa, Danio rerio
MAASAGFSSNGPVPWALSDTEVNNLYRDLELGTVLTLYYSKKSQRPERRTFQVKLETRQIIWTRGTDKIEGEIDIREIKEIRTGQKSRDFERYVEDVTTRPDQAHCFVILYGTEFRLKSLSLAATSDEEMVMWVKGLTWLMSDTLSSSTPLQIERWLRKQFYAVDRNREDRISCKDLKCMLCQVNYRVPNMKFLREKLPDGELRNGDVSYSHFAQLYRSLMFDAQKSMEIPLLQRFIDRPEQKISLEDFQNFLIEQQKELWAADSNKVQEYMFRYLKDPLREIEQPYFHQDEFLTYLFSKENTIWDAQLDQVRPEDMNNPLSHYWISSSHNTYLTGDQFSSESSLEAYARCLRMGCRCIELDCWDGPDGMPVIYHGHTLTTKIKFSDVLNTIKEHAFVTSDYPIILSIEDHCSIVQQRNMATFFKKVFGEMLLTKAVDISADGLPSPHQLKRKILIKHKKLAEGSAYEEVSSSTPYSENDISNSIKNGILYLEDPINHEWYPHFFVLTSNKIYYSEETSSNQGNEDEEEHREICNGMDQHVTEKWFHGKLGAGRDGRQIAERLLSEYCVETGAPDGSFLVRESETFVGDYTLSFWRSGRVQHCRIHSRQEAGSPKFYLTDNLVFDTLFALITHYQQVPLRCNEFEMKLTEPVPQTNAHESKEWYHACLSRSQAENMLMRVPRDGAFLVRKRTEFNSFAISFRAEGKIKHCRVQQEGQTVVLGTSEFDSLVDLISYYEKHPLYRKMKLRYPINEETLEKIGTAEPDYGSLYEGRNPGFYVEANQMPTFKCTVKAMYEYKAQRDDELSFIKNAIISNVDKQEGGWWKGDCGGKKQLWFPANYVEEISPTAVEPDRSASENSPLGDLLRGSVDVSSCQIVVRPEGKGSRQFVFSLVPVASPRTGPVLDIAASSQEELKDWVVKIREVTMTSEAKLEEGKMMERRKKIALELSDLVIYCRPVPFDEDKIGTERACFRDMSSFPETKAEKYVNRVKGKKFLQYNRLQLSRIYPRGQRLDSSNYDPLPMWLCGSQLVALNFQTADKPMQMNQAIFMLNGRSGYVLQPPIMRDDNFDPFDRHSLRGVEPITLSIEVLGARHLPKHGRGIVCPLIEIEVCGAEYDNAKQRTDSEADNGLNPTWTRKLFRFTVCNPSFAFLRFVVYEIDMFSDQNFLAQATFPINCLKTGYRSVPLKNSYSEDLELACLLVHMDVIRGRVGYEMIHENGDMLSPFSPAGAMAMAMQTGRERMNDSGSVSSTSSMSPLPSSPAQALGYRGREGSFEARYQTPLEDFRVSQEALLDHENRRLRRARVSADNRA

SEQ ID NO: 20341 - protein, 429 aa, Agrobacterium tumefaciens
EFGETKPLKGARITGSLHMTIQTAVLIETLVALGAEVRWASCNIFSTQDHAAAAIAASGVPVYAIKGESLEDYWIYTDKIFQWADGGFSNMILDDGGDATMYILLGARAEAGEDVLSDPHSEEEEILFAQIKKRLKASPGWFTKQRDAIKGVTEETTTGVNRLYQLSQKGLLPFPAINVNDSVTKSKFDNKYGCKESLVDGIRRATDVMMAGKVAVVCGYGDVGKGSAASLSGAGARVKVTEVDPICALQAAMDGYEVVLLEDVVSSADIFISTTGNKDVIRIDHMRAMKDMAIVGNIGHFDNEIQVAALRNLKWTNVKPQVDLIEFAKGNRIILLSEGRLLNLGNATGHPSFVMSASFTNQTLAQIELFTKPGQYQNQVYVLPKHLDEKVARLHLGKLGVKLTELSGEQAAYIGVTPQGPFKSDHYRY

SEQ ID NO: 20342 - protein, 146 aa, Catharanthus roseus
RTLRELKLLRHMDHENVVAIRDIIPPPQRESFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTTAIDVWSVG

SEQ ID NO: 20343 - protein, 318 aa, Streptomyces griseus subsp. griseus
MSDGNGDGPVRDETIRSGVVRPAGIPEQQARPHPVDGADGAESIDVAVEQQSQAGRAGQMSEHGHHDPHDRSGARALFFELRELPDGSAEKAELRNRLVRMHLPLVEHLARRFRNRGEPLDDLTQVATIGLIKSVDRFDPDRGVEFSTYATPTVVGEIKRHFRDKGWAVRVPRRLQELRLSLTTATAELSQQHGRSPTVHELAERLGISEEEVLEGLESANAYSTLSLDVPDTDDESPAVADTLGSEDEALEGVEYRESLKPLLEALPPREKRILLLRFFGNMTQSQIAQEVGISQMHVSRLLARTLAQLRERLLVEE

SEQ ID NO: 20344 - protein, 224 aa, Podospora anserina
NTFWKARPSKKLVERLESFPYYENYEDLTRLEVCSILSATKKAPRRVAFIGSGPLPLTSLCLLQALKNDVAVRSLTQPTTNNTTATDNAANQEPIVLNVDYDEAAISASLKLSLALGERGNGMEFICAEATSASASRDLSEFDVVYMAALVGVTQTDKEKIMLEVISRMRRGALLVVRSSWGLRSCLYPEVDLATETLLKRLEPCVVVHPYNQVVNSVIVARVR

SEQ ID NO: 20345 - protein, 129 aa, Fusobacterium nucleatum subsp. vincentii ATCC 49256
  unsure (1)..(129): unsure at all Xaa locations
MGVANMKTPILYAFTXPEKEFNSSINFLDLIKTSNLTFEEPNRKIFKGIDLAYRAGEIGCTMTTVFNASNEVAVELFMKKKIKFLDIYRIIEEAMNSHQILSLNTDNALNIIKEVDRETRKKVREQWER

SEQ ID NO: 20346 - protein, 851 aa, Fusobacterium nucleatum subsp. vincentii ATCC 49256
MKQVYEFKDGGKEMVALLGGKGANLAEMAKIDLPIPKGIIISTTACNDYFKNDKKLSSVLEEEILTNIRVLEYETGKKFQSTKPLLVSVRSGAPVSMPGMMDTILNLGFNDYVAEKMLEITKDEKFVYTSYLRFVQMFSEIAKGINRKKFMHLKATDYKAQIIESKNIYREECGEMFPENYKAQILIAVKSIFDSWNNDRAILYRKLHNIDNNMGTAVVIQEMVFGNFNDKSGTGVLFTRNPSTGENKIFGEVLLNAQGEDIVAGIRTPDNIELLKTSMPNIYNELADTVKKLEKHNRDMQDVEFTIEDSKLYILQTRNGKRTAEASLKIAMDLVKEGIITKEEAILKVEPASLNKLLNGDFEEKYLKEATLLTKGLAASSGVAVGRIMFDAKRVKIREKTILVREETSPEDLQGMALAQGIVTLKGGATSHGAVVARGMGKCCVTGCSEIKIDEINKTMTVGKHTLKEGDFISVSGHTGEIYLGKIPLKENSFSDELKEFVSWASEIKRMGVRMNADTPEDVKQGKAFGAKGIGLCRTEHMFFKKDKIWTIREFILSDRGEEKEKALKKLHNLQKEDFLNIFKILNGDEANIRLLDPPVHEFLPKTLEDKKKMAEILSISLEDIEKRIYRLKDENPMLGHRGCRLGVSYPELYRIQARAIVEAAYECEKKGIKVHPEIMIPFIMESKELAYLRKEIEEEIESFFKEVGATVEYKLGTMIEIPRACLLANEIAEYADFFSFGTNDLTQMSMGLSRDDSVKFLDDYREKGIWEGEPFYSIDTKSVTKLVEIGVKNGKTTKPNLQIGVCGEHGGDPKSIEFFEGQKFDYVSCSPFRVPTAILAAAQSYLKLKR

SEQ ID NO: 20347 - protein, 535 aa, Fusobacterium nucleatum subsp. vincentii ATCC 49256
MKQRLALHYVFNSPKDKFVFDVSHQTYPHKMLTGRRQAFTDETHYDDVTGYSNQNESEHDHFILGHTSTSISLALGLAKARDVKGEIGNVVAIIGDGSLSGGEALEGLDFAGELRSNFIIIVNDNDMSIAENHGGLYKNLKLLRETEGKAETNLFKAMGLDYIFIKDGNNLEELIETFKKVKDINHPIVVHIFTQKGKGYKLAEIDKEPWHYVMPFNIEDGKPLNTDDSEDYTDVTKEYLIKKMKEDKTVVTITSGTPGAVGFNKKDRDEVGSQFIDVGIAEETAVAIASGMASKGAKPVYTVVSTFLQRTYDQLSQDLCINNNPATIVVYYAGAIGMTDVTHLGWFDIAMMGNIPNLVYLAPTTKEEHLAMLEWSIEQQEHPVAIRIPGGKMVSSGKKVTKDFSKLNTYEVSQKGKKVVIIGLGTFYQLGEKAAKLYEEKTGVKATVINPMYITGVDEKLLEELKKDHSLVITLEDGVLDGGFGEKITRFYGNSDMKVLNYGLKKEFLDRYDIGKLLTKNRLKADLIVEDLLKF

SEQ ID NO: 20348 - protein, 276 aa, Fusobacterium nucleatum subsp. vincentii ATCC 49256
MKNVKLLNGVEMPILGFGVYQIPDLEECERVVSEAIGVGYRLIDTAQIYRNEKAVGNAIKKSGVDRKEFFITTKVWITNSGYEKAKTSIEESLKKLQTDYIDLLLIHQPFGDYYGTYRAMEEYYKAGKLRAIGVSNFYPDRFIDIAHFFEIKPMVNQVETHVFNQQIIPQGIMKEYGTQIESWGPFAEGKNNLFTNETLVEVGKKYNKTAAQVALRYLIQRDVVVIPKTVRKERMIQNFDIFNFELSETDMKEILKLDKKESLFLSHYETLKQLTI

SEQ ID NO: 20349 - protein, 340 aa, Fusobacterium nucleatum subsp. vincentii ATCC 49256
MDNEEHDDLLEDETEDKLDDTDEENDETEEHFTEFDDEFNPEYIEDVSEDELSNEKLLNLGNSAKVDEPIKMYLREIGQVPLLTHDEEIEYAKKAYEGDEEASKKLIESNLRLVVSIAKKHTNRGLKLLDLIQEGNIGLMKAVEKFEYTKGYKFSTYATWWIRQAITRAIADQGRTIRIPVHMIETINKIKKESRIYLQETGKDASPEILAERLGMEVDKIKAIQEMNQEPISLETPVGSEEDSELGDFVEDQKTTSPYEATNRAILREELDAVLKTLSPREEKVLRYRYGLDDSSPKTLEEVGKIFNVTRERIRQIEVKALRKLRHPSRKKKLEDFKVD

SEQ ID NO: 20350 - protein, 231 aa, Fusobacterium nucleatum subsp. vincentii ATCC 49256
MIKMKKILILGSTGSIGTNALELIRNNREQYQVVGISGNKNIELLKKQIEEFKPTFIYVGTEQDALNLKKEYSFLKEVYFGESGLAELSKNSDYDIILTAVSGAIGIDATVEAIKREKRIALANKETMVSAGTYINKLLKEYPKAEIVPVDSEHSALFQSLQGFKKENVKKLIITASGGTFRGKDLAYLDNVTVEQALKHPNWSMGKKITIDSSTLINKGLEVIEAMSYLV

SEQ ID NO: 20351 - protein, 601 aa, Fusobacterium nucleatum subsp. vincentii ATCC 49256
MNEELTKKCEEIRKKLIEVVSKNGGHLGSNLGVVELTVCLDEVFDFKEDIVLFDVGHQAYVYKILTDRAEKFDTIRTRKGLSPFLDPNESKYDHFVSGHAGTALPAAVGFAIANPDKKVIAVVGDASLSNGHSLEALNYIGYKKLENILVIVNDNEMSIGENVGFISKFLKRVITSGKYLNFREDVKSFINRVKADRVKKTLERLERSIKGYVTPFYALESLGFRFFNVCEGNNIEKLLPMLKKIKDLKGPIVLLVKTEKGKGYCFAEENKEKFHGIAPFDIKTGNTHKSSVSYSEVFGNKILELGKEDKDIYTLSAAMIKGTGLHKFLEEFPERCIDTGIAEGFAVTLAGGLAKSRKKPYVCIYSTFIQRAVSQLIHDISLQNLPVRFIIDRSGIVGEDGKTHNGIYDLSFFLSIQNFTVLCPTTSKELEQALDISKNFNLGPLVIRIPRDSIFDIEDEKPLEIGRWKEIKKGSKNLFIATGTMLKIILEIYDELKNRGIDCTIVSAASVKPLDENYLLNYIKGYDNIFVLEENYVRNSFGTSILEFLNDNGIQKKIIHRIALKSAIIPHGKREELLKEEKLKGESLIERIEELIYGRKK

SEQ ID NO: 20352 - protein, 488 aa, Fusobacterium nucleatum subsp. vincentii ATCC 49256
MMNGKIVKEGITFDDVLLIPAKSDVLPNEVSLKTRLTKKITLNLPILSAAMDTVTESDLAIALARQGGMGFIHKNMSIEEQAAEVDRVKRSESGMITNPITLNKDSRVYQAEELMSRYKISGLPVIEDDGKLIGIITNRDIKYRKDLDQPVGDIMTSKGLITAPVGTTLEQAKEILLANRIEKLPITDQNGYLKGLITIKDIDNIIQYPNACKDKLGKLRCGAAVGIAPDTIERVSALVKAGVDIITVDSAHGHSQGVINMIKEIKKNFPDLDVIGGNIVTAEAAKELIEAGVSAVKVGIGPGSICTTRVVAGVGVPQLTAVNDVYEYCKDKNIGVIADGGIKLSGDIVKALAAGGDCVMLGGLLAGTKEAPGEEIILEGRRFKIYVGMGSIAAMKRGSKDRYFQAEEKDNSKLVPEGIEGRIAYKGSVKDVIFQLAGGIRAGMGYCGTKTIKDLQINGKFVKITGAGLIESHPHDITITKEAPNYSK

SEQ ID NO: 20353 - protein, 673 aa, Fusobacterium nucleatum subsp. vincentii ATCC 49256
MDLLTQVMYLGIAVGILSLLAAFYYAKKVEHYQINIPKVQEITAAIREGAMAFLTAEYKILVVFVIVVAVALGIFISVPTAGAFVLGAITSAIAGNAGMRIATKANGRTAIAAKEGGLAKALNVAFSGGAVMGLTVVGLGMFMLSLILLVSRTVGISVNDVTGFGMGASSIALFARVGGGIYTKAADVGADLVGKVEAGIPEDDPRNPATIADNVGDNVGDVAGMGADLFESYVGSIIATITLAFLLPVDDATPYVAAPLLISAFGIISSIIATLTVKTDDGSKVHSKLEMGTRIAGILTIIASFGIIKYLDLDMGIFYAIVAGLVAGLVIAYFTGVYTDTGRRAVNRVSDAAGTGAATAIIEGLAIGMESTVAPLIVIAIAIIVSFKTGGLYGISIAAVGMLATTGMVVAVDAYGPVADNAGGIAEMSELPAEVRETTDKLDAVGNSTAAVGKGFAIGSAALTALSLFAAYKEAVDKLTSEPLIIDVTDPEVIAGLFIGGMLTFLFSALTMTAVGKAAIEMVEEVRRQFREFPGIMDRTQKPDYKRCVEISTHSSLKQMILPGVLAIIVPVIIGLWSVKALGGLLAGALVTGVLMAIMMANAGGAWDNGKKQIEAGYKGDKKGSDRHKAAVVGDTVGDPFKDTSGPSLNILIKLMSIVSLVLVPLFVSVMNR

SEQ ID NO: 20354 - protein, 185 aa, Fusobacterium nucleatum subsp. vincentii ATCC 49256
MLRDREAILTFVDEVEKEYGKIDILVNNAGITKDGLLMRMTEDQWDAVINVNLKGVFNMTQAVSRSMLKARKGSIITLSSVVGLHGNAGQTNYAATKGGVVAMSKTWAKEFGGRNVRANCVAPGFIQTPMTDVLSEDTIKGMLDATPLGRLGQVEDIANAVLFLASDESSFITGEVISVSGGLML

SEQ ID NO: 20355 - protein, 309 aa, Fusobacterium nucleatum subsp. vincentii ATCC 49256
MSKKSTRQAYGEALVELGRINNDIVVLDADLSKSTKTDLFKKEFPKRHLNIGIAEADLMGTAAGFATCGKIPFASTFAMFAAGRAFEQIRNTIAYPKLNVKIAPTHAGISVGEDGGSHQSIEDIALMRAIPGMVVLCPCDAVETKKMVFAAAEYNGPVYLRLGRLDVETVLDDNYDFQIGIANTLRDGSDVTIVSTGLLTQEALKAADELAKENISVRVINCGTIKPLDGETILKAAQETKFIITAEEHSVIGGLGSAVSEFLSETHPTLIKKLGVYDKFGQSGKGTEMLEKYELTAAKLISMVKENLK

SEQ ID NO: 20356 - protein, 574 aa, Fusobacterium nucleatum subsp. vincentii ATCC 49256
MAFMKIKGIPASPGIAIGKAFLYKENKLEIVEKSNLSKEEEIERLVKGREIAKKQLEEIKENTLKKLGKDKADIFEGHITLLEDEELFSEIDSKISQKKCTAEFALNEAIDEYATMLANLEDTYFKERAGDLRDIGKRWLYGVMNEQIVDLSKLKPETIIVAKELNPSDTAQINLDNVLAFVTEIGGKTAHSSIMARSLELPAVVGVGEVLDKLEDNQILIVDALKGEVIVSPDVETLQIYKEKREKFLKEKEELKALKDKEAISKDGIKVDVWGNIGSPNDVKGIISNGGFGVGLYRTEFLFMEKDSFPSEDEQFEAYKIVAEELKAYPVTIRTMDIGGDKSLPYMELPKEDNPFLGWRAIRVCLDREEILRTQFKALLRASKYGQIKIMLPMIMDIVEVRKARAILEECKKELQEKGIDFDKNIMLGIMVETPAVAFRAKYFAKECDFFSIGTNDLTQYTLAVDRGNEKIANLYDTYNPGVLQAIKMLIDGAHEGGIKISMCGEFAGDENAVALLFGMGLDAFSMSGISIPRVKRIIMKLDRKECENLVEKVLTLSTASEIKEEVKKFMKKI

SEQ ID NO: 20357 - protein, 434 aa, Fusobacterium nucleatum subsp. vincentii ATCC 49256
MTGIVDVIGREILDSRGNPTVEVDVILECGVKGRAAVPSGASTGSHEAVELRDEDKTRYLGKGVLKAVNNVNTEIREALLGMDALNQVEIDRVMLELDGTANKGRLGANAILGVSLAVSKAAAEALGLPLYKYLGGVNAKELPLPMMNILNGGAHADSAVDLQEFMIQPVGAKSFREAMQMGAEVFHHLGKILKANGDSTNVGNEGGYAPSKIQGTEGALSLISEAVKAAGYELGKDITFALDAASSEFCEKVNGEYQYHFKREGGIIRNTDAMIKWYEELINKYPIVSIEDGLGEDDWDGWVKLTKAIGDRVQIVGDDLFVTNTERLKKGIELGAGNSILIKLNQIGSLTETLDAIEMAKRAGYTAVVSHRSGETEDATIADVAVATNAGQIKTGSTSRTDRMAKYNQLLRIEEELGSVAQYKGRDVFYNIKK

SEQ ID NO: 20358 - protein, 236 aa, Fusobacterium nucleatum subsp. vincentii ATCC 49256
MSGKGGVGKSTVTTLLAKELRKKGYAVGVLDADITGPSIPRLMGVSEQKMTTDGKNMYPVVTKDGIEIVSINLMIDENEPVVWRGPVIAGAVIQFWNEVVWGDLDYLLIDMPPGTGDVPLTVMKSFNIKGLIMVSVPQDMVSMIVTKAIKMARKLNMNIIGLIENMSYITCDCCNNKIYLTDENDTQTFLKENDVELLGELPMTKQIAKLTKGENEYPEEIFSKIADRVIEKVKEL

SEQ ID NO: 20359 - protein, 401 aa, Fusobacterium nucleatum subsp. vincentii ATCC 49256
MKNILLGVTGGIAAFKSASIVSLLKKKGYNVKVVMTKNATNIIGPLTLETLSRNRIYVDMWDTNPHYEVEHISLADWADMVLIAPATYNIIGKVANGIADDMLTTIISAVSIRKPVFFALAMNVNMYENPILKENINKLKSYGYRFIEAEEGLLACNYVAKGRMSEPEDIVAEIERYSIYSKIENYHTVLKGKKILITSGRTKENIDPIRYLSNNSSGKMGYSLAQAAVDLGAEVTLISGPTNLGIPKRLRNFISVESALEMYEKVDEYFEDIDIFIACAAIADYRPKEYKKEKIKKSDSDLILELVRNPDILFEMGKKKDKQLLVGFAAETNDIKENALKKLEKKNLDIIVANNASTMGTDSNTVEIIKKDKSSVEIKQKNKMELAYDILSEVISVLKKG

SEQ ID NO: 20360 - protein, 320 aa, Fusobacterium nucleatum subsp. vincentii ATCC 49256
MKKIMFEIEKELKERILVLDGAMGTVLQKYELPAEDFNGTKGCYEILNETRPDIIFEVHKKYIEAGADIIETNSFNCNAISLKNYHLEDKVYDLAKKSAEIAKDAVRKSEKKVYVFGSVGPTNKGLSFPEKDVSCKRAVSFDEMKEVIKVQVAGLIDGGVDGILLETIFDGLTAKAALLAIEEVFAEKDTKLPISISATVNKQGKLLTGQSIESLMVDLDRDSVISFGFNCSFGAKDLVPFVLKIKELTAKFISLHANAGLPNQNGEYEETAQKMRDDLLPLIENQAINILGGCCGTDYEHIKLIAELIKGQKPRVLLEK

SEQ ID NO: 20361 - protein, 346 aa, Fusobacterium nucleatum subsp. vincentii ATCC 49256
MKRELALEFARVTEAAALAAYKWVGRGKKESADQAGVDAMRTMLNRLAIDGEIVIGEGEIDEAPMLYIGEKVGQIYNEEEKDSVTYVDPVDIAVDPVEGTRMTAQGQPNAITVLAVGKKGSFLKAPDMYMEKLIVGPEAKGKIDLSKPLEDNIHAVAKALNKELKDLMIVVLDKPRHKELIKDLQAMGIKVYALPDGDVAGSILTCMIDSDVDMLYGVGGAPEGVISAAVIRALGGDMQARLKLRSEVKGATLENDKISKFEKLRCEEQGLKVGEILKLDDLAKDDEIIFSATGITGGDLLEGVKRKGNIARTQTLVVRGLSKTIRYINSIHNLDFKDEKITHLVK

SEQ ID NO: 20362 - protein, 424 aa, Homo sapiens
MGCGTSKVLPEPPKDVQLDLVKKVEPFSGTKSDVYKHFITEVDSVGPVKAGFPAASQYAHPCPGPPTAGHTEPPSEPPRRARVAKYRAKFDPRVTAKYDIKALIGRGSFSRVVRVEHRATRQPYAIKMIETKYREGREVCESELRVLRRVRHANIIQLVEVFETQERVYMVMELATGGELFDRIIAKGSFTERDATRVLQMVLDGVRYLHALGITHRDLKPENLLYYHPGTDSKIIITDFGLASARKKGDDCLMKTTCGTPEYIAPEVLVRKPYTNSVDMWALGVIAYILLSGTMPFEDDNRTRLYRQILRGKYSYSGEPWPSVSNLAKDFIDRLLTVDPGARMTALQALRHPWVVSMAASSSMKNLHRSISQNLLKRASSRCQSTKSAQSTRSSRSTRSNKSRRVRERELRELNLRYQQQYNG

SEQ ID NO: 20363 - protein, 429 aa, Methylobacterium extorquens
MTAITNIAAREILDSRGNPTVEVDVLLEDGSFGRAAVPSGASTGAHEAVELRDGDKSRYNGKGVLKAVDAVQSEILDAIGGMDAEDQVAVDEAMIALDGTPNKARLGANAILGVSLAVAKAAAETAGLPLYRYVGGVQGRVLPVPMMNIVNGGAHADNPIDFQEFMVMPVGATSLSDAVRMGAEIFHTLKSALKKAGHNTNVGDEGGFAPNLPSAEAALDFVMESINAAGFKPGSDVVLALDCAATEFFKDGAYRYEGEGQTRSIEQQVDYLAKLTEAYPILSIEDGMSEDDWEGWKLLTDRIGSRVQLVGDDLFVTNVERLARGIETGTANSILVKVNQIGSLTETLAAVDMAQRAGYTAVMSHRSGETEDSTIADLAVATNCGQIKTGSLARSDRLAKYNQLIRIEEGLGAQALYAGRSAIRQLAGR

SEQ ID NO: 20364 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 20365 - protein, 315 aa, Hordeum vulgare subsp. spontaneum
MATAGKVIKCKAAVAWEAGKPLSIEEVEVAPPQAMEVGVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 20366 - protein, 315 aa, Hordeum vulgare subsp. spontaneum
MATAGKVIKCKAAVAWEAGKPLSVEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 20367 - protein, 315 aa, Hordeum vulgare subsp. spontaneum
MATAGKVIKCKAAVAWEAGKPLSIEEVQVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 20368 - protein, 235 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVCKTKKGFHGGHFRSWSCRTGCHGRGQDGWGIKDHWCGFEPCKIRTS

SEQ ID NO: 20369 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQVKKFGCTDFVNPKDHTKPVQEVLVEMINGGVDRAVECTGHIDAMIAAFECVHDGWGVAVLVGVPHKEAVFKTHPMNFLNEK

SEQ ID NO: 20370 - protein, 315 aa, Hordeum vulgare subsp. spontaneum
MATAGKVIKCKAAVAWEAGKPLSVEEVEVAPPQAMEVRVKILYTALCHTDVYFWEAKGQTPVFPRILGHEAGGIVESVGEGVTELVPGDHVLPVFTGECKDCAHCKSKESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 20371 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEMLVDMTNGGVDRAVECTGHIDAMIAAFECVHDGWGVAVLVGVPHKEAVFKTHPMNFLNEK

SEQ ID NO: 20372 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEASLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 20373 - protein, 287 aa, Buchnera aphidicola str. Bp (Baizongia pistaciae)
MIKVETKTLPAISLGNLDSYIREANSWPMLSSQEEKYLSEKLFYHGDLNAAKTLILSHLRFVIHVSRNYSGYGLLQADLIQEGNIGLMKAVRRFNPKIGVRLVSFAVHWIKSEIHEYVLRNWRIVKVATTKSQRKLFFNLRKTKQRLGWFNDHELELVAQELGVKREDVREMESRMSAQDIALHHVPDNFREEQNFSYTIPYLKDSLSDFANHVEEDNWEAHKTNKLSNALSSLDERSRNIIHARWLDDSDHKMTLREIAHNYGISAERVRQLEKNAMKKLKVAIET

SEQ ID NO: 20374 - protein, 254 aa, Buchnera aphidicola str. Bp (Baizongia pistaciae)
MIMSSKEVEIIWHQIISEVEILMDQEPELAGFYHAYILQHDSFDMALSYILSNQLSNKVMSTVFVRDIINKVYIACRKIVAYAIQDIKALFNHGLVHCYSFSLLHSKGFHALQAYRISNFLWCEEKKSLALYFQNRISCLFSVDIHPASMIGSGIVLDNAIGITIGQTSAIKDSVSVLSQSLALLGSAFKISSVQCPKINEGVIIGANVAILGNVVIGEKTKIQACTVVLQSVPPNSIVTSVLAKIVSFKNINE

SEQ ID NO: 20375 - protein, 609 aa, Buchnera aphidicola str. Bp (Baizongia pistaciae)
MEQNPQSQLKLLVTYGKEQGYLTYSEINDHLSDNIINSDQIEDIIQMINDMGIQVVEKAPDSDDLILHEIKRNNETDEDIVEATAQVLSTVESELGRTTDPVRMYMREMGTVELLTREGEIDIAKRIEDGINQVQCSVAEYPEAITHLLEQYNRVELGELRLSELIHGFVDPNAEAVHTSITNHINTNSEEHHHNDNTEENNDDDHLVDPELAREKFIALKNQYHITNYAIKTKNRNHQDTLIEINNLSEIFKQFRLVPKQFDHLVINMRKMMQKIRIQERNIAKLCIEYGNIPKKALLNFFSLQKTNQIWSKIVQNIKKPWIDKFNTIKPDIQMILKKLQKVEEETGLTIHQVKNINKRISLGEAKAKRAKKEMVEANLRLVISIAKKYTNRGLQFLDLIQEGNIGLMKAVDKFEYRRGYKFSTYATWWIRQAITRSIADQARTIRIPVHMIETINKLNRISRQILQEIGREPTPEELSERMLIPEDKIRKVLKIAKEPISMETPIGEDDDSHLGDFLEDTNIELPLDSATSASLRSATKNVLSGLTTREAKVLRMRFGIDMNTDHTLEEVGKQFDVTRERIRQIEAKALRKLRHPSRSEILRSFLDD

SEQ ID NO: 20376 - protein, 576 aa, Buchnera aphidicola str. Bp (Baizongia pistaciae)
MISGILASPGITFGKALLLKNEILSINYKKISNQDIHQEVKKFINGKNKTICQLQEIKNKTQQKFENTQSNIFEGHIMLLEDDEFQQKIISLIQDRNISSEYATKIIIEEHAKTLEQLNDEYLKNRAIDIQDIGNRLLKNILNIDIKDLNNIKNPVILIARDLTPSETAQINLKKVLGFITDLGGQTSHTSIIARSLELPAIVGTKNITEKAKNDDFIILDSINNKISINPSLEEIHRIKQKKKKYESEKKLLIESKNLYAITKDKHKVEIGANISTIQDINNAKKYGAECIGLYRTEFLFMNRNYLPSEEEQFNTYKTIAEEMKNKSIIIRTMDVGGDKNISYMNIPKEENPFLGWRAIRIAIDRKEILHAQLKAILRASAFGKLRIMFPMIISVEEVRTLQYELEKLKQLLHHQKIPFNAKIEVGIMIETPASAIIAHHLAQEVDFFSIGSNDLTQYTLAVDRGNDLISHLYNPMSPSVLSLIQQVINASHKVGKWTGMCGELAGDEKATLLLLGMGLDEFSMSAATIPKIKKIIRESTFLDVKKLAKKVLLQPTYNEVNNTINTFININNKNK

SEQ ID NO: 20377 - protein, 351 aa, Buchnera aphidicola str. Bp (Baizongia pistaciae)
MRIEEDIKLGFKDVLIRPKRSILKSRSQVDLTRLFIFKHAQNKWSGIPLIAANMDTVGTFKMAIALSSFGILTAIHKYYSYLDWKKFIHTIPGTVVKHIMVSTGMLDEDFVKLKQILSLSSKLKYICIDVANGYSEKFVTFLKKVRECYCDKIICAGNVVTGEMVEELILSGADIVKVGIGPGSVCTTRAKTAIGYPQLSAVIECSDAAHGLGGQIISDGGCVVSGDIAKAFGGGADFVMLGGMLAGHKECEGLIFKENKKRYMIFYGMSSKFAMDRHIGGVARYKTPEGKTVKVLFRGAVSETINNILGGLRSTCTYVGAFTLKELTKRTTFIKVSEQENIIFNNQEVSN

SEQ ID NO: 20378 - protein, 431 aa, Buchnera aphidicola str. Bp (Baizongia pistaciae) [sequence omitted]

SEQ ID NO: 20379 - protein, 300 aa, Toxoplasma gondii
MEKYQKLEKIGEGTYGVVYKAQDHSGEISALKKIRLEAEDEGIPSTAIREISLLKELHHPNIVRLRDVIHTDRRLTLVFEYLDQDLKKLLDVCDGGLEPSTTKSFLFQLLCGIAYCHEHRVLHRDLKPQNLLINREGALKLADFGLARAFGIPVRSYTHEVVTLWYRAPDVLMGSKTYSTPVDIWSVGCIFAEMVNGRPLFPGTGNEDQLMKIFKVLGTPQVSEHPQLAELPHWNRDFPQFPPLPWDQVVPKLDPLGTDLLSRMLRFDSNQRISARQAMQHPYFSDLADNIKRLATFRGE

SEQ ID NO: 20380 - protein, 322 aa, Sesbania rostrata
MAEKKIPEVLLNSGHKMPVIGMGTSVESRPSNDVLASIFVDAIQVGYRHFDSASVYGTEEAIGMAVSKAIEQGLIKSRDEVFITSKPWNTDAHHDLIVPALKTTLKKLGMEYVDLYLIHWPVRLRHDLENPVIFSKEDLLPFDIEGTWKAMEECYRLGLAKSIGICNYGTKKLTKLLEIATIPPAVNQVEMNPSWQQGNLREFCKQKGIHVSAWSPLGAYKIFWGSGAVMENQILQDIATAKGKTIAQVALRWVYQQGSSAMAKSFNKERMKQNLEIFDFELSEEELEKIKQIPQRRQYTGDMWLSENGSCKTLEELWDGDV

SEQ ID NO: 20381 - protein, 724 aa, Tupaia belangeri chinensis
MEGERKNNNKRWYFTREQLENSPSRRFGVDPDKELSYRQQAANLLQDMGQRLNVSQLTINTAIVYMHRFYMIQSFTQFHRTSVAPAALFLAAKVEEQPKKLEHVIKVAHTCLHPQESLPDTRSEAYLQQVQDLVILESIILQTLGFELTIDHPHTHVVKCTQLVRASKDLAQTSYFMATNSLHLTTFSLQYTPPVVACVCIHLACKWSNWEIPVSTDGKHWWEYVDATVTLELLDELTHEFLQILEKTPNRLKRIRNWRACLAARKTKADDRGADENTSEQTILNMISQSSSDTTIAGLMSMSTSSTSAVPSLPVAEESSSNLSSVEMLQGERWLSSQPPFKLEPTQGHRTSENLALIGVDHSLQQDGSNTFISQKQSSKSVPSAKVSLKEYRAKHAEELAAQKRQLENMEANVKSQYAYAAQNLLSHHDSHSSVILKMPMEGSENPERNFLEKGDKTALKMRIPVAGGDKAASSKPEEIRMRIKVHTAADKHNSVEDSVTKSREHKEKHKTHPSNHHHHNHHSHKHSHSQLPAGTGNKRPGDPKHSSQTSTVAHKTYSLSSSFSSSSSTRKRPPPEETGGAVFDHPAKIAKSTKSSINFPFPPLPTMAQLPGHSSDTSGLPFSQPSCKTRVPHGKLDKGPTGANGHNTTQTIDYQDTVNMLHSLLSAQGVQPTQPPAFEFVHSYGEYLNPRAGGISSRSGNTDKPRPPPLPSEPPPPLPPLPK

SEQ ID NO: 20382 - protein, 319 aa, Fragaria x ananassa
MAKVPSVTLSSCGDDIQTMPVIGMGTSSYPRADPETAKAAILEAIRAGYRHFDTAAAYGSEKDLGEAIAEALRLQLIKSRDELFITTKLWASFAEKDLVLPSIKASLSNLQVEYIDMYIIHWPFKLGKEVRTMPVERDLVQPLDIKSVWEAMEECKKLGLARGIGVSNFTSSMLEELLSFAEIPPAVNQLEMNPAWQLKKLRDFCKAKGIHVTAYSPLGAARTKWGDDRVLGSDIIEEIAQAKGKSTAQISLRWVYEQGVSIVTKSYNKERMRQNLDIFDFCLTEEELEKMSHLPQRKGVTFASILGPHDIVLEVDEEL

SEQ ID NO: 20383 - protein, 725 aa, Xenopus laevis
MSTRTPLPTVNERDTENHTSHGDGRQDVPTRSGRQGARARNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARAKFRQIVSAVQYCHQKHIVHRDLKAENLLLDADMNIKIADFGFSNEFTVGNKLDTFCGSPPYAAPELFQGKKYDGPEVDVWSLGVILYTLVSGSLPFDGQNLKELRERVLRGKYRIPFYMSTDCENLLKRFLVLNPSKRGTLEQIMKDRWINAGHEEDELKPFLEPELDIADQKRIDIMIGMGYSKEEIQESLSRMKFDEITATYLLFGRKSSELDASDSSSSSNLSLAKVRPNSDLNNSSGQSPHHKGRSISSSQKQRRYSDHAGPAVPAVTAYPKRSQTSTTDNDLKEEVGQSRKSSSIGRGVTPPSPMLGNANNPNKADIPDRKKSSVVPTTNSTSSGMTRRNTYVCNERAPTDRHSVIQNGKENSTIPDQRTSVASTHSITSTTTPDRMRFPRGTASRSTFHGQLRERRTATYNGPPASPSLSHEATPLSHTRSRGSTNLFSKLTSKLTRSRNVSGDQKDENKESKPRSLRFTWSMKTTSSMDPNDMMREIRKVLDANNCDYEQRERFLLFCVHGDGHAENLVQWEMEVCKLPRLSLNGVRFKRISGTSIAFKNIASKIANELKL

SEQ ID NO: 20384 - protein, 780 aa, Xenopus laevis
MLEDLAAKHRDQQDSCINPLAAHEPALGHADPKTSSSSNKPNMLRSRTSIAATADEQPHIGNYRLLKTIGKGNFAKVKLARHVLTGKEVAVKIIDKTQLNSSSLQKLFREVRIMKVLNHPNIVNLFEVIETEKTLYLVMEYASGGEVFDYLVAHGRMKEKEARAKFRQIVSAVQYCHQKLIVHRDLKAENLLLDSDMNIKIADFGFSNEFTFGYKLDTFCGSPPYAAPELFQGKKYDGPEVDVWSLGVILYTLVSGSLPFDGQNLKELRERVLRGKYRIPFYMSTDCENLLKKFLILNPSKRGTLEQIMRDRWMNVGHEEDELKPYVEPIPDYKDPKRTELMVTMGYTNEEITDSLVNQKYNEVMATYLLLGYKSSEMDNDHLTLKPRPPPGVSNNIVSSPAHKVQRSVSANPKQRRPGDQAGQAIPKSNSYSKKTQSNNAENRRSADEKESGRKSGSTVRVPPSPLSGLDRKKTTPTPSTNSVLSTGTNRSRNSPMLDRATLVPGSIHNGKDSFSMPGSRASTASAPATSARIRQHQKSMSTSVHPSKPAPSLDGNCDVQRASTAPQRLPVSSPSAHNISSAATERNNFPRGVSSRSTFHAGQVRQARDQQNLGFVSPASPSGISQGRRGATGSIFSKFTSKFVRKNPNDPEGKDRVESTRPHLSVVDKEKDKEDLRDSKPRSLRFTWSMKTTSSMEPNEMISEICKVLDANNCQYESQDKYMLLCVHGTPGHDNYVQWEMEVCKLPRLSLNGVRFKRISGTSIAFKNIASKIANDLKL

SEQ ID NO: 20385 - protein, 533 aa, Amycolatopsis mediterranei
MQMTEENLRGLFGRMTGDEKHGWAAASTLHAIWVLYERVLNVSPSNIDDPGRDRFYLSKGHGPMAYYAVLAAKGFIEPETLDTWRQWGSPLGMHPDRNLAPGVEISSGSLGHGLPLGVGTALGLRAQGRDARVVVLMGDGEFDEGSNHETMAIAGRLGLGSLTAVVIDNKTASLGWPGGIAGRFEQEGWAATTVDGRDHDALEKALTGETDGRPRAVIAEILPDRGREHRMTAQVTRKQMRTVFAETVIESLATDPRVVMLTADISSWFFWEVKKDFPDRVHNFGIREQAMIDIAGGFALAGQRPVVHTYAPFLVERPFEQIKIGLGHQDVGAVLVSVGASYDDPSWGRTHQAPGDVALLDTLPGWTVHVPGHEDEVAPLLSKAIAGDNRVYVRLSERANSEAVPVSEKFTVLRRGKAGVVLAVGPVLDQVLAATATADVTVLYASTIRPFDHAGLREAVAAAAPNVVLVDPYLRGTSAFEVTEALGDVPHRLRSFGTWRDREARVYGTPEEHDRLFGVDAESLADSIARFVG

SEQ ID NO: 20386 - protein, 317 aa, Mus musculus
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVGASEATLLNMLNISPFSFGLIIQQVFDNGSIYNPEVLDITEQALHSRFLEGVRNVASVCLQIGYPTVASVPHSIINGYKRVLALSVETEYTFPLAEKVKAFLADPSAFAAAAPAAAATTAAPAAAAAPAKAEAKEESEESDEDMGFGLFD

SEQ ID NO: 20387 - protein, 246 aa, Xenopus laevis
MDRTAQIQKAKLAEQAERYDDMAASMKDVTECGGELSSEERNLLSVAYKNVVGARRSAWRVISSIEQKSDSEETKLKIAKEYKEKVESELQSICETVLNLLDKHLISASTATESQVFYLKMKGDYYRYLAEVATGENRTKTIADSQAAYQQAFDISKKDMQPTHPIRLGLALNFSVFYYEILNSPEKACALAKTAFDEAIAELDTLNEESYKDSTLIMQLLRDNLTLWTSDTACDDNDAVEPGENN

SEQ ID NO: 20388 - protein, 337 aa, Xenopus laevis
MIEQNKRKGMELVPVQAKKPRNELVVSGPPRSSSIQAPIMLLSGHEGEVYCCKFHPNGVTLSSAGFDRLILLWNVYGDCDNYATLKGHSGAVMELHYNTDGSLLFSASTDKTVAIWDCQTGERVKRLKGHTSYVNSCYPARRGPQLICTGSDDGTVKLWDFRKKAAVQTFQNTYQVLSVTFNDTSDQIISGGIDNDIKVWDLRQNKLMYTMRGHGDSVTGLSLSSEGSYLLSNAMDNTVRVWDVRPFAPKERCVKIFQGNVHNFEKNLLRCSWSADGSKIAAGSADRFVYVWDTTSRRILYKLPGHAGSVNEVAFHPEESIILSASNDKRLYMGEIQ

SEQ ID NO: 20389 - protein, 376 aa, Ralstonia solanacearum
MPRQKAATSANPTDETIGAVDGPNAPNGRGGRRARSAASAASDDIEVVDALTDEMPASEPADIVDTPDTNDSADEPDEEEEDEEAAPEEDFRTVLQAELAADTVQHYLNRISIKPLLTPAEELHFSTRAKAGEFAARQVMIERNLRLVVSIAKGYLNRGVPLLDLIEEGNLGLMHAIEKFDPERGFRFSTYATWWIRQSIERAIMNQARTVRLPVHVIRELNQVLRAKRHLEKSGIDGRDASIEDIAHLLGKTTEEVQDVLSLNEHTTSLDTPFDLDPGTSLLDFLSDEHGASPDQEVAHRELSQLMKSWLARLSDKHRYVVERRFGLNHIEPATLEELAAEMGLTRERVRQIQQEALVKLKRHFASQGVRKDAVL

SEQ ID NO: 20390 - protein, 483 aa, Hordeum vulgare subsp. vulgare
  unsure (1)..(483): unsure at all Xaa locations
MERYNIITEVGDGTFGSVWRAINKESGEVVAIKKMKKKYFSWEECINLREVKSLRRMNHPNIVKLKEVIRENDMLFFVFEYMECNLYQLMKSKGKPFSETEIRNWCFQVFQALSHMHQRGYFHRDLKPENLLVTKELIKVADFGLAREIISEPPYTEYVSTRWYRAPEVLLQSSVYSSAVDMWAMGAIIAELFSHRPLFPGSSEADEIYKICNILGTPNQHTWAGGLQLAASIHFQFPQSGSINLSEVVPTASEDALNLISWLCSWDPRKRPTAVEVLQHPFFQPCFYVPPSLRYRSTGYATPPPSVGAKGAMDQKNARRYPVGTLSNGRPAVNNSYLSTNAPARAAGVQRKLELDHQVKPEGNHKLTTKENAMNQPWSRLPPAPVRNNMNYLAAXEQIPRGGAPDIAEKLSQLSMSSTTNRAPIMPSDRFVDLKATTRAHGEPVRRPVPLGPRDTWHARNDPFRRTYEMPGERALLQRKLVS

SEQ ID NO: 20391 - protein, 519 aa, Ceriporiopsis subvermispora
MARFQTLSAAVALGLSLGAFAAIGPVTDLEITDAFVSPDGPGLGREAVLAGGTFPGPLIQGNKGDNFQINVVNNLTNHTMLKTTSIHWHGLFQHGTTWADGPAFVSQCPIASGNSFLYNFNVPDQAGTFWYHSHLATQYCDGLRGPLVVYDPNDPHADLYDVDDESTVITLSDWYHAAASTLTFPTFDTTLINGLGRFAGTGGSDSNLTVITVEQGKRYRFRLVSISCDPNWVFSIDQHELTVIEVDGVNAVPLTVDAIQIFAAQRYSFVLNANQTVDNYWIRANPNNGNMGFANGINSAILRYVGADDVEPTSTGTTANLLNEADLSPLVPAAAPGAPNQDFDAVDVPMNLNFTFNGTNLFINGATFVPPSVPVLTQILSGAMTAQELLPAGSVYTLPRNATVQLSLPGNIIAGPHPFHLHGHTFSVIRSAGQSDYNYVDPIQRDVVSIGGATDNVTIRFTTDNPGPWFFHCHIDWHLQAGFAIVFAEETADVASANPVPADWSALCPTYDALSDADH

SEQ ID NO: 20392 - protein, 187 aa, Equus caballus
MGGNSGQPGVPTYKSLAEDGPFGSVELPKRSTGRLVMHSMAMFGREFCYAVEAAYVTPVLLSVGLPKRLYSVVWLLSPVLGFLLQPVVGSASDHCRARWGRRRPYILALSVIMLLGMALYLNGDAVISALIADRRKKLTWAITITMIGVVLFDFAADFIDGPIKAYLFDVCSHQDKERGLHHHALFT

SEQ ID NO: 20393 - protein, 334 aa, Candida glabrata
MSTEVISTSVVSEPTQEILPAEYSLDAPEPEHCPGPESEMAGKADACQTCENKDICESLPKGPDPDIPLITENLSGIKHKILVLSGKGGVGKSTFTTMLSWALSADDNLQVGAMDLDICGPSLPHMLGCTDEVVHESNTGWTPVYVAENLAAMSIQFMLPEDDSAVIWRGNKKNLLIKKFLKDVVWDDLDYLVVDTPPGTSDEHISINKYMKESGIDGALVVTTPQEVALLDVRKEIDFCRKAGINILGLVENMSGFVCPNCKGESQIFKPTTGGGEALCKELGIKFLGSVPLDPRIGRCSDEGESFLDEFPDSPATLAVLNVVEELRDAVGDV

SEQ ID NO: 20394 - protein, 540 aa, Hordeum brevisubulatum
MGWGLGDPPADYGSIMAVGLFVALMCICIIVGHLLEENRWMNESTTALLLGLGAGTVILFASSGKNSRLMVFSEDLFFIYLLPPIIFNAGFQVKKKQFFRNFMTITLFAVVGTLISFSIISLGAMGLISRLNIGALELGDYLALGAIFSATDSVCTLQVLSQDETPFLYSLVFGEGVVNDATSVVLFNAIQNFDLGNFSSLKFLQFIGNFLYLFGASTFLGVASGLLSAYVIKKLYFGRHSTDREVAIMMLMAYLSYMLAELLDLSGILTVFFCGIVMSHYTWHNVTESSRVTTKHAFATLSFISETFLFLYVGMDALDIEKWKIVSETYSPMKSITLSSIILALVLVARAAFVFPLSYLSNLTKKTAGEKISIRQQVIIWWAGLMRGAVSIALAYNKFAKSGHTQLPSNAIMITSTIIIVLFSTIVFGLLTKPLIRLLIPARHLTREVSALSEPSSPKSFLEQLTVNGPETDVENGVSIRRPTSLRMLLASPTRSVHHYWRKFDNAFMRPVFGGRGFVPFVPGSPTESSVPLLAHGSEN

SEQ ID NO: 20395 - protein, 366 aa, Drosophila melanogaster
MSVSITKKFYKLDINRTEWEIPDIYQGLQPVGSGAYGQVSKAVVRGTNMHVAIKKLARPFQSAVHAKRTYRELRLLKHMAHENVIGLLDIFHPHPANGSLENFQQVYLVTHLMDADLNNIIRMQHLSDDHVQFLVYQILRGLKYIHSAGVIHRDLKPSNIAVNEDCELRILDFGLARPTENEMTGYVATRWYRAPEIMLNWMHYDQTVDIWSVGCIMAELITRRTLFPGTDHIHQLNLIMEMLGTPPAEFLKKISSESARSYIQSLPPMKGRSFKNVFKNANPLAIDLLEKMLELDAEKRITAEEALSHPYLEKYAEPSVEQTSPPYDHSFEDMDLPVDKWKELIYKEVTNFKPPPSYAQVLKDVK

SEQ ID NO: 20396 - protein, 316 aa, Hordeum vulgare
MEGLQRSSSTFRRKKRPRRSRDGPNSVSETIKQWKEVKQQLEHDPQGAKRARKPPAKGSKKGCMQGKGGPENTQCGFRGVRQRTWGKWVAEIRESNRVSRLWLGTFPTAEVAAQAYDEAAKAMYGPLARTNFPVQDAQAAPTVVVQVATEGVVRGSSASCESTTTSNHSDVASSSHNKQLQIQAPEISSQSDLLESTQSVEYIQQQSVPDAVSSIAMSTSEEDVYEPLEPISNLPDGEAHCAISRCFGPRTWPETWTRRRRGCPAASSTPSSGVPAPALAPQRAEAVPSPRGGNGRRCRGSDRAMVDVMRAVFILE

SEQ ID NO: 20397 - protein, 372 aa, Hordeum vulgare
MTVDRKGAQAAAAAAATSAPFEIPALQPGRKKRPRRSRDGPNSVSETIKRWKEVNQQLEHDPQGAKRARKPPAKGSKKGCMQGKGGPENTQCGFRGVRQRTWGKWVAEIREPNRVSRLWLGTFPTAEVAAQAYDEAARAMYGPLARTNFPVQDAQAAPAVAVPVATEGVVRGSSASCESTTTSNHSDVASSSHNKQRQIQAPEISSRSDLLESTQSVEYSQQQSVPDAVSSIAMSTSEEDVYEPLEPISNLPDGEADCFDIEELLKLMEADPVEVDPVTVGSWNEFQDAGANARGSWNEFQCARANTGVSWNANAGMEMGQQEPLYLDGLDQGMLEGMLHSDYPFPVWISEDRPMHNPAFHDAEMSEFFEGL

SEQ ID NO: 20398 - protein, 132 aa, Leishmania mexicana
MATPRSAKKASRKSGSKSAKCGLIFPVGRVGGMMRRGQYARRVGASGAVYMTAVLEYLTAELLELSVKAAAQSGKKRCRLIPRTVMLAARHDDDISSLLKNVTLSHSGVVPSVSKAMSKKKGGKKLKATPSA

SEQ ID NO: 20399 - protein, 458 aa, Giardia intestinalis
MTLSEDTLRAVEATAGLIAAQGIEFTRAFYERMLTKNEELKNIFNLAHQRTLRQPKALLDSLVAYALNIRRINELYELKGKGLPVPPEHWAELQGFFSAAERVANKHTSFGIQPAQYQIVGAHLLATIEDRITKDKDILAEWAKAYQFLADLFIKREEEIYAATEGCKGGWRQTRTFRVEEKTRVNEIICKFRLVPAEEGAGVVEHRPGQYLAIFVRSPEHFQHQQIRQYSIISAPNSAYYEIAVHRDEKGTVSRYLHDYVSTGDLLEVAPPYGDFFLRYLEADEQAPADTQASQEFQMLQSGAINFAAEKTMPIVLISGGIGQTPLLSMLRFLAQKEGKETARPIFWIHAAHNSRVRAFKEEVDAIRETALPSLRVVTFLSEVRATDREGEDYDFAGRINLDRISELTKLEADNANPHYFFVGPTGFMTAVEEQLKTKSVPNSRIHFEMFGPFKASH

SEQ ID NO: 20400 - protein, 185 aa, Anemone nemorosa
NGIIKKARELNVLCDAQISLVVISSNGKISEFNSKPLEKTLERYQNASGKKLWDAKHDYLSKEVDRIKKENDCMQIELRHLKGEDLTSLQARDLIPIEEALLNGLRKVKDKQIEFWENKKQRIMKLEEDHKVLSYTSQKQEQQMEMNGNVRDLGNVYHQNGGEYPSQMPFTFRVQPIQPNLQENI

SEQ ID NO: 20401 - protein, 185 aa, Anemone nemorosa
NGIIKKARELNVLCDAQISLVVISSNGKISEFNSKPLEKTLERYQNASGKKLWDAKHDYLSKEMDRIKKENDCMQIELRHLKGEDLTSQQARDLIPIEEALLNGLRKVKDKQIEFWESKKQRIMKLEEDHKVLSYTSQKQEQQMEMNGNVRDLENGYHQNGGEYPSQMPFTFRVQPIQPNLQENK

SEQ ID NO: 20402 - protein, 184 aa, Anemone nemorosa
QGILKKAKEITVLCEAKVSLVIFSNTNKMFEYNSDPVQDILAKYQTTSGKKLWDAKHEYLSKEVDRIKKENDSMQIELRHLKGEDLTSLQPRELIPIEEALLDGLIKVRDKKMDFVMRKQIEMKKMEEENEQLNWTVNQQEIKMNGNSRSMQVNGFHQNGADYPSEVPFTFRLHSTKPNSQEKK

SEQ ID NO: 20403 - protein, 203 aa, Akebia quinata
VGIIKKARELSVLCDAQVSLIMFSATEKLSEYISPTVTTKKVFDRYQQTAGINLWSTHYERMQENLNKQKEINRRLRKEIRQRMGEDLNELSIDVLRGLEQNMEHSLNIVRERKLKVIRTQSGTYRKKVTNLEQVHKKLMRELEGRNEDPHYVFANHNGDGDYQSALELANNGGSHIFALRLQPSQPILREGGGYGSHDLRLA

SEQ ID NO: 20404 - protein, 187 aa, Akebia quinata
NGIMKKAKEITILCDAQVSLVIFSSSGKMSDYCSPSTTLTKVLDRYQKTSGKRLWDAKHEYLSTEVDRVKKENDCMQIELRHLKGEDITSLNPKELIPIEEALENGLVNVRAKQMEYLKMLKKNERYLEEENKHLRCILHHQQIEIEGNMRMEMENGYNTQKGRDYPSQMPFAFRAQPIQPNLQENK

SEQ ID NO: 20405 - protein, 187 aa, Akebia quinata
NGIMKKAKEITILCDAQVSLVIFSSTGKMCDYCSPSTTLTKVLDRYQKTSGKRLWDAKHEYLSTEVDRIKKENDCMQIELRHLKGEDITSLNPKELIPIEEALENGLVNVRAKQMEYLKMLKKNERYLEEENKHLRCILHHQQIEIEGNMRMEMENGYNTQKGRDYPSQMPFAFRAQPIQPNLQENK

SEQ ID NO: 20406 - protein, 200 aa, Akebia quinata
AGIMKKAQELTVLCDAEVSLIMFSNTGKFTEYISPSVTTKQIFDQYQKVSGINIWQPHYERMQDNLNKQKEINNKLRREIRQRIGEDLDDLTIHELRGLEQNMESSLKTVRDRKFQVISTRTETHKKKFKNMEQTHAKLLREFEGRNDEPHFAMAGHEGEYESVLGLGNGGSHVFAFRLQQSQPNLQSGGEFGMNDLRLA

SEQ ID NO: 20407 - protein, 200 aa, Akebia quinata
AGIMKKAQELTVLCDAEVSLIMFSNTGKFTEYISPSVTTKQIFDQYQKVSGINIWQPHYERMQDNLNKQKEINNKLRREIRQRIGEDLNDLTIHELRGLEQNMESSLKTVRDRKFQVISTRTETHKKKFKNMQETHAKLLREFEGRDDEPHFAMAGHEGEYESVLGLGNGGSHVFAFRLQQNQPNLQSGGEFGMNDLRLA

SEQ ID NO: 20408 - protein, 203 aa, Akebia quinata
AGIIKKARELSVLCDAQVSLIMFSGTEKLSEYISPTVTTKKVFDRYQQTAGINLWSTHYERLQENLNKQKEINRRLRKEIRQRMGEDLNELSIDVLRGLEQNMEHSLNIVRERKLKVIRTQSDTYRKKVTHLEQVHNNLMRELVQEGRNEDPHYVFANHNGDYQSALELANNGGSHIFALRLQPSQPILREGGGYGSHDLRLA

SEQ ID NO: 20409 - protein, 199 aa, Anemone nemorosa
QGIIKKAQELTVLCDAEVSLIMFSSTGKCTSYISPNISPKEFYDKYQQAAGIDLWQSQYQEMHNTLRKLKEINSKLRREIRVRVGEDDLKELDFDELHGLEQHLENSHKIVHQRKFSQLTTHTETTRKKIRNHEEIHNNLMQDCQQKFEEEYALANPQGISSLEMATDGAGGSHIFAFRMHPGHQDVHGDYDFHQLRLA

SEQ ID NO: 20410 - protein, 197 aa, Anemone nemorosa
TGIMKKAEELTILCDAQVSLLMFSTTGKLHEYISPSITQKEFYDKYQQISGVSLWDSQYEKMQDTLKKLKETNSKLRREIRQRHGEDLEGLQFQQLRGLEQNMEKSAERIRNKKFHVIGTQTETCKKKIKSHEETQNNLLRGFDMGDPTCHYGFIPHEDDYDHDNEGSQVFAFRLQPAQHSLQDAEAAYGSYGLTLA

SEQ ID NO: 20411 - protein, 197 aa, Anemone nemorosa
NGILKKARELTVLCDAQVSLIMFSCTGKLAEYISPSTTPKKLYDQYQKSTGVDLWNSQYEKLKESLKQQKEINMKLRKEIGQRTGMESLDGESFEKLRSLEQDLDGTSKMVRERKFHMISTQTETTRKKIRSQQEIYKRMVREIEARGEVLYYEGNLESIMAMSNGGGEDFVAYQLQPNLQEVEDFGSYGFQLAQPN

SEQ ID NO: 20412 - protein, 197 aa, Anemone nemorosa
NGILKKARELTVLCDAQVSLIMFSCTGKLAEYISPSTTPKKLYDQYQKATGVDLWNSQYEKLKDSLKQQKEINMKLRKEIGQRTGMESLDGESFEKLRSLEQDLDGTSKVVRERKFHMISTQTETTRKKIRSQQEIYKRMVREIEARGEVLYYEGNLESIMAMSNGGGEDFVAYQLQPNMQEVEDFGLYGFQLAQPN

SEQ ID NO: 20413 - protein, 184 aa, Anemone nemorosa
QGILKKAKEITVLCEAKVSLVIFSNTNKMFEYNSDPVQDILAKYQTTSGKKLWDAKHEYLSKEMDRIKKENDSMQIELRHLKGEDLTSLQPRELIPIEEALLDGLIKVRDKKMDYVMRKQIEMKKMEEENEQLNWTVNQQEIKMNGNSRSMQVNGFHQNGTDYPSEVPFTFLVHSTKPNLQEKK

SEQ ID NO: 20414 - protein, 199 aa, Aquilegia alpina
AGILKKAKELNVLCDAQVALIMFSTTDKLTDFVSPNTTMKKTFDMYQQASGTNLWNSHYEKMQEALKKQKETNRKLRKEIGQRVGAEDLSDLSFEELCGLEQHLESSVKIVAQRKFTQITTQTETSKKKIKSLEEMHNNLLHEYEERLVEEYALADHEGLSALEMAANGASHIFAFRLQPSQPNLHGDGGCGFEDLRLG

SEQ ID NO: 20415 - protein, 201 aa, Aquilegia alpina
AGIVKKAKELTVLCDAEVSLLMVSSTGKMHEYISPSCTHKNLYDRYQQASGSNLWQPHYERMQDTLQKLKEVNNKLRKEIRQRNGEDLDELSFQQLRGLEQNMEKSVECVRNRKFHQISTSTDTYKKKIKNHEETHNSLLREFEERDADFSFPALDFEGDYQSTIGFATGNPQIFAFRLQPKLQSDLQDEEAYGSYGLSLA

SEQ ID NO: 20416 - protein, 196 aa, Aquilegia alpina
TGIVKKARELTVLCDAEVSLIMFSSTGKLSEFISPSTTTKKIYDQYQQVSGINLWNSHYEKMQESLKKQKETNMRLRREIRQRIGESLDDDMSFDELRSLEQDLDESVKLVRDRKYHMIATQTETYRKKLRNLQETHTHLVREFETRGEDPYYEGDYESLLGMSSVGAHLVSYRVQPSQHNIQNGEGYGSHNLRLA

SEQ ID NO: 20417 - protein, 185 aa, Aquilegia alpina
NGILKKAREIHILCGAEIALVIFSSTGKMSEYISPPGPTTLIKILDKYQKTSGKKLWDAKHEYLSSELDRIKKENDNMQIELRHLKGEDINSLNAKELIPIEEALQNGLSKVRDKKSDIWRMMRKNTGLLEEENKRLSYHLHSLEIGGNDREMENGYHQKGRDYPAQMPFTFRVQPIQPNLQESK

SEQ ID NO: 20418 - protein, 99 aa, Aquilegia caerulea
ERMQDTLQKLKEVNNKLRKEIRQRNREDLDELSFQQLRGLEQNMEKSVECVRNRKFHQISTSTDTYKKKIKNHEETHNSLLREFEERDADFSFPALDFE

SEQ ID NO: 20419 - protein, 191 aa, Berberis gilgiana
TGIVKKARELTVLCDAEVSLIMFSSTGKLSEYISPSTTTKRLFDQYQQMTGINLWTTHYERMQESLKKQNDTNMRLRREISQRMGECLDELNFDELHSLEQDLSGSLKVVRDRKYHMIGTQTETYRKKLRNLEETHKNLVREFEIRGEDPYYEADMETSMDVVNGLYDYRLQLNQPNLRGEGFQEYFGVMH

SEQ ID NO: 20420 - protein, 193 aa, Berberis gilgiana
TGIMKKAKELTVLCDAEVSLIMFSSTRKLSEFISPSTSVKKIFDRYQQVTGKQLWQHHYEKMQETLNKLKDVNNNLRREIRQRKGDDDLDDLNIQELRDLEQNMEKSVKAVRDRKFHVIGTQTNTSKKKIKNLQETHKFLLCELDQIELASHFESSSFGLANRSSHEFAFRLQPSTPNLQDGRGYGSYDFHLA

SEQ ID NO: 20421 - protein, 193 aa, Berberis gilgiana
TGIMKKAKELTVLCDAEVSLIMFSSTRKLSEFISPSTSVKKIFDRYQQVTGKQLWQHHYEKMQETLNKLKDVNNNLRREIRQRKGDDDLDDLNIQELRDLEQNMEKSVKAVRDRKFHVICTQTDTSKKKIKNHQETHKFLLSELDQIEQASHFESSSFGLANRSSHEFAFGLQPSTPNLQDGRGYGSYDFHLD

SEQ ID NO: 20422 - protein, 185 aa, Berberis gilgiana
NGIMKKAKEITVLCEAEVSLVIFSGTGKMSEYCSSSTSLIKILDRYQKASGKRLWDAKHEYLNTEVDRVKKENDSMQIELRHLKGEDITSLHPKELIPIEAALQHGLTKVIAKQTEYVKMMKKKERMLEEENKHLSYILHQQQGEMDGNLREMENGYQQNNRDFPNNIPFAFRGQPIQPNLQGNK

SEQ ID NO: 20423 - protein, 185 aa, Berberis gilgiana
NGIMKKAKEISVLCEAEVSLVIYSGTGKMSEYCSPSTSLIKILDRYQKASGKKLWDAKHEYLNTEVDRVKKENDNMQIELRHLKGEDITSLHPKELIPIEEALQNGLTKVKAKQNEYIKMMKKKERMLEEENKHLSCILHQQQVEMDGNVREMENGYQQKSRDFLNHIPFAFCVQPIQPNLQQNK

SEQ ID NO: 20424 - protein, 197 aa, Cimicifuga racemosa
GGIMKKAKELHVLCDAEVSLIMFSNTGKMTDFISPNTTMKKMYDKYQQASGLNLWQSQYEKMQDNLNKLMEINRKLRREIGKRLGEDLNDLSFAELRGLEQHLESSCKIVRDRKFGLLGTQTETCRKKIKNLEEVHNNLLHEYEERLEEAYALANHEGMSTNELANDGSHVFMFRLQPSQPNLRDDGGYGIHDLRLG

SEQ ID NO: 20425 - protein, 201 aa, Cimicifuga racemosa
AGITKKAQELTVLCDAQVSLIMISSTGKLFEYTSSSTTTKSIYDRYQQTTGLNLWQSHYEKMQENLNKLKETNSKLRREIRQRNGEDIDDLTFQQLRGLEQHMEKSVERVRHRKFHVIGTSTDTYKKKIKSLEETHNNLLRAFEERIEEDCHYALVDQEGDYQSAIGLANGGPHIFSIRLQPSQPNLRDDEGYASYGLRLA

SEQ ID NO: 20426 - protein, 195 aa, Cimicifuga racemosa
TGIVKKARELAVLCDAEVSLIMFSSTGKLSEYISPSTTTKKIYDTYQQVTGVDLWNSHYEKMQETLKKQKESNMKLRKEIRQRIGEGLDDLSFEELRGLEQDLNGSVKVVRDRKYHTIATQTETYRKKLRNLQETHTHLVREFEARGEDPYYEGGYESLLGMSNGAAHLLPYRLQPSQPNLQDGENYGSYNLRLG

SEQ ID NO: 20427 - protein, 187 aa, Cimicifuga racemosa
NGILKKAKEITVLCDAEVSLVIFSSTGKMSEFSSPSTPLIKILDKYQKSSGRKLWDAKHEYLNSEVERVKKENDSMQIQLRHLKGEDLTSLNPKELIPIEEALLDGLSKVKDKQMEVWRKMKKNDRALEEENKRLNLILHQQQQMKMDGNVRDMENGYHQNGGRDYPTQMPFSFRVQPIQPNLQENK

SEQ ID NO: 20428 - protein, 187 aa, Cimicifuga racemosa
NGILKKAKEITVLCDAQVSLVIFSSSGKMSEFTSQSTPLIKILDKYQKSSGRKLWDAEHESLNNEVERIKKENDSMQIQLRHLKGEDITSLTPRELIPIEEALLDGLSKVKDKQMEVWRKMKKNDRALEEENKRLNLILHQQQQMKMDGNARDMENGYHQNGGRDYPTQMPFSFRVQPIQPNLQENK

SEQ ID NO: 20429 - protein, 191 aa, Cimicifuga racemosa
NRQVTYSKRRNGILKKAKEITVLCDAQVSLVIFSSSGKMSEFTSQSTPLIKILDKYQKSSGRKLWDAEHESLNNGVERIKKENDSMQIQLRHLKGEDITSLTPRELIPTEEAPQDGLSKVTAKKMEVWERMKRNDTQLEEENRRLRFIMHQMQRMEMDGTSRDMADGYHQNGGRDYPTEMPFAFHNLQLNK

SEQ ID NO: 20430 - protein, 181 aa, Cimicifuga racemosa
NGILKKAKEITVLCDAQVSLVIFSSSGKMSEFTSQSTPLIKILDKYQKSSGRKLWDAEHESLNNEVERIKKENDSMQIQLRHLKGEDITSLTPRELIPIEEALQDGLSKVTAKKMEVWERMKRNDTQLEEENRRLRFIMHQMQRMEMDGTSRDMAGGYHQNGGRDYPTEMPLAFHNLQLNK

SEQ ID NO: 20431 - protein, 203 aa, Clematis chiisanensis
NRLVTYSKRRTGIMKKARELTVLCDAEVSLIMFSCTGKLAEYTSPSTTPKKVYDQYQRVTRINLWKSYYEKLQESLKQQKEVNMKLHKEIGQRTGKESLDGVSFEKLHGLEQDLDGTLKVVRERKYHVIATQTETSKKKLKNKQEAHKRLVREIEARNEVAYYGGDFESIMAMSNGGAHLFSYHLQPNPQEVEAHGACDFHLA

SEQ ID NO: 20432 - protein, 202 aa, Clematis integrifolia
NGIIKKAQELSVLCDAEVSLIMFSSTGKCTSFISPTISPKEFYDRYQQAAGTDLWQSQYQEMHNNLRKLMEINSKLRREIRIRVGEDDLTELDFDELHRLEQHLENSSKIVRQRKFSQIATHTETARKKIRSQEQIHTNLMQDNYEQIEKQYALANHQSISSLELATDGAGGSHIFAFRLHPGQPHVHGDEGDYDFHQLRLA

SEQ ID NO: 20433 - protein, 197 aa, Clematis integrifolia
TGIMKKAEELTVLCDAQVSLLMFSTTNKLHEYISPSITQKEFYDKYQRSSGVNLWDSQYEKMQENLKKLKETNNRLRKEIRQRHGEDLEGLQLQQLCGLEQNMLKSAERIRHKKFHVLGTQTETCKKKIKSHLEAHNNLLRGFEEGDTSCHYGFIPHGDDYDDDNGGSQVFAFRLQPTQPSLQDAQAAYGSYGLTLA

SEQ ID NO: 20434 - protein, 182 aa, Clematis integrifolia
NGILKKARELNVLCDAQVSLVVFSSTGNMFEFHSKPLSKTLERYQSASGNKLWDAKLEYLSKEVDRIKKENDRMQIELRHLKGEDINSLQPRDLIPIEDALSNGLRKVKDKQMEFLENTKRRTLKVEEDNKLLCYTLQQQEQQMEMNRNADKGYHQNGGEYPSHVPFTFRVQPIQPNLQENK

SEQ ID NO: 20435 - protein, 183 aa, Clematis integrifolia
NGILKKAREITVLCSAQVSLVIFSNTNKMVEFHSEPVETLLEKYQKTSGKRLWDAKHEYLSKEVDRIRKENDNMQIELRHLKGEDLSSLQPRELIPIEEALLNGLDKVKDKKMEVVTRSQIKMKRLEEENEHLNWTVHQQETKMNMNARNMVNGFHQNGTDYPSEIPFSFCVHPAKPDLQENK

SEQ ID NO: 20436 - protein, 193 aa, Helleborus orientalis
AGIMKKAQELHVLCDAEVALIMLSSTGKVIHYISPNTTDKAIYDKYQQSLGHSIWEPQYQQMQETLRKLKDINSKLRREIRQRVGEDLDDLTFNQLRGLEQHLNESAEIVRQRKFHQIKTQIETTKKKITHHEQTHNNLVHDYHEKLEDAFALVTHESVSLELSNGDGAHVFAFRNPYEADKAGYDLSDLRSG

SEQ ID NO: 20437 - protein, 200 aa, Helleborus orientalis
AGILKKAKELTVLCDAQVSLLMFSSSGKVHEYTSPSTTMKNVYDRYQQVLGVNLWQSHYERLQDNLKKQKEINSKLRREIRQRNGEDLDNLSCQQLRGLEQNMEKSVNCVRARKFHVLHTQTETFKKKVKHLEQEQTNLFRTCERDNGDEHYAVIGPEGDYQSAIGLANGGSHIFAFRLQPSQANIQDEEGYDPYSLSLA

SEQ ID NO: 20438 - protein, 195 aa, Helleborus orientalis
SGIVKKARELSVLCDAQVALIMFSSTGKLSEYMSPSTTPKKVYDQYQQIMGTSLWNSHYEKMQESLKKQKETNLKLRKEIGQRIGEGIDHLSFDELRGLEQDLDGSLKVVRDRKYHMISTQTETYRKKLRNLQETHTHLLREFEIRGEDPYYDGDYESILGMSNGGEHILSYRLQPSEANLQDAECYGSYNLQLA

SEQ ID NO: 20439 - protein, 196 aa, Helleborus orientalis
NGIVKKARELSVLCDDAEVALIMFSSTGKLSEYISPSTTPKKIYDRYQQIIGTNLWNSHYEKMQEILKKQKETNMKLRKEIGQRIGEGIDNLSFDELRGLEQDLDGSLNVVRDRKYHIISTQTETYRKKLKNLQETHTLLMREFEIRGEDPYYEGDYESILGMSNGGAHILSYRLQPNRGNLPDADGYGSSSLQLA

SEQ ID NO: 20440 - protein, 183 aa, Helleborus orientalis
NGILKKAKEIAVLCDAQLSLVIFSSTGKMTDYTSPNTSLIKILDRYQTSSGNKLWDAKHEHLHHEVDRVKKENDSMRIELRHLKGEDLTSLNPRELIPIEEGLEHGLSKVRDKKTEIWKRIKKNDRMLEEENEHLHNIVKQQAMDGNVRDFENEYHQKGMDYHSQMPFAFHIQPMQPNLQDTE

SEQ ID NO: 20441 - protein, 185 aa, Helleborus orientalis
NGILKKAKEIAVLCDAQLSLVIFSSTGKMTDYTSPNSSLIKILDRYQKSSGNKLWDAKHEYLHHEVDRIKKENDSMQIELRHLKGEDLTSLNPRELIPIEEALEHGLSKVRDKKTEIWKKMKKNDRMLEEENTHLHNIVKQQTVDGNVRDFQNGYHHQKGGMDYHSQIPYNFHVQQMQPNLQDAK

SEQ ID NO: 20442 - protein, 184 aa, Helleborus orientalis
QGLLKKAKEITVLCGAKLSLVIFSSAGKMSDYNSSNSSLLEILERYQNASGKRLWDAKHEYLHKEVDRIKKENDSMQIELRHLKGEDITSLGPRELIPIEEALEHGLSRVRDKMGEMWRRLKKNGRKLEEENAQLNCIRRHKQEQRGVDGNENGYHQQAIMEYPSQRPFSFRVQPMQPNLHETN

SEQ ID NO: 20443 - protein, 199 aa, Platanus occidentalis
GGITKKAQELSVLCDAEVSLIMFSSTGKFHEYISPTTTTKEIFDRYQQTLRINLWQAHYEKMQDSLNRLKEINNNLRREIRHRIGEDLNDLSIEELRGLEQNMDNSMKIVRDQKYHKIQTQTDTYKKKLKSSEETHRNLLRQFEGRDDDPDYGLVDNEGDYESEMGVANGGSHSFAFRLQPIQPNLQEGVYGFHDLRLA

SEQ ID NO: 20444 - protein, 200 aa, Platanus occidentalis
GGITKKAQELSVLCDAEVSLIMFSSTGKFHEYISPTTTTKKIFDRYQQISRIDLWQPHYEKMQNNLNKLKEVNNNLRREIRQRMGEDLNDLSIEELRGLEQNLDDSLNIVREQKYHKIQTQTDTCKKKLKNSQETHRELLRHFEVRDEDLDYGLGDNEEDYESELGVANVGSHSFAYRLQPIQLNIQDGGIYGFRDLRLA

SEQ ID NO: 20445 - protein, 195 aa, Ranunculus ficaria
TGIVKKARELTVLCDAQVSLIMFSSTGKLSEYISPTTTRKKVYDMYQKVAEVDLWNSEYERMQKELKKLKETNMELRKEIRQRVGEEIDDLSIDQLRGLEQDLDESVKAVRDRKYHTIATQTETYRKKLRNLHETHTHLVREIEARGEDAYYDGDYEAIMALTNAGAHFLPYGLHPGQPDHHDGDGYALHNLRLA

SEQ ID NO: 20446 - protein, 169 aa, Ranunculus ficaria
NGIIKKAKEIAILCEAKVSLVIFNSNGKMTEFHSHPLTQILQKYQKDSGNKLWDAKHEYLSQEIARLGKENQSMKLELMHLKGEEINSLQPRELISIEHALDNGITKIKQKTMDIYRMMKQNDMELEQENKQLVLKLQQQQMMSGREYPSQMPFTFRLHPSQPNLQESK

SEQ ID NO: 20447 - protein, 180 aa, Ranunculus ficaria
NGIIKKAMEIAILCEAEVSLVIFSSTDKIAEFHSHSLLNSLNRYQGLTGKKLWDAKHQYLHEEIARVKKENDSMELELKHLRGEDLTSLNPKELYAVELALDNGITKVGAKQMHIRDRMEENDMAMEEENRVLAFKLQQLMDANARDLKHGYQQKSEGYPSQMPFTFRVQPTQPNLQDNK

SEQ ID NO: 20448 - protein, 199 aa, Thalictrum thalictroides
AGILKKANELNVLCDAQVAMIMFSSSDKLTEFVSPNTTMKKAFDMYQLASGCNLWDSRYEKMQEALKKQNEINRKLRREIGRRVGGEDLSDMSFEELCGLEQHLHSSVKIVAQRKYSQLTTQTETSKKKVKNLEQMHNDLLHEYEEKLEEPYALVDHEGLSALEMAANGASHIFSFRLQPSQPNLHGDGGFGFEDLRLG

SEQ ID NO: 20449 - protein, 183 aa, Thalictrum thalictroides
AGIVKKAKELTVPCDTQVSLIMISSSGKIHEYISPSYTHKNLYDKYQQVSGNNIWKPHYERMQDNLQKLKEINNKLRKEIRQRNGEDLDELNFQQLCGLEQNMEKSVDCVRNRKFHVISSQTDIYKKKVKNHQVTYNGLLRGFEERDADCQYASPDFEGEYQSTIEFATENPHIFAFGLQPQL

SEQ ID NO: 20450 - protein, 201 aa, Thalictrum thalictroides
AGIVKKAQELTVLCDAEVSLLMVSSTGRIHEYVSPCSTHKNLYDRYQQASGTNLWQPHYERMQETMKKLKEINNKLRKEIRQRNGEDLDELNFQQLCGLEQNMEKSVEGVRNRKFHVITTSTDTYKKKIKNHEETHNSLRREFEEGDADFRFPSVDFEGDYQSTIGFANGNPQIFAVRWQPKLQSNIQDKEAYGSYGLSLV

SEQ ID NO: 20451 - protein, 186 aa, Thalictrum thalictroides
NGILKKAREIHVLCDAQIALVIFSSTGKMSEYISPSPGPSTTLIGILDKYQKTSGKKLWDAKHEFLSSELDRIKKENDSMQIELRHLKGEDITSLNAKELIPIEEALNNGLSKIRDKKNDVWRMMTKNTSMLEEENKRLSYHLHSLEIGGNDRDMENGYHQKGRDYPAQMPFTFRVQPIQPNLQEK

SEQ ID NO: 20452 - protein, 198 aa, Trollius laxus
TGILKKAGELNVLCDAEVSLIMISNTGKLTDFFSPNISPKAFFDKYQHVSGVDLWERHYVRLQDTLMQLKETNTRLRREIGQRVGGDLSGLSLTDLRALELDLQSSAKIVRMRLYKLISTQTDTFKKKVRNLEEINANLVHEYEERVEEAYEIANHEAMSALELANAGSHMFGFRLQPSQPNLHDDGGAYGLHDLRLG

SEQ ID NO: 20453 - protein, 198 aa, Trollius laxus
TGILKKAGELNVLCDAEVSLIMISNTGKLTDFFSPNISPRAFFDKYQHVSGVDLWESHYVRLQDTLMQLKETNTRLRREIGQRVGGDLSGLSLTDLRALELDLQSSAKIVRKRLYKLISTQTDTFKKKVRNLEEINANLVHEYEERVEEAYEIANHEAMSALELANAGSHMFGFRLQPSQPNLHDDGGAYGLHDLRLG

SEQ ID NO: 20454 - protein, 205 aa, Trollius laxus
AGILKKAKELTVLCDAEVSLLMFSSTGKLHEFVSPSTTTKKVYDRYQQTSGISLWQSHYERMQDNLNKLKEINRKLRREIRQRNGEDLDGLTFQQLCTLEQNMDKSAECVRNRKFHVIGTQTDTYKKKLMLQVKNHEETQNDLLREMQRREAEYHYAFGDQEGDYPSAVNGNAAHIFAFRLQPSQPNLHLQDDASGYGSYGLSLA

SEQ ID NO: 20455 - protein, 201 aa, Trollius laxus
AGILKKAKELTVLCDAEVSLLMFSSTGKLHEFVSPCTTTKKVYDRYQQTSGINLWQSHYERMQDNLNKLKEINRKLRREIRQRNGEDLDGLTFQQLCTLEQNMDKSSECVRNRKFHVIGTQTDTYKKKVKNHEETQNDLLREMQRREAEYHYAFGDQEGDYPSAVNGNAAHIFAFRLQPSQPNLHLQDDASGYGSYGLSLA

SEQ ID NO: 20456 - protein, 207 aa, Trollius laxus
NRQVTYSKRRTGIIKKATELAVLCDAEVSLIMFSSTGKLSEFTSPNTTTKKLFDQYQRVTGTPLWDTHYERMQESLKQQKEVNMKLRKQIRQRIGEGSLDNLSFEELRNLEQDLDTSVKAVRDRKYHMIATQTETHRKKLRNMQETHTHLVRELEARGEDPYYEGDYESSYIGMTNGGAHLLSYRLQPNQPNLQDEEGYGSYNLRLA

SEQ ID NO: 20457 - protein, 197 aa, Trollius laxus
TGIIKKATELAVLCDAEVSLIMFSSTGKLSEFTSPNTTTKKLFDQYQRVSGTPLWDTHYERMQESLKQQKEANMKLRKQIRQRIGEGSLDNLSFEELRNLEQDLDTSVKVVRDRKYHMIATQTETHRKKLRNMQETHTHLVRELEARGEDPYYEGDYESSYIGMANGGAHLLSYRLQPNHPNLQDGEGYGSYNLRLA

SEQ ID NO: 20458 - protein, 170 aa, Trollius laxus
NGILKKAKELTVLCDAIVSLVIFSSSGKMVAYASNPLGEILDKYHKISGKRLWDAKHEYLNSEVERVKKENDSMQIELRHLKGEDLTSLNPKELIPIEDALQNGLAKVREKKNEFLKVVKKNGRMLEEDNKRLTYILQKQQMEINGYHQNDSQIPFNFRVQPIQPNLQEP

SEQ ID NO: 20459 - protein, 167 aa, Trollius laxus
NGILKKAKELTVLCDAIVSLVIFSSSGKMVAYASHPLGEILDRYHKISGKRLWDAKHEYLNSEVERVKKENDSMQIELRHLKGEDLTSLNPKELIPIEDALQNGLAKVREKKNEFLKVVKKNGRMLEEDNKRLTYILQKQQMEINGYHQNDSQIFRVQPIQPNLQEP

SEQ ID NO: 20460 - protein, 187 aa, Trollius laxus
NGILKKAREIAVLCDAQVSLVIFSATGKIDEYSSSPLVTILDRYQNSAGNKLWDAKHEYLNSEVERVKKENDNMQIQLRHLKGEDITSLNPKELIPIEEALLDGLAKVRDKKMEYWNRMKKNGRTLEEENKRLRCMLNPKQHMEMEEKADLENGYHHNCRNYPSQIPFSLQIQTIHPNLQEPRGHNY

SEQ ID NO: 20461 - protein, 187 aa, Trollius laxus
NGILKKAREIAVLCDAQVSLVIFSATGKIDEFSSSPLVTILDRYQNSSGNKLWDAKHEYLNSEVERVKKENDNMQIQLRHLKGEDITSLNPKELIPIEEALLDGLTKVRDKKMEYWNRMKKNGRMLEEENKRLRCMLNPKQHMEMEEKADLENGYHHNCRNYPSQIPFSLQIQTIQPNLQEPRGHNY

SEQ ID NO: 20462 - protein, 173 aa, Trollius laxus
NGILKKAKEITVLCDAKVSLVIFSSTGKLTQFSSDPLVTILDRYQKSSGIKLWDAKHEYLNSEVERVKKENDNMQIQLRHLKGEDITSLNPRELIPIEEALLNGLTKVRDKKMEFCDRMKKNGRMLEEENKRLKDMLNPKQHMEMEEREDLEHCRSYPLQIPFSLQDPKGYNY

SEQ ID NO: 20463 - protein, 182 aa, Trollius laxus
NGILKKAKEITVLCDAKVSLVIFSSTGKLTQFSSDPLVTILDKYQKSSGNKLWDAKHEYLNSEVERVKKENDNMQIQLRHLKGEDITSLNPRELIPIEEALLNGLTKVRDKKMEFCNRMKKTGRMLEEENKRLKDMLNPKQHMEMEEKEDLEHCRSYPSQIPFSLQIQPIHPNLQDPKGYNY

SEQ ID NO: 20464 - protein, 184 aa, Trollius laxus
NGILKKAKELTVLCDAKVSLVIFSSTGKMTEFSSSPLETILDKYQRSSGNKLWDAKHEYLNSEVERVKKENDNMQIQLRHLKGEDITALNPKELIPIEEALLDGLTKVRDKKMEYWNRMKNNGRMLEEENKRLKYMENPKQYMEMEEKGELENCRNYPSQIPFSSLHIKPIHPDLQEPKGYYNF

SEQ ID NO: 20465 - protein, 184 aa, Trollius laxus
NGILKKAKELTVLCDAKVSLVIFSSTGKMTEFSSSPLEIILDKYQRSSGNKLWDAKHEYLNSEVERVKKENDNMQIQLRHLKGEDITALNPKELIPIEEALLDGLTKVRDKKMEYWNRMKNNGRMLEEENKRLKYMENPKQYMEMEEKGELENCRNYPSQIPFSSLHIKPIHPDLQEPKGYYNF

SEQ ID NO: 20466 - protein, 196 aa, Trautvetteria carolinensis
AGIMKKAKELTVLCDAEVSLIMFSSSGKCVDFISPTISQKEFYDKYQKITRDDLWKSQYDKMQEELKTLVEINRKLRREIGQRVGEDLDDLSIQELRSLEQDLRNTEKVVRQRKFGLLSSQGETQKKKVRNLAEINSNLWQEYQERSEEEYALANGMSALELGNGVAPHIYSFRLHPSQPNLHEDEEYEIHGLRLA

SEQ ID NO: 20467 - protein, 184 aa, Trautvetteria carolinensis
NGIIKKAQELTILCNARVSLVIFNTNNKLYEFHSHCLKKMLKDYQEKSGNKLWDAKHQYLQDEVNRIKKENDSMQLELRHLKGEDLNSLTAKELYPIELLLDNGITKVREKQMEIHNKMEKRDRMMEEENKLLHLKLQQLMNVNVNANARDLKHGYQQKDEDYPYQMPFIYRVQPTQPNLQDNK

SEQ ID NO: 20468 - protein, 174 aa, Trautvetteria carolinensis
TGIIKKAREIAILCAAQVSLVILNSNGKVSEFHSHPLINILKRYHKVAGKRLWDAKHEYLHQEIQKIEKENGSMQIELRHLKGEEINSLQPKELIPIEHALDNGLSKVRAKLDDIPRIMNKKGRMLEEENKLLAFKLQQMNGNGRDAEHGYTSSQMMPFTFRVQPTHPNLQDNK

SEQ ID NO: 20469 - protein, 534 aa, Drosophila melanogaster
MDIGTIELSVEALIGSLLALSILFAFCRSLLSEDFVSTFKTRHSWKSIKVLEQACFCNVCEILLTPSAGLFCDCCGLCTHATPPCQRRADREYRCKDKWLRNESSVRHLWVHGNLPMGVHCADCNEEVDHHVSTDPGLYGWRCAWCQRCYHNDCYTRADSMEACDLGEFKDMIFPPYSFVAARTRDSMRLHLASITPPDIENWEPLIVIANTKSGSSTGANVLSLLRGYLHPLQVMELGSRGPQDALQWAAKASPRPCRILVAGGDGTIGWVLNTIYTLNIKPQPSVAIMPLGTGNDLSRVLGWGAEPPSVLDPVKILRSIRRARSVNLDRFDLQIEKLHYRLPIQRHPTKTIHVYNYFSVGVDAYITYNFHKTRESRFYLLSSRIFNKLLYFTFGTQQVMQPGCEHIEEKLTLYLDNKPVQLPELQALVFLNIDSWGAGCNVCELSNANGEVRIVNSISDGMMEVFGIVSSFHIAQLQCNISKPVRIGQAKQIRLQVKETVPMQADGEPWMQSPADIRLSSRSQARVLKLAAT

SEQ ID NO: 20470 - protein, 395 aa, Asterina pectinifera
MQTACSGNLCGYQLMFSLSTVVTVCRSLRSRNRHWFLKLLRCTFNDRMRCALENISNVAKNNVQAAAKKEIKQKRGMTKSKATSSLQSVIGLHVEPVEKVQSPEPMDMSEVSNALEAFSQNILEMGVDDIDKDDHENPQLCSEYVNDIYLYMRHLEREFKVRTDYMAMQEITERMRTILIDWLVQVHLRFHLLQETLFLTIQILDRYLEGASVSKTKLQLVGVTSMLIAAYEEMYAEIGDFVYITDNAYSKAQIRAMECNILRKLDFNLGKPLCIHFLRRCSKAGGVDGHKHTLSKYIMELTLQSTALSSMTIEIAAAALLSQDSGMRICGMGTKSLVHYSAYSEGHLGPIVQKMAVLSQQSHPSPNSRLDQEEDMASSKFMSDQQATQELKSIR

SEQ ID NO: 20471 - protein, 185 aa, Homo sapiens
MVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 20472 - protein, 136 aa, Oryza sativa (japonica cultivar-group)
MDGDGGGGWDDQGNGGGETTKYRGVRRRPSGKFAAEIRDSSRQSVRVWLGTFDTAEEAARAYDRAAYAMRGHLAVLNFPAEARNYVRGSGSSSSSRQHQQRQVIELECLDDQVLQEMLKGGDDQYRSAAGSKRNNY

SEQ ID NO: 20473 - protein, 164 aa, Oryza sativa (japonica cultivar-group)
MPPRSLTLSRLPVAALGLPFSSCSPPPPRLRFPFAARRARSLATRASSSSPDSSFGSRMEDSVKRTLADNPVVIYSKSWCSYSMEVKALFKRIGVQPHVIELDQLGAQGPQLQKVLERLTGQSTVPNVFIGGKHIGGCTDTVKLHRKGELATMLSELDIDVNNS

SEQ ID NO: 20474 - protein, 504 aa, Oryza sativa (japonica cultivar-group)
MAAAAALELRLLAPLAAPAVVVYMLIIVMSSATQIFCGQLGNVQLAASSLGNNGIQVFAYGLMLGMGSAVETLCGQAYGAGRHEMLGVYLQRSAVLLTAAGVPLAALYACSERVLLLLGQSPEISRAAAGFARGLIPQIFAYAANFPIQKFLQAQSIVAPSAAVLAASFALHLPLSWAAVRVLGLGLPGAALALSATWWVLVAGQFAYIVRSPRCAATWTGFTWAAFHDLAAFARLSAASAVMLALEVWYFQVLILLAGMLPDPQIALDALTVCTSIQSWVFMISVGFNAAASVRVGNELGAGNPRSAAFSTWMVTALSAIIAAIAGVVVILLRDKLSYIFTQGEAVSRAVSDLCPLLVGTIVLCGIQPVLSGVAVGCGWQALVAYINIGCYYLIGLPLGVLLGFKFDYGIKVLLILDIPQFDTHSVDFSVVESTGKGIVGRHDWRDAHPNTYFNMDHIQNRLEQGGTVTAFPCRAVENTNSSKGRRQQSKRQATINLVSSFDP

SEQ ID NO: 20475 - protein, 393 aa, Mus musculus
MEQCACVERELDKVLHKFLTYGQHCEQSLEELLHSVGQLRAELASAALQGTPLSATLSLVMSQCCRKIRDTVQKLASDHKDIHSSVSRVGKAIDRNFDSEICGVVSDAVWDSREKQQQILQMAIVEHLYQQGMLSVAEELCQESTLNVDLDFKQPFLELNRILEALHEQDLGPALEWAVSHRQRLLELNSSLEFKLHRLHFIRLLAGGPEKQLEALSYARHFQPFARLHQREIQVMMGSLVYLRLGLEKSPYCHLLDNSHWAEICETFTRDACSLLGLSVESPLSVSFASGCVALPVLMNIKAVIEQRQCTGVWSHKDELPIEIELGMKCWYHSVFACPILRQQTSDSNPPIKLICGHVISRDALNKLINGGKLKCPYCPMEQNPADGKRIIF

SEQ ID NO: 20476 - protein, 347 aa, Mus musculus
MHPAAFPLPVVVATVLWGAAPVRGLIRATSEHNASMDFADLPALFGATLSDEGLQGFLVEAHPENACGPIAPPPSAPVNGSVFIALLRRFDCNFDLKVLNAQKAGYGAAVVHNVNSNELLNMVWNSEEIQQQIWIPSVFIGERSAEYLRALFVYEKGARVLLVPDNSFPLGYYLIPFTGIVGLLVLAMGTVLIVRCIQHRKRLQRNRLTKEQLKQIPTHDYQKGDEYDVCAICLDEYEDGDKLRVLPCAHAYHSRCVDPWLTQTRKTCPICKQPVHRGPGDEEQEEETQEQEEGDEGEPRDQPASEWTPLLGSSPTLPTSFGSLAPAPLVFPGPSTDPSPPSSAALA

SEQ ID NO: 20477 - protein, 190 aa, Homo sapiens
AGNVVTGEMVEELILSGADIIKVGVGPGSVCTTRTKTGVGYPQLSAVIECADSAHGLKGHIISDGGCTCPGDVAKAFGAGADFVMLGGMFSGHTECAGEVFERNGRKLKLFYGMSSDTAMNKHAGGVAEYRASEGKTVEVPYKGDVENTILDILGGLRSTCTYVGAAKLKELSRRATFIRVTQQHNTVFS

SEQ ID NO: 20478 - protein, 441 aa, Paracoccus denitrificans
MFLRDDDPPARRVEKLTRIADVLVERIDRLEESRGSAWSMFQAAVALEQEVQVRTRELEQALADLSERNRELAVARASAEEANRSKTRFLRAASHDLLQPLSAAKLFLSALKDTSLDPLQRELTDRLSGAFESVEELMHAVLDISRLDSQRIEFQRKPVDLGGLFRRLAIEYAPMAEAKELRLSFAPTTAMVESDPTFLRRIAQNLVSNAIKYTDRGGVLVGVRKRGERAWLEIYDTGIGIAAPDRARIFDEFQRIGREGGAPGMGLGLSIVRRACAKLGHPIAMDSEPGRGTVFRVSLPLVAPGGEAVRPEGAGQGPHLRGRVALVVENDDAMRRALQLVLRDKLGMVARVSGGIAEALAQMGDEPPDVVIADYNLDNGDTGLQAIEALRKAAGQAVPAIVVSARRAPELGGACQKMGVPVLEKPVRPEDLQAMLQQMLA

SEQ ID NO: 20479 - protein, 865 aa, Lycopersicon hirsutum
MGCVKLIFFMLYVFLFQLVPSSSLPHLCPEDQALALLQFKNMFTVNPNASDYCYDYTGVEIQSYPRTLSWNKSTDCCSWDGVDCDETTGQVIALDLCCSKLRGKFHTNSSLFQLSNLKRLDLSNNNFTGSLISPKFGEFSNLTHLVLSDSSFTGLIPFEISRLSKLHVLRISDLNELSLGPHNFELLLKNLTQLRELNLDSVNISSTIPSNFSSHLTNLWLPYTELRGVLPERVFHLSDLEFLHLSGNPQLTVRFPTTKWNSSASLMKLYVDSVNIADRIPESFSHLTSLHELDMGYTNLSGPIPKPLWNLTNIESLFLDDNHLEGPIPQLPRFEKLNDLSLGYNNLDGGLEFLYSNRSWTELEILDFSSNYLTGPIPSNVSGLRNLQLLHLSSNHLNGTIPSWIFSLPSLVVLDLSNNTFSGKIQEFKSKTLITVTLKQNKLKGPIPNSLLNQQSLSFLLLSHNNISGHISSSICNLKTLISLDLGSNNLEGTIPQCVGEMKENLWSLDLSNNSLSGTINTTFSVGNFLRVISLHGNKLTGKVPRSLINCKYLTLLDLGNNMLNDTFPNWLGYLPDLKILSLRSNKLHGLIKSSGNTNLFTRLQILDLSSNGFSGNLPESILGNLQTMKKINESTRFPEYISDPYDIFYNYLTTITTKGQDYDSVRIFTSNMIINLSKNRFEGHIPSIIGDLVGLRTLNLSHNALEGHIPASFQNLSVLESLDLASNKISGEIPQQLASLTFLEVLNLSHNHLVGCIPKGKQFDSFGNSSYQGNDGLRGFPLSKLCGVDDQVTTPAELDQEEEEEDSPMISWQGVLVGYGCGLVIGLSVIYIMWSTQYPVWFSRMDLKLEHIITTRMKKHKKRY

SEQ ID NO: 20480 - protein, 862 aa, Lycopersicon hirsutum
MDCLELVFLMLYTFLCQLALSSSLPHLCPEDQALALLQFKNMFTVNPNDSDYCYDISTGVDIQSYPRTLSWNNRTSCCSWDGVHCDETTGQVIELDLSCSQLQGKFHSNSSLFQLSNLKRLDLSFNNFTGSLISSRLGEFSSLTHLDLSHSSFTGLIPSEISHLSKLHVLRIGDLNELSLGPHNFELLLENLTQLRELNLNSVNISSTIPSNFSSHLAILTLYDTGLHGLLPERVFHLSDLEFLDLSYNPQLTVRFPTTKWNSSASLMKLYVHSVNIADRIPESFSHLTSLHELDMGYTNLSGPIPKPLWNLTNIESLDLDYNHLEGPIPQLPRFEKLKDLSLRNNNFDGGLEFLSFNRSWTQLEWLDFSSNSLTGPIPSNVSGLQNLEWLYLSSNNLNGSIPSWIFSLPSLIELDLRNNTFSGKIQEFKSKTLSVVSLQKNQLEGPIPNSLLNQSLFYLLLSHNNISGRISSSICNLKMLISLDLGSNNLEGTIPQCVGEMKENLWSLDLSNNSLSGTINTTFSIGNSFRAISLHGNKLTGKVPRSLINCKYLTLLDLGNNQLNDTFPNWLGYLSQLKILSLRSNKLHGPIKSSGNTNLFTRLQILDLSSNGFSGNLPESILGNLQAMKKIDESTRTPEYISDICYNYLTTITTKGQDYDSVRIVDSNMIINLSKNRFEGRIPSIIGDLVGLRTLNLSHNALEGHIPASFQNLSVLESLDLSSNKISGEIPQQLASLTFLEFLNLSHNHLVGCIPKGKQFDTFLNSSYQGNDGLRGFPLSIHCGGDDQLTTPAELDQQQEEEDSSMISWQGVLVGYGCGLVIGLSVIYIMWSTQYPAWFSRMDLKLERIITTRMKKHKKRY

SEQ ID NO: 20481 - protein, 806 aa, Lycopersicon hirsutum
MGCVKLVFFMLYVFLFQLVSSSSLPHLCPEDQALALLEFKNMFTVNPNASDYCYDRRTLSWNKSTSCCSWDGVHCDETTGQVIELDLRCIQLQGKFHSNSSLFQLSNLKRLDLSYNDFTGSPISPKFGEFSDLTHLDLSHSSFRGVIPSEISHLSKLYVLRISLNELTFGPHNFELLLKNLTQLKVLDLESINISSTIPLNFSSHLTNLWLPYTELRGILPERVFHLSDLEFLDLSSNPQLTVRFPTTKWNSSASLMKLYLYNVNIDDRIPESFSHLTSLHKLYMSRSNLSGPIPKPLWNLTNIVFLDLNNNHLEGPIPSNVSGLRNLQILWLSSNNLNGSIPSWIFSLPSLIGLDLSNNTFSGKIQEFKSKTLSTVTLKQNKLKGPIPNSLLNQKNLQFLLLSHNNISGHISSAICNLKTLILLDLGSNNLEGTIPQCVVERNEYLSHLDLSNNRLSGTINTTFSVGNILRVISLHGNKLTGKVPRSMINCKYLTLLDLGNNMLNDTFPNWLGYLFQLKILSLRSNKLHGPIKSSGNTNLFMGLQILDLSSNGFSGNLPERILGNLQTMKEIDESTGFPEYISDPYDIYYNYLTTISTKGQDYDSVRILDSNMIINLSKNRFEGHIPSIIGDLVGLRTLNLSHNVLEGHIPASFQNLSVLESLDLSSNKISGEIPQQLASLTFLEVLNLSHNHLVGCIPKGKQFDSFGNTSYQGNDGLRGFPLSKLCGGEDQVTTPAELDQEEEEEDSPMISWQGVLVGYGCGLVIGLSVIYIMWSTQYPAWFSRMDLKLEHIITTKMKKHKKRY

SEQ ID NO: 20482 - protein, 369 aa, Cricetulus griseus
GGEPRGAAGVGPGVPGEVEVVKGQPFDVGPRYTQLQYIGEGAYGMVSSAYDHVRKTRVAIKKISPFEHQTYCQRTLREIQILLRFRHENVIGIRDILRAPTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEDALAHPYLEQYYDPTDEPVAEEPFTFDMELDDLPKERLKELIFQETARFQPGAPEAP

SEQ ID NO: 20483 - protein, 701 aa, Caenorhabditis elegans
MEEKSLLQKLRSYPPAVFFMLGNEFCERFSFYGMKTILFIYLITEHEFSPSKATFIYHLFTCIAYLTPLIGSIMADSVFGRFKVILYGSSIYVVGHVLLSLGAVPFLSYPIRSSLDFSGLFVIAFATGCIKPCVSAFAADQFTEDQKDLRSQFFSFFYFAINGGSLFAIIITPILRGRVQCFGNAHCFPLAFGVPGVLMLLALILFLMGWSMYKKHPPSKENVGSKVVAVIYTSLRKMVGGASRDKPVTHWLDHAAPEHSQKMIDSTRGLLNVAVIFCPLIFFWALFDQQGSTWVLQARRLDGRVGHFSILPEQIHAINPVCVLILVPIFEGWVYPALRKITRVTPLRKMAVGGLLTAFSFAIAGVLQLKVNETMEFPPSLGRIYLQRVGNESLISDFRYKSDGRLIGDGMLPKGRTELDAGIYTFNTGLKNESQEIDISTPNKGYVMAVFRLKDAVEVVKFDYKVEKTDNGATRVFVVTAREDADTLVYAINKKGKILSSCELKSGSYVDVIPGIISDPNVRLYWGPKNSCSGVDCPNTVTLNAQMGAVHVLHIHPSTTEGDFNLLVRPNSVSILWSLPQYIIITLGEVLLSVTGLEFAYSQAAPNMKSVLTAMWLLTVFAGNLIDMMISGTRLIPHPALEFFFYSTLMVIVMGVFILLAMQYTYVEDNDDEITITESEKKDVIALTEIESGTATSDKKE

SEQ ID NO: 20484 - protein, 501 aa, Amaranthus hypochondriacus
MAIRVPSRQLFIDGEWREPIKKNRIPIINPSTEEIIGDIPAATAEDVELAVAAARRALKRNKGEDWASASGAHRAKYLRAIAAKITEKKDYFAKLEAMDCGKPLDEAARDIDDVAGCFEYYADQAEALDAKQKAPIALPMDTFKCHVLKQPIGVVGLISPWNYPLLMATWKVAPALAAGCSAVLKPSELASVTCLELAEVCREVGLPPGVLNILTGLGPEAGGPLACHPDVDKVAFTGSTATGSKVMSSAAQLVKPVTLELGGKSPIVIFEDVDLDKAAEWTAFGCFWTNGQICSATSRLLVHESIAAEFLDRLVKWCKNIKISDPFEEGCRLGPVVSKSQYEKVLKFISTAKSEGATILCGGSRPEHLKKGYYVEPTIISDVSTSMQIWREEVFGPVLCQKTFGSEDEAIELANDTQYGLGAAVLSKDLDRCERITKALEVGAVWVNCSQPCFTQAPWGGTKRSGFGRELGEWGIENYLNIKQVTRDTSTDEPWGWYKSP

SEQ ID NO: 20485 - protein, 938 aa, Elaeis guineensis
MMSLLLRIFYFVIFLPFLAESRNPALNDDVLGLIVFKADLREPDSKLVSWNEDDDEPCCWTGIKCEPKTNRVTELSLNGFSLSGKIGRGLLQLQSLRTLSLSKNNFSGTLSSDLLRLESLRNLDLSENKLSGPIPDDFFGQCRSIRAISLAKNAFFGAIPSNVGFCSTLAALNLSSNRLSGSLPWRLWSLNALRSLDLSDNTLVGEIPVGISKMYNLRSISLHGNRLSGHLPDDIGDCLLLKSLDLAGNSLSGSLPESMRKLSTCSYLSLSSNFFSGEVPTWIGEMKSLETLDLSRNGFFGQLPGSLGDLQLLKALKLSRNGFTGSFPESLCSCKSLVDVDLSQNSLTGKLPLWVFESGLQQVLVSENKLNGSIVIPSSSASNLQVLVLSSNAFSGSIPEGLGKLKSLEVLDLSGNRLNGSIPLEIGGAVSLKELRLEKNSLKGAIPTQIGNCASLTSLDLSQNNLTGPIPPTLANLTNLQIINFSRNRLTGTIPKQLSNLPHLLSFNIAHNVLSGDIPSGSFFNTIPPSFLSDNPGLCGSIVNRSCPGVLPKPIVLNPENSSPNSSSGSTFSPSGLHHKKIILSVSTLIAIGAAAIIALGVITITVLNFRARASASQSAAALALSDDFLSQSPTTDANSGKLIMFAGGDPEFSAGAHALLNKDCELGRGGFGAVYKTMLQNGRPVAIKKLTVSSLVKSQEDFEREVKKLGKVQHPNLVALEGYYWTPSLQLLIYEFVSGGSLYKHLHESSASNALSWQERFDIILGTAKSLAHLHRLDIIHYNLKSAYILLDGSGEPKTGDYGLAKLLPMLDHYVLSSKIQSALGYMAPEFACRTVKITEKCDVYAFGVLVLEIQARKRLLEYMEDDVVVLCDMVRGALEEGKVAECVDGRLMWEVPHRGGHCSDEAGFDLHVAGSIESARHGGGGEHPGTYQMPSG

SEQ ID NO: 20486 - protein, 719 aa, Elaeis guineensis
EIPYNIGFLQVATLSLQGNRLTGKIPEVIGLMQALAVLDLSENELVGTIPPILGNLSYTGKLYLHGNKLTGPIPPELGNMTKLSYLQLNDNKLVGTIPAELGKLEELFELNLANNNLEGPIPQNISLCTALNKFNVHGNRLNGSIPLQFQKLESLTYLNFSSNNFKGKVPWELGRIINLDTLDLSNNHFSGPIPDSIGDLEHLLELNLSRNNLNGPLPTEFGNLRSGQTIDISYNKLSGPIPEELGQVQTIDTLILNNNDLYGEIPVQLTNCFSLSSLNLSFNNFSGDVPLSKNFSRFPQESFLGNPMLCGNWLGSSCGQDLHGSKVTISRAAVVCITLGCITLLSMMLVAIYKSSQPKQFIKGSNRTVQGPPKLVVLRMDMAIHTYEDIMRITENLSEKYIIGYGASSTVYKCVLKNSKPIAIKRLYSQYPHNLHEFETELETIGSIRHRNLVSLHGYSLSPHGNLLFYDYMENGSLWDLLHGPSKKVKLDWDTRLKIAVGAAQGLAYLHHDCNPRIIHRDVKSSNILLDENFEAHLSDFGIAKCIPAAKTHASTYVLGTIGYIDPEYARTSRLNEKSDVYSFGIVLLELLTGKKAVDNDSNLHQLILSKADDNTVMEAVDFEVRSPAWIWGCQKAFQLAICAQRSDRPTMHEVARVLVSLLPVPSLKPGLVPQKPMDYAHYLAAGPDVKIKRTHDDNSSSDGQWFLRFGEVISKNTL

SEQ ID NO: 20487 - protein, 481 aa, Elaeis guineensis
LTFVDLSRNNLSGEIPAEIAGIRILNYLNVSRNHLEGSIPPSIATMQSLTAVDFSYNNLSGLVPSTGQFSYFNVTSFVGNAELCGPYLGPCGFTNSSGSTHARGPLSASFKLLLGHWSPPLFHCLRHRRHHQKLGSFEEGRARPGHGSLTAFQRLDFTCDDVLDWLKEENIIGKGGAGIVFQGCDAQRRTVAVKKLPAINPGSSHEHGFSAEIQTLGRIRHRHIVRLLGFCSNHETNLLVYEYMPNGSLGEVLHGKKGGHLRWDTRYKIAVEAAKGLCYLHHDCSPLILHRDVKSNNILLDSDFEAHVADFGLAKFLQDSGTSECISAIAGSYGYIAPEYATLKVDEKSDVYSFGVVLLELVTGRKPVGEFGDGVDIVQWVRKVTDTNKEGILKIIDPRLSSVPLHEAMHVFYVAMLCVEEQSVERPTMREVVQILTELPGTPAKQGEDPPPPPPVGGETPPRESKPRQEQQSPPPDLLSI

SEQ ID NO: 20488 - protein, 556 aa, Lycopersicon esculentum
MPGMEAENSNASRAEELKQLANEAFKGHKYSQAIDLYTQAIELNGENAVYYANRAFAHTKLEEYGSAIQDGTRAIEIDPRYSKGYYRRGAAYLAMGKFKDALKDFQQVKKLCPNDPDATKKLKECEKAVMKLKFEEAISVPESQRRSVADSIDYRSVGSGPGSSYVPTKTTAVSAAAALMGVLVVYMGTKAATMVAAAASAALLVVLITFLWGRCSDGFFTKSRTLELEVEPQYAGARIEGDVVTLDFVKKMLDDFKNQKNLHKRYAYQIVLQTREMLRALPSLVDIVVPEGKHFTVCGDVHGQFYDLLNIFELNGLPSEDNPYLFNGDFVDRGSFSLEVILTLFAFKCMCPSAIHLARGNHESKSMNKIYGFEGEVRSKLSEIFVELFAEVFCCLPLAHVINEKVFVVHGGLFSVDGVKLSDIRAIDRFCEPPEEGLMCELLWSDPQPQPGRGPSKRGVGLSFGGDVTKRFLQENNLDLVVRSHEVKDEGYEIEHDGKLITVFSAPNYCDQMGNKGAFIRFEAPDMKPNIVTFSAVPHPDVKPMAYANNFLRMFS

SEQ ID NO: 20489 - protein, 197 aa, Brassica rapa subsp. pekinensis
SFTLPGLYRVVHGIDVFDPKFNIVSPGADMSIYFAYTEEKRRLTAFHLEIEELLYSDVENEEHLCVLKDKKKPIIFTMARLDRVKNLSGLVEWYGKNTRLRELVNLVVVGGDRRKESQDNEEKAEMKKMYELIEEYKLNGQFRWISSQMNRVRNGELYRYICDTKGAFVQPALYEAFGLTVVEAMTCGLPTFATCNG

SEQ ID NO: 20490 - protein, 142 aa, Brassica rapa subsp. pekinensis
KNLGVRPGEALAVNFAFVLHHMSDESVSTENHRDRLLRMVKSLSPKVVTLVEQESNTNTAAFFPRFKETMDYYDAMFESIDVTLPRNHKQRINVEQHCLARDVVNIIACEGADRVERHELLGKWRSRFGMAGFTPYPLSPLV

SEQ ID NO: 20491 - protein, 176 aa, Brassica rapa subsp. pekinensis
TSTRQEIDEQWRLYDGFDPILERKLRARIKRNVSCYGRFMPRMVKIPPGMEFNHIVPHGGDMEDTDGNEEHPTSPDPPIWAEIMRFFSNSRKPMILALARPDPKKNITTLVKAFGECRPLRELANLALIMGNRDGIDEMSSTSSSVLLSVLKLIDKYDLYGQVAYPKHHKQSDVPD

SEQ ID NO: 20492 - protein, 188 aa, Brassica rapa subsp. pekinensis
AGGVQFGWALQLSLLTPYVQELGIPHAWASVIWLCGPLSGLFVQPLVGHSSDRCTSKYGRRRPFIVAGAVAISISVMVIGHAADIGWAFGDREGKIKPRAIVAFVLGFWILDVANNMTQGPCRALLADLTGKVPDFSVDWVKGSKFGILVIIHSHAKHGNAQICDFGYNLGYWSIAIKRSLLCFWSVA

SEQ ID NO: 20493 - protein, 359 aa, Aedes albopictus
MYFTARYVRLEAKGFGAQGMVCAAYDTVTQQNVAIKKLSRPFQNVTHAKRAYREFKLMKLVNHKNIIGLLNAFTPQRTLEEFQDVYLVMELMDANLCQVIQMDLDHERMSYLLYQMLCGIKHLHSAGIIHRDLKPSNIVVKSDCTLKILDFGLARTAGTTFMMTPYVVTRYYRAPEVILGMGYKENVDIWSVGCIMGEMIRGGVLFPGTDHIDQWNKIIEQLGTPSPSFMTRLQPTVRNYVENRPRYTGYPFDRLFPDVLFPTDSNEHNRLKASQARDLLSKMLVVDPEHRISVDQALVHSYINVWYDESEVNAPAPGPYDHSVDEREHTVEQWKELIYQEVMEYEARNNLTDGEGTPR

SEQ ID NO: 20494 - protein, 325 aa, Aspergillus oryzae
MSNGKTFTLSNGVKIPGVGFGTFASEGSKGETYQAVTKALETGYRHLDCAWFYLNEDEVGDGIHDFLKKNPSVKREDIFVCTKVWNHLHRPEDVQWSVDNSLKRLRLDYVDLFLVHWPIASEKEDQEKPKIGPDGKYVILKELTENPEPTWRAMEKIYRDGKAKAIGVSNWTIPGLEKLFKFAEIKPHVNQIEIHPFLPNNELVQFCFKNDILPEAYSPLGSQNQVPTTGERVSENKTLNEIAQKGGNTLAQVLIAWGLRRGYVVLPKSSNPARIESNFKSIELTDEDFEAVNKVAEGRHFRFVNMKDTFGYDVWPEETAKNLSA

SEQ ID NO: 20495 - protein, 842 aa, Caulobacter vibrioides
MGRHGGPAAAGPTAPSAVRAKAVNAPSQVFVRIAILAALLLLAVYTAFGVHRLQREAMAQPGGAPLAAKADLIAGRVDANLAAQRAGLSAAADLLKRDPGATMDAAETTLRAAGGEAAAVAVVSEAGVVAVAGRDDGADWKAAALAAGASGRTNWVGSVGETGRLYVATTTSLDRARAFVIASGDASRLVADPEKGESGALALPDGKLIAARGRGVQGAGALREAFALSIEDLGDGPAAVRGQAADGALLDVAVRPVAQGALLAVAAAPTRSVANLDRQVMEGAFSLLVPLGVGIALALLLMIQSRKAEVAHREFIDSERRFRLAVEAARCGIWEWDLNGDQVYLSDVTGAMFGWGGGGVVSGQDLLERISIDHRERVRQALANAAMYGAFDVSFRVPASEQGARSLWIDARGQGFGKPGSEGHARIIGVALDVTEERIAQARAQAAENRLRDAIESVSEAFVLWDRQGRLLMCNRNYRSVFSLEPKILKPGAARAEVNRFAALAIKQDHPAPDGAKGVREAEMMDGRWIQISERRTAEGGLVMTAADITAIKTQEEARRRNEEQLQNAVAGLERSQEQLAELARKYETEKVKAESANKAKSEFLANMSHELRTPLNAINGFSEIMMNEMFGPLGDQRYKGYSQDIHSSGQHLLALINDILDMSKIEAGKMNLKFESMHLEDVAEDAVRLVRNRAEAAGLKLDIDFPQLPEIEADYRAVKQVLLNLLSNAIKFTPRAGSVTVRVEVRRDPFGDLIKVSVTDTGIGIAKEDLARLAKPFEQVESQFSKTTQGTGLGLALTKSLITMHDGVLEMHSTPGEGTTVSFTLPVRHSDQKITRDFVAA

SEQ ID NO: 20496 - protein, 191 aa, Chironomus tentans
MSSERGTRVYVGNLTDKVKKEQLEEEFTRFGKLNSVWLAHNPPGFAFIEFANKDEAISACDSLNGQELLGSKLRVEISKGKGRSNSRGGRGGGRFNDRRGGGGFRRDGDRFSDRSGGFRGRGRGFRSGGSGDRYGGSSGGGGGGPRSGGGGYDRGNRDSFSSGGGGGGYRSSGGGSSNRFRSRSPQGARRF

SEQ ID NO: 20497 - protein, 929 aa, Pseudomonas syringae
YRRTDTCCRRKSVLTKLGIKGRVLLLTILPASLMAAMLGGYFTWMQLSELQSQLLQRGEMIAQDLAPLAANALGRKDKVLLSRIATQTLEQTDVRAVSFLDTDRTVLAHAGPTMISPSPIGSGSQLLSSTGTDATRYLLPVFGSQRHLTSPIIPAEADTLLGWVELEISHNGTLLRGYRSLFASLLLILTGLAFTATLAVRMSRTINGPMSQIKQAVSQLKDGNLETRLPPLGSRELDELASGINRMAATLQNAQEELQLSIDQATEDVRQNLETIEIQNIELDLARKEALEASRIKSEFLANMSHEIRTPLNGILGFTHLLQKSELTPRQFDYLGTIEKSADNLLSIINEILDFSKIEAGKLVLDNIPFNLRDLLQDTLTILAPAAHAKQLELVSLVYRDTPLALSGDPLRLRQILTNLVSNAIKFTREGTIVARAMLEDETEEHAQLRISVQDTGIGLSSQDVRALFQAFSQADNSLSRQPGGTGLGLVISKRLIEQMGGEIGVDSTPGEGSEFWISLKLPKAREDKEESLNIPLGGLRAAVLEHHDLARQALEHQLEDCGLQTIVFNNLENLLNGVTAAHETPAAIDLAVLGVTALEISPERLRQHIWDLENLNCKVMVLCPTTEHALFQLAVHDVYTQLQAKPACTRKLQKALSELIAPRAVRADIGPPLSSRAPRVLCVDDNPANLLLVQTLLEDMGAEVVAVEGGYAAVNAVQQEAFDLVLMDVQMPGMDGRQATEAIRAWEAERNQSSLPIVALTAHAMANEKRSLLQSGMDDYLTKPISERQLAQVVLKWTGLALRNPAPERQNEALEVHVGPLVLDHEEGLRLAAGKADLAADMLAMLLASLDADREAIRVARANQDVHALIERIHRLHGATRYCGVPQLRSACQRAETLLKQNAPHTEEALNDLDKAIIRLEAEARVMA

SEQ ID NO: 20498 - protein, 256 aa, Saccharothrix mutabilis subsp. capreolus
MTAPTEPAGRADRPVALVTGASGAIGTAIATALAAAGFDLGVHHHTDAAGGRRTAAAAAALGARAVPVQGDLAREKACVAAVERVVESFGRLDVLVANAGRHRDALLLRLSEDDWDRHQEANLKSAYLCVRAALPSMLRQRHGRIVLVSSVAGLVGSPGQAAYSAAKAGLAGLARTVAHEHGRYGVTCNCVAPGLIADTPSHDGLSEARRRQILDRTAAQRAGRPEEVAAAVAFLSSPAAAYVTGQVLAVDGGMTA

SEQ ID NO: 20499 - protein, 303 aa, Physcomitrella patens
MDQYEKVEKIGEGTYGVVYKARDRLTNETIALKKIRLEQEDEGVPSTAIREISLLKEMHHGNIVRLQDVVHSEKRLYLVFEYLDLDLKKHMDTCPDLAKDPRLIKTFLYQILRGIAYCHAHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRTLGTPNEEVWPGVTSLPDFKTAFPKWPPKPLSSVVPSLEPAGIDLLEVCDLSTPASEFCVVLFFFIISTFSLIVRLKQCMQSYAS

SEQ ID NO: 20500 - protein, 511 aa, Lotus japonicus
MPGDPDNRHHHHPRSKNRPSTSSARPPPSRPPPARVPLRQLLRVASVASGIQFGWALQLSLLTPYVQQLGIPHQWASIIWLCGPVSGLFVQPLVGHLSDKCTSRFGRRRPFILAGAASIVVAVLIIGYAADIGWMLGDTESFRPAAITVFVIGFWILDVANNVTQGPCRALLADLTSKDNRRTRVANAYFSLFMAIGNILGYATGAYSGWYRIFTFTLSPACTISCANLKSAFFLDVAFIAVTTYVSITAAHEVPLNSSGAAHAGEGAGESGSTEEAFMWELFGTFKYFSSTVWIILSVTALNWTGWFPFILFDTDWMGREIYGADPNGGPNYDAGVRMGALGLMLNSVVLGVTSLLMEKLCRKRGAGFVWGISNILMAVCFLAMLVVTYVANTIGYVGKDLPPTGIVIAALIIFTILGFPLAITYSVPYALISKHTEPLGLGQGLSMGVLNLAIVIPQIVVSLGSGPWDQLFGGGNSAAFAVGAVAAIMSGLLAVLAIPRTGTQKPQIRV

SEQ ID NO: 20501 - protein, 304 aa, Plasmodium falciparum 3D7
MIKMSVLHRFYLFFLFTKFFHCYKISYVLKNAKLAPNHAIKNINSLNLLSENKKENYHYCGENKVALVTGAGRGIGREIAKMLAKSVSHVICISRTQKSCDSVVDEIKSFGYESSGYAGDVSKKEEISEVINKILTEHKNVDILVNNAGITRDNLFLRMKNDEWEDVLRTNLNSLFYITQPISKRMINNRYGRIINISSIVGLTGNVGQANYSSSKAGVIGFTKSLAKELASRNITVNAIAPGFISSDMTDKISEQIKKNIISNIPAGRMGTPEEVANLACFLSSDKSGYINGRVFVIDGGLSP

SEQ ID NO: 20502 - protein, 205 aa, Salmo salar
MSDEGKLFVGGLSFDTTEQSLAEAFSKYGNISKCDVIMDRETGRPRGFGFVKYDNPEDAKDAMDAMNGQSLDGRTIRVNEAGQGGGGGRGGGGGYRGSRGGGGYGGGGGYGGGERSYGGGGGGRSYGGEDRGYGGGGGGGYMERWRPRRVLLWWRIQGQSIGWAQEGYGDRSRPGILQRLLATTVNVMLHTSKTPIQDHPLAGCI

SEQ ID NO: 20503 - protein, 290 aa, Xenopus laevis
MSIRKVIKTVLSVEQSEGVGARVRRSIGRVELKNLDPFLMLDEFKGGKPAGFPDHPHRGFETVSYLLDGGSMAHEDFCGHVGRLDPGDLQWMTAGRGIVHAEMPCTTEPAHGLQLWVNLRSTEKMIPPQYQELKCSDIPKPSKDGVTVAVISGECMDIKSKVYTRTPTLYLDFKLEKNAQHTQAIPKGWTAFIYTLSGVISVGPPDAQQKIEAHHTAVLDDGDRAHFENQNEELSHFVLIAGEPIKEPVVQHGPFVMNTREEIAKTIEDFSLGINGFEHAHTWKSKIGKK

SEQ ID NO: 20504 - protein, 413 aa, Arabidopsis lyrata
SRRSFDFRLSSLHKGKAQGSSFREYSSSRDLLSPVIVQTSRWANLPPELLFDVIKRLEESESNWPARKHVVACASVCRSWRAMCQEIVLGPEICGKLTFPVSLKQPGPRDAMIQCFIKRDKSKLTFHLFLCLSPALLVENGKFLLSAKRTRRTTRTEYIISMDADNISRSSNSYLGKLRSNFLGTKFLVYDTQPPPNTSSSALITDRTSRSRFHSRRVSPKVPSGSYNIAQITYELNVLGTRGPRRMHCIMNSIPTSSLEPGGSVPNQPEKLVPAPYSLDDSFRSNISFSKSSFDHRSLDFSSSRFSEMGISCNDNEEETSFRPLILKNKQPRWHEQLQCWCLNFRGRVTVASVKNFQLVAARPSQPQGTGTAPATAPAHPEQDKVILQFGKVGKDMFTMDYRYPLSAFQAFA

SEQ ID NO: 20505 - protein, 72 aa, Bos taurus
NGSIYNPEVLDITEETLHSRFLEGVRNVASVCLQIGYPTVASVPHSIINGYKRVLALSVETDYTFPLAEKVK

SEQ ID NO: 20506 - protein, 141 aa, Bos taurus
LNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAAPTAAPAATTAAPAKVEAKEESEESDEDMGFGLFD

SEQ ID NO: 20507 - protein, 72 aa, Bos taurus
WDLTTGTTTRRFVGHTKDVLSVAFSSDNRQIVSGSRDKTIKLWNTLGVCKYTVQDESHSEWVSCVRFSPKEN

SEQ ID NO: 20508 - protein, 164 aa, Bos taurus
AAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEVRRILGLLDAHLKTRTFLVGERVTLADITVV

SEQ ID NO: 20509 - protein, 98 aa, Bos taurus
PGEDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIR

SEQ ID NO: 20510 - protein, 168 aa, Bos taurus
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKVG

SEQ ID NO: 20511 - protein, 157 aa, Bos taurus
PGEDRATWKSNYFLKIIQLLDDYPKCFIVGADNVGSKQMQQIACPPREGCGADGQEHDDAQGHPRASGKQPVWRNCLPHIRGNVGFVFTKEDLTEIRDMLLANKVPAAARAGAIAPCEVTVPAQNTGLGPEKTSFFQALGITTKDLQGTIEILSDVQ

SEQ ID NO: 20512 - protein, 99 aa, Bos taurus
QGTIEILSDVQLIKTGDKVGASEATLLNMLNISPFSFGLVIQQVFDNGSIYNPEVLDITEETLHSRFLEGVRNVASVCLQIGYPTVASVPHSIINGYKR

SEQ ID NO: 20513 - protein, 181 aa, Bos taurus
AAGTLYTYPENWRAFKALIAAQYSGAQVRVLSAPPHFHFGQTNRTPEFLRKFPAGKVPAFEGDDGFCVFESNAIAYYVSNEELRGSTPEAAAQVVQWVSFADSDIVPPASTWVFPTLGIMHHNKQATENAKEEVRRILGLLDAHLKTRTFLVGERVTLADITSCLHPVVLYKQVLEPSFRR

SEQ ID NO: 20514 - protein, 425 aa, Pinus taeda
MEGLKEFSPRLMIVSDLDNTMVDHHDPENISLLRFNALWEADYRHDSLLVFSTGRSPTLYKELRKEKPLLTPEITIMSVGTEITYGDSMSPDKGWEEVLNQGWDRGTVVKEASRFPQLKFQVETEQRPHKVSFYIEKTKSSEVINALSKRLEEHQLDVKIIYSGGIDLDILPQGAGKGQALAYLLKKFNSKGKSPQNTLVCGDSGNDAELFSVADVYGVMVGNAQEELLQWYEGNAKSNPKVILAHERCAAGIIQAMQHFNLDPNVSPRDIVGLSQTGAKYFLLGHEIVEFHLLCERWRRAEVEDSNEIFQRFKSAIDPNCSLLHPWGVEENLFTSIDVLRQCYGDQKGKQFRIWIDRIRPLKISLDIWLVRFDKWELIERERRCCCTTALLKVKPDAPNSLSWIHIHETWLDGCGSSTNLCCSI

SEQ ID NO: 20515 - protein, 422 aa, Aegilops speltoides
MDKLKGSARLMIVSDLDHTMVDHHDEENLSLLRFGALWESVYCQDSLLVFSTGRSPTLYKELRKEKPMLTPDITILSVGSEITYGEAMVPDHGWEEYLNNKWDRNIVLEETAKFSELKLQVETEQRPHKVSFLVDKKNAQGVIKSLSETFEKRGVDAKIIYSGGQDLDILAQGAGKGQALAYLLKKLGSCGKTPNNTLACGDSGNDAELFSIPGVHGVMVSNAQEELLQWHAENAKDNSKIIHATERCAAGIIQAIGHFKLGPNVSPRDVEFPYIKEDPFKPTAAIVKFYVLYEKWRRADVPKADSVIQYFKNITDANGVIIHPSGVELSIHSSIDELASCYGDKQGKKYRSWVDRLVILQTASDSWLVRFDLWEAEGAAWVCCFTTLALTVKPESPGGFVVTHIHKTWRKEYPGVEQSSKL

SEQ ID NO: 20516 - protein, 422 aa, Secale cereale
MDKVKGSARLMIVSDLDHTMVDHHDEENLSLLRFGALWESVYCQDSLLVFSTGRSPTLYKELRKEKPMLTPDITIMSVGSEITYGEAMVPDDGWVEYLNNKWDKNIVLEETAKFSELKLQAETEQRPHKVSFLVDKKNAQGVIKSLSEKFEKRGVDAKIIYSGGQDLDILAQGAGKGQALAYLLKKLGSCGKTPNNTLVCGDSGNDAELFSIPGVHGVMVSNAQEELLQWHAENAKDNPKIIHATERCAAGIIQAVGHFKLGPNVSPRDVEFPYIKEDSFKPTAAIVKFYVLYEKWRRADVPKADSVIEYFKNITDANGVIIHPSGVELPIHSSIGELASCYGDKQGKKYRSWVDRLVILQTASDSWLVRFDLWEAEGAAWACCFTTLALNVKPETPGVFVVTHIHKTWHKEYPGAEQSSKL

SEQ ID NO: 20517 - protein, 437 aa, Zea mays [sequence omitted]

SEQ ID NO: 20518 - protein, 422 aa, Hordeum vulgare subsp. vulgare
MDKVKGSARLMIVSDLDHTMVDHHDEENLSLLRFGALWESVYCQDSLLVFSTGRSPTLYKELRKEKPMLTPDITIMSVGSEITYGEAMVPDDGWEEYLNNKWDKNIVLEETAKFSELKLQPDTEQRPHKVSFLVDKKNAQGVIKSLSDKFEKRGVDAKIIYSGGQDLDILAQGAGKGQALAYLLKKLGSCGKTPNNTLVCGDSGNDAELFSIPGVHGVMVSNAQEELLQWHAENAKDNPKIIHATERCAAGIIQAIGHFKLGPNVTPRDDAFPYVKEDPFKPTAAIVKFYVLYEKWRRADVPKADSVIDYFKNITDANGVIIHPSGVELSIHSSIDELASCYGDKQGKKYRSWVDRLVILQTASDSWLVRFDLWEAEGDAWVCCFTTLALSVKPENPGGFVVTHIHKTWRKEYPGVEQSSKL

SEQ ID NO: 20519 - protein, 425 aa, Lycopersicon esculentum
MDRLTSAARLMIVSDLDHTMVDHHDSENLSLLRFNALWEANYRDNSLLVFSTGRSPTLYKELRKEKPMLTPDITIMSVGTEITYGNAMVPDDGWETFLNNKWDRKIVTEETSKFPELSLQSETEQRPHKVSFYVQKEKAQDIMKTLSKRLKERGLDVKIIYSGGMDLDILPQGAGKGQALAYLLKKLKSEGKLPSNTLACGDSGNDAELFSIPDVYGVMVANAQEELLQWHAANAKNNPKVIHASERCAAGIIQAIGHFNLGPSTSPRDVTDLSDCKMDNFVPAYEVVKFYLFFEKWRRGEIEHSEHYLSNLKAVCRPSGTFVHPSGVEKSLQECVTTFGTCHADKHGKQYRVWVDQVLPSQVGSDSWLVSFKKWELSGENRRCCITTVLLSSKNKTVADGLTWTHVHQTWLHDDASSDSASWFF

SEQ ID NO: 20520 - protein, 205 aa, Lycopersicon esculentum
MDRLTSAARLMIVSDLDYTMIDHHDPENLSLLRFNALWEANYRENSLLVFSTGRSPTLYKELRKEKPMLTPDITIMSVGTEITYGNSMLPDDGWEAFLNDKWDRKIVTEETKKFTELTLQSETEQRPHKVSFYVPKDKAQDIMKTLSKRLEERGVRCDNSKMMACLSCQCCSEQNFDKWRDGFRYFAARCWQRTSTRVFAEEIKE

SEQ ID NO: 20521 - protein, 261 aa, Lycopersicon esculentum
MALDILPQGAGKGQALVYLLKKLKSEGKLPNNTLVCGDSGNDAELFSIPDVYGVMVSNAQEELLQWHAANAKDNPKVIHATERCAAGIIQAIGRFNLGPSTSPRDVTDMSDSKMENFVPAYEFVKFYLFFEKWRRGEIENSDLYLSNLKAVCRPSGTFVHPSGVEKSLEECVNTLKKCHGDKKGKQYRIWVDQVLPTRVGSDSWLVSFKKWELCGEERQCCITTVLLSSKNVTVQTGSIDTRASDLLQGVKSASDSPTWFF

SEQ ID NO: 20522 - protein, 285 aa, Brassica oleracea
STEANKAAISILVRNLAHGSELAAGEIRVLTRTVTETRTLIVEAGAIPYLRSLLKSENAVAQENAVASIFNLSIDEANRSLIMEEHDCLEPIMSVLVSGLTMRAKEIATAALYTLSSVHDYKKTIANADGCIESLALVLRNGTVRGKKDAVYALHSLWLHPDNCSLVVKRGGVSALVGALGEESVAEKVACVLGVMATESLGAESIGREETVVTGLMELMRCGRPLGKEKAIATLLQLCTLGGAVVTEKVVKTPALAVLTRKLLLTGTDRAKRKAVSLSKVCKGC

SEQ ID NO: 20523 - protein, 320 aa, Homo sapiens
MPHIDNDVKLDFKDVLLRPKRSTLKSRSEVDLTRSFSFRNSKQTYSGVPIIAANMDTVGTFEMAKVLCKHLAASSGTGSSDFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYAGGVAEYRASEGKTVEVPFKGDVEHTIRDILGGIRSTCTYVGAAKLKELSRRTTFIRVTQQVNPIFSEAC

SEQ ID NO: 20524 - protein, 104 aa, Brassica rapa subsp. pekinensis
YSSMFHPFNGSMDAEERRHISSTTEHSAIDNHCSANSSSVGRTQQSLQREAALNKFRMKRKDRCFDKKVRYESRKKLAEQRPRIKGQFVRQVQSTETSTQEAPQ

SEQ ID NO: 20525 - protein, 157 aa, Brassica rapa subsp. pekinensis
YPEWQHVKVSSPPPGRWGHTLTCVNGSNLVVFGGCGQQGLLNDVFVLNLDAKPPTWREISGLAPPLPRSWHSSCTLDGTKLIVSGGCADSGVLLSDTFLLDLSIEKPVWREIPAAWTPPSRLGHTLSVYGGRKILMFGGLAKSGPLKFRSSDVFTMD

SEQ ID NO: 20526 - protein, 212 aa, Bixa orellana
IGDGAMTAGQAYEAMNNAGYLDANLVVVLNDNKQVSLPTATLDGPATPVGALSSALTKLQASTKFRKLREAAKNITKQIGGQAHEVAAKVDEYARGMISASGSTLFEELGLYYIGPVDGHNIEDLVTIFEKVKAMPAPGPVLIHLVTEKGKGYPPAEAAADKMHGVVKFDPTTGQQFKTKSSTLSYTQYFAESLIREAEVDDKIVAIHAAMG

SEQ ID NO: 20527 - protein, 317 aa, Lycopersicon esculentum
MPVFKTPFNGYSVKFSPFYENKLAVATAQNFGILGNGRVHILQLNPNGPVSELAAFDTADGVYDVCWSEAHDSLVIAGSGDGSVKLYDLSLPPTNNPIRSFKEHTREVHSVDYNTVRKDSFLSASWDDTVKLWTVDRNASVRTFKEHAYCVYSAAWNPRHADIFASASGDCTTRIWDVREPGSTMILPAHEFEILTCDWSKYDDCIIATASVDKSIKVWDVRNYRVPISVLNGHGYAVRKVRFSPHRASAMVSCSYDMTVCMWDYMVEDALIGRYDHHTEFAVGVDMMSVLVEGLLASTGWDELVYVWQHGMDPRAS

SEQ ID NO: 20528 - protein, 430 aa, Mus musculus
MALRVTRNTKINAENKAKVSMAGAKRVPVTVTAASKPGLRPRTALGDIGNKVSEELQARVPLKREAKTLGTGKGTVKALPKPVEKVPVCEPEVELAEPEPEPELEHVREEKLSPEPILVDNPSPSPMETSGCAPAEEYLCQAFSDVILAVSDVDADDGADPNLCSEYVKDIYAYLRQLEEEQSVRPKYLQGREVTGNMRAILIDWLIQVQMKFRLLQETMYMTVSIIDRFMQNSCVPKKMLQLVGVTAMFIASKYEEMYPPEIGDFAFVTNNTYTKHQIRQMEMKILRVLNFSLGRPLPLHFLRRASKVGEVDVEQHTLAKYLMELSMLDYDMVHFAPSQIAAGAFCLALKILDNGEWTPTLQHYLSYSEDSLLPVMQHLAKNVVMVNCGLTKHMTVKNKYAASKHAKISTLAQLNCTLVQNLSKAVTKA

SEQ ID NO: 20529 - protein, 358 aa, Cryphonectria parasitica
MAEFVRAQIFGTTFEITSRYSDLQPVGMGAFGLVCSARDQLTNQNVAIKKIMKPFSTPVLAKRTYRELKLLKHLRHENIISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLASKFKNADEQAVDLLERMLVFDPKKRITASDALAHEYLAPYHDPTDEPVAEEKFDWSFNDADLPVDTWKIMMYSEILDYHNVDASGASAAMGEFNGQ

SEQ ID NO: 20530 - protein, 397 aa, Xylella fastidiosa Temecula1
MSASFSPHTITLIKSTVPLLAEHGTTIIEAMYHRLFEDPQIEALFNQANQKNGTQIHALAGAILAYARNIDNPGVLASAIERISQKHVGYAIHPEHYPHVATALLGAIKQVLGDVATSEVLEAWGEAYWFIANLLKDREAVIREGIMTKNGGWIHWRRFVISKRIPESETITSFMLHPEDGGPVVPHQAGQYLTFRFDAAGMPGMKRNYSISCGPNSDHYRITVKREHGTGASAFLHDQAKVGTIIECTPPVGDFFLPSVIERPIVLLSGGVGLTPMVSMMEQIAEAYPDAQVWYVHGTQNRETHAMDAHIRALVSRHKHMKATTFYTQRSEADDAEAGFITIDWLRANTPFQKADFYLCGPRPFLRTFVRDLIGAGVPAAQVHYEFFGPMDEEMAA

SEQ ID NO: 20531 - protein, 610 aa, Xylella fastidiosa Temecula1
MGVSMNTVTFPSQGGIDRRRFLKGLALGGVVAGTGLWRLPVHAANPELPPLQRRTTPLELRIGQSSVNFTGRMRPAITVNNSLPGPVLRWRQGDTVQIHVTNTLPDVMTSIHWHGIVLPSNMDGVPGMSFDGIAPGEHYLYRFQLHQSGTYWYHSHAMFQEQAGLYGALIIDPLEPPPYRADREHILLFSDWTDLDPAALFRRLKKMSSYDNTYQRTVRDFFHDIHRDGLRTTLADRRMWGRMRMTPTDLSDVNAHTYTYLLNGTTPAGHWTGLFRPGEKVLLRLINGSAMTYFDVRIPGLKLTVVAVDGQYVHPVTVDELRIALAETYDVLIQPHGQDAFAIFAQDMGRTGYACGTLAVRPGLHAPLPALDPRPRLTMQDMGHGMTHDQHGSRVSEMADIPGMTHPGRLGDHASHANQPPAQPPHGLHSLPADRTAPQHPASEQNNPLVDMHVDAPQPRLNDPGIGLRDNGRHVLTYADLHSLFDDPDGREPGREIELHLTGNMEKFAWSFDGIPFASAQPLRLNYGERVRIVLVNDTMMAHPIHLHGLWSDLEDANAAFQVRKHTIDMPPGTRRSYRVRADALGRWAYHCHMLYHMESGMMREVQVRP

SEQ ID NO: 20532 - protein, 409 aa, Xylella fastidiosa Temecula1
MTGSHQPRSLNGQRLLLCVSGGIAAYKSLELVRRLCGAGAQVQVAMTASAQQFVTPLSFQALSGQSTRTTLWDGNAEQAMGHIELARWAERVLIAPASADVIARLAHGLADDLVTTLCLATTAPLIICPAMNHNMWLHPATQANVAMLLGRGVQVIGPEDGPLAEGVSGLGRMSEPEAIVVALVQGVSPAPVHGGLFHGQRIVISAGPTFEDLDPVRYLGNRSSGKMGFALASAAVSHGAEVVLVAGPVYQPTPPGVIRVDVRSAAQMRDAVLSAFPADVYIGAAAVADYAPKSVLPQKIKKSGQTLILELVRTQDILSEVAAQTANLKFVVGFAAETHDVACYARGKLAAKHLDLIIANQVGIVGNGFESDDNAVTAYWQGGERVFASCSKVELAERLLALIAERMQT

SEQ ID NO: 20533 - protein, 251 aa, Xylella fastidiosa Temecula1
MEHVSMITDDSPRFRALVTGGSGNLGTAICRQLIADGAHVIVHANHHRSRADTLVECLCAEGGSAEVIVFDVTAAQASKTALENLLQAGPIQIIINNAGIHDDAPMAGMSSTQWHRVIDVSLHGFFNVTQPLLLPMARTRWGRIVCISSVTAVLGNRGQSNYAAAKAGLHGAARSLAREMANRGITVNVVAPGVIESEMVGKTFTPEMIKQLVPTGRPGRPEEVAALIGFLCSEKAGYINGQVIGINGGMV

SEQ ID NO: 20534 - protein, 480 aa, Xylella fastidiosa Temecula1
MNTHPQTSPNTHYKIADISLADWGRKEIDIAEHEMPGLMSIRRKYASKQPLKGVRVTGSLHMTIQTAVLIETLKDIGADVRWASCNIFSTQDHAAAAIATSGTPVFAWKGETLEEYWDCTLQALTFTLADGTLTGPELIVDDGGDATLLIHKGYELENGSTWVDEPSDSLEEQVIKRLLKRIAIERPGYWTRVVNDWKGVSEETTTGVHRLYQIAATGRLLVPAINVNDSVTKSKFDNLYGCRESLADGLKRAMDVMLAGKLAVVCGYGDVGKGSAHSLRAYGARVIVTEIDPICALQAAMEGFEVTTVEDTLGQADIYVTTTGNKDVIRIEHMTAMKDQVIVCNIGHFDNEIQVDALNALTGVQKINIKPQVDKFILPNGNTLFLLAEGRLVNLGCATGHPSFVMSNSFANQTLAQIDLWQNKDVYEKNVYRLPKKLDEEVARLHLEKIGVKLTTLTANQAAYLGISVEGPFKPEHYRY

SEQ ID NO: 20535 - protein, 394 aa, Xylella fastidiosa Temecula1
MTKPIRNVAVLGATGSIGAAALDVLARHPRQFHVSLLAAGQRVDALLALCRTYRPDHAVIGDATLYTTLRDGLNAAGLATKAYAGEAALAELVASTTCDTVVAAIVGAAGLHSTLAAARAGKRLLLANKESLVLAGMLLMREASISGAEIIPIDSEHNAIFQCLRSRTTDGVHRVTLTASGGPFRGHNRTMLAKITPTQAMAHPTWSMGPKISVDSATLMNKGLEVIEAHHLFGLPSEQIDVLVHPQSLVHSLVEFIDGSTLAQLSLPDMRTTLAVGLAWPERIGSGVQGLDLMKHNRLDFEHPDTETFSCLRLARDAMQTGGTAPAVLNAANEIAVSAFLQGRIGFLTIPALIEHALTTLPRYEADTLETLLTVDTETRRITHAALTHFPLPL

SEQ ID NO: 20536 - protein, 663 aa, Xylella fastidiosa Temecula1
MVLLSDLGVSLALMLAIVMHPQISHVRRCIGIIADYTSLTVLMLLMGEAGSPLYVLCLWVTIGNGLRYGSVYLLVTTTLGALSFLTVILVSAYWKSNPFLAWGLLIGLIAIPWYFQSLLKALIQALNDARHANEAKSRFLANMSHEFRTPLNGLSGMTEVLATTRLDAEQRECLKAIQASVHSVLSLIEEVLDISRIEAGKIRILHDTFSLKEVIGSVGLILQPQIRNKALEYRVDVGLDVPEWLFGDAGYVRQVLLNIVGNAVKFTERGRITLCVSVLNRSRQHSVVLRFEVADTGIGVPLGMRNRLFDVFEQADVGLDRRYQGSGLGTTIAKGLIELMGGSIGFEENVPCGSLFWFELPFELAKKQVVAQEVSEASQCTEPSNVIAFSNPFLRHRARVKSMRVLVADDHETNRMVLSRILDKAGHKLLCVDGAEAVLDCLISMEFDVVIIDLHMPGMSGLDMLKQLRVMQSSSLPYTPVLVLSADATSDSIRCCEEAGARAFLSKPVLATKLLDVLAEIAEGDGGALPYAALSQSSVQQHQVFDPAGLDDLAELNMDDDFEERFIVQSFRDAEHCQQTMLSAAETNQWQEVREEAHALRGVLGHLGLMRASSLAAELMRIPDWQLQLEWCALVQMLDEALLCGRDALEARRQERRRSGVLR

SEQ ID NO: 20537 - protein, 868 aa, Xylella fastidiosa Temecula1
MSASPTAERWIVLKFGGTSVSRRHRWDTIAMVVRKRLEEHGTRVLIVVSALSGVTNELTAIAQGVVDSAKRVTALEQRHRDFLVELGLDAQAVLGTRFAMLSDLLQDARAVTRSLDWQAELLGQGELLSSTLGAAYLGASGIDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTGVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQICKVKIIVPCAAITLVGRGMRSLLHKLSEVWATFGKERVHMISQSSNDLNLTFVIDETDADGLLAVLHFKLIESGAMPVQDRAVFGSPWREIIGHVRTRVMPWWHSARMRLLAMRDEEGIGPCYVYHLPTVRERARQLNAVAAVDQCYYAIKANPHPAILRTLIEEGFGLECVSLGELRHVFEVVPHLVPSRVLFTPSFASRVEYEQAFLLGVNVTLDNVEALRLWPEVFRERTLWLRIDLGYGDGHHEKVTTGGKTSKFGLSVTRIDEFIDVAKTLNITVTGLHAHLGSGVESGNHWSRMYDELAGFASRIGSVSTLDIGGGLPIPYRPDDEPFDVGAWGASLAEVKALHPKFQLVIEPGRFLVAEAGVLLTRVTQVIEKDDILRVGLEAGMHTLIRPALYDAWHGVENLTRLDETPHVLCDVVGPICESSDVFGRRRHLPAATASGDLMLIADAGAYGFSMASTYNLRGLPAEVVLDA

SEQ ID NO: 20538 - protein, 799 aa, Xylella fastidiosa Temecula1
MALNGASYLNENILWLHELRLTDLARVGGKNSSLGEMIGNLTALGVSVPGGYATTAAAFKAFIAYNNLSKRIYDKLATLDVEDVKALTAAGKEIRDWVIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFREVVFVTASFGLGEMVVQGAVNPDEFYVYKKTLKAGKPAILRRTLGTKLVRMVYSDAPGERVKIEDTPTELRHCFAISDADVQELARQALIIEQHYGRPMDIEWAKDGISGKLFIVQARPETVKSRSHTTQIERFALQQPGQILTEGRAIGQKIGSGTARVVNSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNPAVKKLLSMAIKAARSKGKYIGICGQGPSDHPDLAEWLMQEGIESLSLNPDTVVDTWLRLAKLKTVH

SEQ ID NO: 20539 - protein, 430 aa, Xylella fastidiosa Temecula1
MTVIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGTEIFHALKSVLKGQGLSTAVGDEGGFAPDFRSNVEALDAILEAIGRAGYIAGEDVLLGLDVASSEFRNNGKYNLVGENKRLTSEQFVDFLDDLVAQYPIISIEDGLAEDDWVGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 20540 - protein, 1190 aa, Xylella fastidiosa Temecula1
MRCLKRVRGGLLTALLVFVSLLTATAAVPEMPRFRVLDATSGLPSNVVRAMLQDAAGYLWLATSDGLARYDGTAFKVWRHDPNDPGSLPGDSVLALYIDVQDRIWVLSENAGLAVLDAQRRRFIQIPVGSVAKTDALHTLTGHGDAIWLSDLHASVIRIDSAGALTRYALADVSPTLKDTPVVALTFDANGRLWVGTPDGLLYFEAGRLHLAPPPLDKTSIHSIAAVGSRLWVGSTDGVYLQDAEGRWRAPNWGPMFAFGNLLLSVADAGDGEFWLGSERGLWRTRQERPPVQIPLSDMHHGVSTVSSLWRDTSGGLWVPVYGRGLGYLRQDWKRMAVVRPSDGGESAYCNVAPAAYSGGLWQLNRIGELMHLNTSTGELVHTGWQRHELRGVNITATLEDSRGRLWLANMQNGLSRLDLKNGQWREWAAHGDDAVPLYGPISWIVEMPDSSLWLEALGVLQQRDLESGRVLNQIVPGSHGLDGSRVEQIGLGPDGRLWLAAGSGVYAWESQRRMFVPIPDLTGTRAYSFVPVGGNEVWVHRLRGLEQWRHSSHGWKRVALVGPQHGLPAMESLGMQHDAQGRIWLSTRRGLWRIDNTDELQVRNFGLRDGLGTQEFAEACLWMAPDGVLVGGTTDGYLMLFDTAMPDPAPFVPQLRMETVSVIRAGHRIDLPVDQPFELLPNDRQLIVGARLLSFGDPLSNRYSYWLKGFDTGWIDQGSSGTREFSSLPPADYTLLIQGTDPMGNLSRIHLVTFRVLPPWWRSAWGMSVLTGSGLLLLWGVAWNYHRRLRRRARLQLEQHQREVAERASLAKTQFLATLGHEVRTPMTGVLGMSELLLETPLDTRQHGYATSIQAAGKHLLRLVNDALDLAKIEAGKLSLERRDFDFHALLEQVVAMIRPMVERKGLRFVYRLDPEVPQYVHGDADRLQQILLNLLINATKFTEHGEVVLQVAPGQEQACLGVRIDVADTGPGLSEEQCQRLFRRFEQVNGASTAARYGGSGLGLAICRELATVMEGEIHVDSELGKGTCFRVLLPLPWVLAVQPAVAVMDMEPSPCSNPLHLLLIEDDPTVAEVIVELLRARGHRVTHALHGLEALVEVTLTRFDACLCDLDLPGLDGAGLIVQLRAQGQSFPIVVVTARTDADAQRQAFHVGCDAFLRKPVTGEMLEQVLTQVLSAPRQDADVDTPT

SEQ ID NO: 20541 - protein, 623 aa, Xylella fastidiosa Temecula1
MRSPIMSNERTAQQSDIKQLISKGLEQGYLTYAEVNDHLPEDLVDPDQIEDIIGMINGMGIEVHEVAPDAETLLLNEGNTGNREVDDTAAEEAAAALSALDTEAGRTTDPVRMYMREMGTVELLTREGEIAIAKRIEEGLSEVQAALGAFPLSTELLLSEYELHKEGKRRLTEVVVGFNDLIEEDNSVTSSVDVTDESIVEVDEEDDDSVGNDEDAPMIGPDPAEVASRIESLSTEYAKFKKLYAKHGPEHKAVIKVREDVAAIFVTFKLSLPLTDLLVQQLQNMVNSVKDHERKVLHLATNVAKMPRKDFIRSWENNQTNLEWVEDAIKRKQKWSSALRDIKDQITAEQQASIDLEKVNSLTLADIKEINRMMVYGEAKASKAKKEMVEANLRLVISIAKKYTNRGLQFLDLIQEGNIGLMKAVCKFEHRRGFKFSTYATWWIRQAITRSIADQARTIRIPVHMIETINKLNRISRQMLQQFGREATPEELAKEMDMPEDKIRKVMKIAKEPISMETPIGDDEDSHLGDFIEDPNVESPVDTTTNVNLSETVREVLAGLTPREAKVLRMRFGIDMNTDHTLEEVGKQFDVTRERIRQIEAKALRKLRHPSRSEQLRSFLDID

SEQ ID NO: 20542 - protein, 575 aa, Xylella fastidiosa Temecula1
MNVRLQGHGAARGTALGRAWVRQMNIIEIQDKYITDTNAELHSLYQAMSAARQEIQVLRERMHGTLSHEVGEFLDLYTLLIDDPELLRSLNELILTHNYSAEYALKIQRDRLTTEFEAMEDHYLKSRMDDLNHVLGRIHAFLKKHSPEPKDAAGEILICNNIAPSELAQVQAQGIIGIVIAAGNTLSHSAILAHSLHLPLIVGAGELLLQKITNGDMLIIDGNSGEIIVNPSPQDLRHYHSRLRERAKEQRELEQLRSKHSRTRDNVDIVVQANAESPDDVSQAYALGAAGVGLYRTEFLFLQRNKLPDEEEQFQTYRDTVLRMNGRPVTIRTLDLGADKTDCTGLTLSNEENPAMGLRGIRLSMAHPAVANTQLRAILRTSTYGHVRILVPMVSCREEIILLRKQIKALSIQLRTEGHDIAEQVPLGAMIEVPAAAIALNSFIKEIDFLSIGTNDLVQYLLAADRNNAAISEIYSPLHPGVLAVLAQIIVTAHTHATPVAICGEIAGDPHYVPMLLALGLTEFSLHPATLLEVRRAIRNSDLGTLKTSVTTLLRARDRKSIEEWMAAHANTTPT

SEQ ID NO: 20543 - protein, 245 aa, Xylella fastidiosa Temecula1
MSDPSKVALITGGARRIGKAIVHHLHAHGYRVAVHAHQSGHELHAFLTELERTRPSITLALLGDLHENAVPETLIARCAGHFGRLDVLINNASNFYPTPLGEVTPAQWDDLFAINAKAPFFLAQAATPLLRKHRGAIINLTDLHGTQPLRQHAVYTAAKAALEMLTRSLALELAPQVRVNAIAPGAILWPTQGIAEAAKQALLARTPLARTGTVEEIAEAVLWLLESANFITGHTLRLDGGRTLT

SEQ ID NO: 20544 - protein, 336 aa, Salmonella choleraesuis
MNNKKVLMDISWSNKGGIGRFTDEISKLLCDISKEELYRKCASPLAPLGLAVNIFLRKKTDVVFLPGYIPPLFCSKKFIITIHDLNHLDLNDNSSLFKRLFYNFIIKRGCRKAYKIFTVSNFSKERIVAWSGVNPNKIVTVYNGVSSLFNADVKPLNLGYKYLLCVGNRKTHKNEKCVISAFAKADIDPSIKLVFTGNPCNDLEKLIIQHGLSERVKFFGFVSEKDLPSLYKGSLGLVFPSLYEGFGLPVVEGMACGIPVLTSLTSSLPEVAGDAAILVDPLSEDAITKGISRLINDSELRKHLIQKGLLRAKRFNWQNVVSEIEMVLTEACDGNK

SEQ ID NO: 20545 - protein, 549 aa, Xylella fastidiosa Temecula1
MVSCMHSIQIVLAMLLVVAASGYLVRIIPFSMPLPLLQIALGAVISGVFDGGYELQPEAFFLLFLPPLLFLDGWRIPKQGLFRDKNVILELALGLVVFTVLGIGFLIHWMIPTMPLPLAFALAAILSPTDPVALSSITSRVPIPKRMMHILEGESLLNDATGLVCFQFAVAAVLTGHFSLATASLTFVWVLVVGLSLGIATTYVLSRVQRWVWRHFGGEPAAAILFNLLTPFAAYLLAESMQASGILAAVAAGITMSYVELSGNAQATIRVQRWAVWETVQFTFNGIIFVLLGEQLPGILDDLVHSAQQAGYMNVGWLLVDVAVISAGLMLLRFLWVWLSLQWNLFKAVCCGKQRISPPWQIVVAMSLSGVRGAVTLAGVLTLPLLMPDGTPLPARQLVIFLAASVILVSLLLASVALPYLLRGLELPEKSSYDKEEDFARRVSAQAALEAVERLRQRLVEDSANAERYNEAAHQVSQLYQRKLGAVDLANVDPQETKVFEQVVRRFRQVGLAAERDELFRLAREHNISDELLQRMVRNLDLIEARRRS

SEQ ID NO: 20546 - protein, 112 aa, Xylella fastidiosa Temecula1
MKLITAIIRPFKLDEVREALSKVGVSGITVTEVKGFGQQKGHTELYRGTEYVIDFLPKIKIEMVVTDEHLDAVIEVIRIAAVTGKIGDGKIFVTKIEQVVRIRTGEIDIDAL

SEQ ID NO: 20547 - protein, 635 aa, Xylella fastidiosa Temecula1
MIDFTCYPRLSRIQTPEDLRAFQESELRAVADELRNYLIESVGLSGGHFAAGLGVVELTIALHYLYCTPIDQLVWDVGHQTYPHKILTGRRDKISTVKHQGGLAPFPKREESIYDTFGVGHSSTSISAALGMAIVAQRNGDERKVVAIIGDGAMTAGMAYEALNHAGGMSPAPNLLVILNDNRMSISEAVGGLTKMLGRATGSKALNAIREGGKRIFGDKKTNATARFLRRWEEHWKGMFVPSTLFEEMGFHYTGPIDGHDLPALLGALKTLRTLKGPQLLHVITTKGKGYELAEGDQIGYHAVAPFDPQKGLIKAGAKKQTYTDVFSEWLCDMAAVEPRLLAITPAMREGSGLVRFSQEYPQRYFDVAIAEQHAITLAAGMATQGAKPVVAIYSTFLQRGYDQLVHDVALQKLDVLFAVDRGGVVGPDGATHAGNLDLSFLRCVPNMMLMAPADEAECRKMLSTGFHYSGPVAVRYPRGTGPGVVPSAELDVLPVGVAQLRHSGTRIALLGFGVCVAPAEQVGRRLGLTVVNMRFIKPLDRTLLLELARTHEVFVTIEDNVVAGGAGSGVAELLNAEGIVLPIVHLGLPDAFQQHASREDLLAEAGIDAAGVYAALLSRWPDLAVQNHPLSAVS

SEQ ID NO: 20548 - protein, 303 aa, Xylella fastidiosa Temecula1
MSEDGGVTTDERACAAPLQLSNTFPRVSRHAVQTGLSPHPRVRNVIAVGSGKGGVGKSTIAVNLAVALQRTGVRVGLLDADIYGPSVPAMLGLSGRPESPDNKLIEPLRAFGIEAMSIGLLIDVDTPMIWRGPMATSALTQLFNDTLWGDLDYLLIDLPPGTGDIQLTLSQKIPVAGAVIVTTPQDIATLDARKALKMFEKVNVPVLGIVENMAMHCCRQCGHVEHLFGEGGAQRMAEHYHVPLLGSLPLDIVIREHGDLGQPITVAAPKGSVGQAYAAVAACLAAELAKRPRAAIPMTTTLG

SEQ ID NO: 20549 - protein, 485 aa, Xylella fastidiosa Temecula1
MLRILAEALTYDDVSLVPSHSTVLPKDVKLETRLTRNIRLKLPILSAAMDTVTEARLAIVMAQLGGIGIIHKNLTIEQQVAEVTKVKKYESGVIRDPITVDPETSIRDVLALTRAKNISGVPVVDKGQLIGLVTHRDMRFERELDDPVRHIMTKKEALVTVKEGADSQEVLQLLHKHRIEKILVVNDAFELRGLITVKDIQKKSDYPNAAKDAVTRLLVGAAVGVGGETEKRVETLATAGVDVIIVDTAHGYSQGVLDRVAWIKRYFPQLQVIGGNIVTGDAALALMDVGADAVKVGVGPGSICTTRMVAGVGVPQITAVQMVSDALQDRIPLIADGGIRYSGDIGKALAAGASTVMIGGLFAGTEEAPGDVELFQGRTYKSYRGMGSLAAMEKGSKDRYFQEASDVDKLVPEGIEGRVPYRGSVSGIVHQLMGGLRATMGYVGCATIEEMRTKPQFVKITGAGQVESHVHDVQITKEPPNYRMR

SEQ ID NO: 20550 - protein, 261 aa, Xylella fastidiosa Temecula1
MRTMTQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDLYYYEQVIERTPMRRIGEPEEVAAAVAFLCLPASSYVTGECIAVDGGFMRYGF

SEQ ID NO: 20551 - protein, 499 aa, Xylella fastidiosa Temecula1
MQIVLDDGQPVDGIFRLTNASFGRHLRLDSVVGESVCGIMPDDGPEYIKRYGGVALSGQRVHFEARALRRWYSVEVMRVGAPEGRLLGVLFVDITEHKRMERRLAESEVRFNILADGLPMPVWVFDAQGGMRFVNTAYGEFFGVDLSSGTLPEWSMVLHPEDVLIFEFKLSAALKTQSALRALVRARRYDGQWRWIEMSATPRYSPDGHFIGLTGSSQDVTERLEIELAREQLLKSERAARNEAENMARLKDEFLSTLSHELRTPLTTILGWSELLLQRIEEQHPCYKGLSVIASSAKVQKRLISDMLDLSSMLLGKMQLEMEVLDLVEQIREVIGLYEQVVESKGQRLLLRAPEMPCLVLGDATRLRQIFENLLSNAIKFTPTDGCIDVEIDADGDSFRVSVTDSGDGIAAEFLPHLFSRFRQADGTTTRCHGGLGLGLAIVQSLVEMHGGYVGATSPGLGKGAMFTVSLLRYVCAINVADTVICDRRFGSVGDQGEY

SEQ ID NO: 20552 - protein, 448 aa, Xylella fastidiosa Temecula1
MISRFGSEVRPTLLLALPLVLGHVSTGLIGFVLNVIAGHHSTVTLAASTIGTALLWLPMLVPMGTLISLTVLVSQLHGAERERDIGPLFRQALWLAMLLGLVMFTFLSVVPALLPLFGIVPDIVPGAAKFLHVVRWGSLAFPLYFCMRYFCEGMHCTFPTMLLGFGGLLVLVPLSYALTYGRFGFAEYGVEGLGIATVTVMWLQAVVFALYLWRSRRFAHLQLFAHLELPCWARIRDLLNIGLPIGISILMEGGLFIVTTLLIGRFGTDEIAAHQIALSVAQLCFMIPMGVAEATTVRIGHAVGRCDLLVMRRVAWAGYAIVIGTQTLSASVLLLGYDVIVAAYTDDLVVASLASKLLLFAAIFQFPDGLQMLSSGVLRGMKDTRVPMLLAMISYWGLGMPLGLGLGFALEWNSRGMWIGLIIGLTAAALLLGWRFRVVSERMFAGIP

SEQ ID NO: 20553 - protein, 293 aa, Xylella fastidiosa Temecula1
MGYLSMTRNTSMVLVGNNFPVPNALGSLEAYISAVHQISVLSVDEEQLLARRYRDQQDLDAARELVHSHLRFVVRVARGYSGYGLSLGDLIQEGNIGLMKAVKRFDPDMGVRLVSFAMHWIRAEMHEFILKNWRIVKVATTKAQRKLFFNLRKSRTRLGWMNAEEVSAVARDLNVSEREVLEMESRLSGRDIGFDAPEEDNAPPSPVGYLIANDGDPSQAYERGNSEETQLRLLQEGLSVLDTRSRDIIQRRWLETDKKITLQELAEEYGVSAERIRQIEANALKKMKVLFAA

SEQ ID NO: 20554 - protein, 177 aa, Lycopersicon esculentum
MPRERDPLVVGRVVGDVLDPFTRTIGLRVIYRDREVNNGCELRPSQVINQPRVEVGGDDLRTFFTLVMVDPDAPSPSDPNLREYLHWLVTDIPATTGSSFGQEIVSYESPRPSMGIHRFVFVLFRQLGRQTVYAPGWRQNFNTRDFAELYNLGLPVAAVYFNCQRESGSGGRRRSAD

SEQ ID NO: 20555 - protein, 175 aa, Lycopersicon esculentum
MPRDPLIVSGVVGDVVDPFTRCVDFGVVYNNRVVYNGCSLRPSQVVNQPRVDIDGDDLRTFYTLIMVDPDAPNPSNPNLREYLHWLVTDIPAATGATFGNEVVGYESPRPSMGIHRYIFVLYRQLGCDAIDAPDIIDSRQNFNTRDFARFHNLGLPVAAVYFNCNREGGTGGRRL

SEQ ID NO: 20556 - protein, 140 aa, Lycopersicon esculentum
MPRVDPLIVGRVIGEVLDPFTRSVDLRVVYNNREVNNACVLKPSQVVMQPKVYIGGDDLRTFYTLIMVDPDAPSPSNPNLREYLHWLVTDIPATTDTRFGNEIVCYENPTPTMGIHRFVLVLFRQLGRETVYPPGWRQNF

SEQ ID NO: 20557 - protein, 343 aa, Vibrio vulnificus
MSISNTVTKVKDFDVNQMDDDFNDDIEINEKEDLTEEKVKLREEFDASNKSLDATQLYLGEIGFSPLLTAEEEVLYARRALRGDEAARKRMIESNLRLVVKISRRYSNRGLALLDLIEEGNLGLIRAVEKFDPERGFRFSTYATWWIRQTIERALMNQTRTIRLPIHVVKELNIYLRTARELSQKLDHEPTAEEIAAQLDIPVDDVSKMLRLNERISSVDTPIGGDGEKALLDIIPDANNSDPEVSTQDEDMRVSLIHWLEELNPKQKEVLARRFGLLGYEPSTLEEVGQEIGLTRERVRQIQVEGLRRLREVLIKQGLNMENLFDIVWIEFAFSNRKKAMES

SEQ ID NO: 20558 - protein, 538 aa, Hordeum vulgare
MAFEVVAAQLARLSDALATSDHASVVSINLFVALLCACIVLGHLLEENRWLNESITALIIGLCTGVVILMTTKGKSSHVLVFSEDLFFIYLLPPIIFNAGFQVKKKQFFRNFMTITLFGAVGTMISFFTISLAAIAIFSKMNIGTLDVSDFLAIGAIFSATDSVCTLQVLNQDETPFLYSLVFGEGVVNDATSVVLFNALQNFDPNQIDAIVILKFLGNFCYLFVSSTFLGVFSGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKTELEKISWRQQIVIWWAGLMRGAVSIALAYNKFTRSGHTQLHGNAIMITSTITVVLFSTMLFGILTKPLIRFLLPASSNGDPSEPSSPKSLHSPLLTSMLGSDMEAPLPIVRPSSLRMLITKPTHTIHYYWRKFDDALMRPMFGGRGFVPYSPGSPTDPNVIVA

SEQ ID NO: 20559 - protein, 319 aa, Mamestra brassicae
MTETLKLRGTLCGHNGWVTQIATNPKYPDMILSSSRDKTLIVWKLTRDETNYGVPQKRLYGHSHFISDVVLSSDGNYALSGSWDKTLRLWDLAAGKTTRRFEDHTKDVLSVAFSVDNRQIVSGSRDKTIKLWNTLAECKYTIQDDGHSDWVSCVRFSPQSRQPIIVSAGWDRTVKVWHLTNCKLKINHLGHSGYLNTVTVSPDGSLCASGGKDMKAMLWDLNDGKHLHTLDHNDIITSLCFSPNRYWLCAAFGPSIKIWDLESKEMVEELRPEIINQTQTSKSDPPQCLSLAWSTDGQTLFAGYSDNIIRVWQVSVSAR

SEQ ID NO: 20560 - protein, 140 aa, Oryza sativa (japonica cultivar-group)
MIPIARVRGVNSAVSSSSALNTPAPPPPLPPPRHYCSSNETKKSIVPAKKKKKKEESMAARTVAVAAALAVLLIFAASSATVAMAGRPTPTTSLDEEAAQAAAQSEIGGGCKEGEGEEECLARRTLTAHTDYIYTQQHHN

SEQ ID NO: 20561 - protein, 639 aa, Oryza sativa (japonica cultivar-group)
MTNSNNGNGGTNAAASGWLGFSLSPHMASSTMDEHHHVHHHQQQQQQQQQQQHHQQQQHGLFFPSVTTAAAAAAYGLAGDVVAATNGYYSQLASMPLKSDGSLCIMEALRRTDQDHHGPKLEDFLGAAQPAMALSLDNTSSFYYGGGGAAAAGHGQHGYLQACDLYGGPAAPSLVTAADEEAAAAAAAMASWVAARGAATAYATGAADANAAENVLPSATAAQHLHHPLALSMSSGSLSSCITAGEYGMAAVAAADGGRKRGGAGGGGQKQPVHHRKSIDTFGQRTSQYRGVTRHRWTGRYEAHLWDNSCKKEGQTRKGRQGGYDMEEKAARAYDLAALKYWGPSTHINFPLEDYQEELEEMKNMTRQEYVAHLRRKSSGFSRGASMYRGVTRHHQHGRWQARIGRVSGNKDLYLGTFSTQEEAAEAYDVAAIKFRGLNAVTNFDITRYDVDKIMASNTLLPADLARRNAATTTSKDDHSAAGAGAIVSVHSAADIAVADTLWKATTAPRQQQQHHDDVVLSGADQAAFSVLHDLVAVDAAAAHQQQQQQQHMSMSAASSLVTSLSNSREGSPDRGGGLSMLFAKPSPAVAASAQQQASTKLMAAPLPLGSWVSSPPASARPPAVSIAHMPLFAAWTDA

SEQ ID NO: 20562 - protein, 369 aa, Oryza sativa (japonica cultivar-group)
MSRLPPRPKLGRHTPLDGRHHEARRRRVRRVQPSVGPIARVAAVIRFLRWRSSWTCWLEINGKLQPAALAPLSGDDVRRLTCLLLSPVVGLQRRLLLSPVAGLQRRDAPAGAGVTPLKPHQSSPTKPPALATAMDVVSSLSSSPAPSPSVLKSLLLSYAYVSVWITFSFSVIMYNKYILNPTMYNWPFPVSLTMVHTAFCASLTVVLIRVLRVVAEPTSPPMTPSLYAVSVVPIGVLYALSLWFSNSAYIYLSVSFIQMLKALMPVTVYCLAVAFRTDSFRHASMLNMLGISAGIAVAAYGEARFDAFGVILQLVAITAKATRLVLIQILLTGATPPPAPTQADRDVEMGLLGGESSASRPAMKPQPGS

SEQ ID NO: 20563 - protein, 512 aa, Mus musculus
MLFEGLELVSALATLAACLVSVTLLLAVSQQLWQLRWAATRDKSCKLPIPKGSMGFPLIGETGHWLLQGSGFQSSRREKYGNVFKTHLLGRPLIRVTGAENVRKILLGEHQLVSTEWPRSARVLLGPNTVANSIGDIHRNKRKVFSKIFSHEALESYLPKIQLVIQDTLRAWSSQPEAINVYQEAQRLTFRMAVRVLLGFSIPEEDLGHLFEVYQQFVENVFSLPVDLPFSGYRRGIQARQILQKGLEKAIREKLQCTQGKDYSDALDILIESSKEHGKEMTMQELKDGTLELIFAAYATTASASTSLIMQLLKHPAVLEKLREELRAQGLLHGGGCPCEGTLRLDTLSSLRYLDCVIKEVMRLFTPVSGGYRTVLQTFELDGFQIPKGWSVMYSIRDTHDTAPVFKDVNVFDPDRFSQARSEDKDGRFHYLPFGGGVRTCLGKHLAKLFLKVLAVELASTSRFELATRTFPRITLVPVLHPVDGLSVKFFGLDSNQNEILPETEAMLSATV

SEQ ID NO: 20564 - protein, 779 aa, Pseudopleuronectes americanus
MAALLLRAPRSSSSSGGRSAARLAGLLACVLLLLAAGASASRDEGSGESNGTRRDPGRVAEPGERDLHPRSNSTAHKKAFPVLSFNYEHVRKPFEISLWILLALLMKLGFHIIPRVSNVVPESCLLIVVGLLVGGLIKAIGEKAPVLHYELFFFYLLPPIILDAGYFLPIRPFMENLGTILVFAVVGTLWNAFFVGGTMFAVCQLAGAQLGGVDLLSCLLFGTIISAVDPVAVLAVFEEIHINELLHILVFGESLLNDAVTVVLYHLFREFSQAGTVTVGDALLGVVCFFVVSLGGIMVGAIYGLLGAFTSRFTHHTRVIEPLFVFLYSYMAYLSAEVFHLSGIMSLIACGVTMRPYVEANISHKSHTTIKYFLKMWSSVTETLIFIFLGVSTVAGPHAWNWTFVILTVILCLVARVLGVIGLTFIINKFRIVKLTKKDQFIVAYGGLRGAIAFSLGFLLPNNEMKNMFLTAIITVIFFTVFVQGMTIRPLVELLAVKKKKESKRSINEEIHTQFLDHLLTGIEDICGHYGHHHWKDKLNRFNKSYVKKWLIAGERSSEPQLISFYNKMEMKQAMMLVESGSAAKLPSIVSSVSMQNIQQKGPTRGRAIPSISKSREAEIRKILRANLQKTRQRLRSYSRHDLMIDPFEDNVSEVRFRKQRVEMERRMSHYLTVPANRQETPPVRKVCFEPEHQVYTYDTEGESPRGRAAQTHPSPPDAIGLMNEATPRPNQSSALRDEGETELRAKAPDDQEEQLKLSRCLSDPGPNKDEEEDGSFVS

SEQ ID NO: 20565 - protein, 204 aa, Brassica rapa subsp. pekinensis
  unsure (1)..(204): unsure at all Xaa locations
TVLKGKIEEIELPTPKVDVIISEWMGYXLLFENMLDSVLYARNKWLVDGGIVLPDKASLFLTAIEDSEYKEDKIEFWNSVYGFDMSCIKKKAMMEPLVDTVDQNQIVTDSKLLKTMDISKMSSGDASFTAPFKLVAQRNDYIHALVAYFDVSFTMCHKLLGFSTGPRSRATHWKQTVMYLEDVLTICEGETITGSMSVSYNKKN

SEQ ID NO: 20566 - protein, 300 aa, Manduca sexta
MSNLTDPVAFAKDFLAGGISAAVSKTAVAPIERVKLLLQVQHVSKQIAEDQRYKGIVDAFVRIPKEQGFFSFWRGNLANVIRYFPTQALNFAFKDKYKQVFLGGVDKNTQFWRYFAGNLASGGAAGATSLCFVYPLDFARTRLAADVGKGEGQREFTGLGNCISKIFKSDGLIGLYRGFGVSVQGIIIYRASYFGFYDTARGMLPDPKNTPIVISWAIAQTVTTVAGIMSYPFDTVRRRMMMQSGRAKSDILYKNTLHCWATIARTEGTSAFFKGAFSNILRGTGGAFVLVLYDEIKKLL

SEQ ID NO: 20567 - protein, 317 aa, Leishmania mexicana amazonensis
MSANNNSAAAPKKARQDAPKLGFWEEFMISGFAAGAAKTAAAPIERVKLLVQNQGEMIKQGTLDRPYSGVMNCLTRTVKTEGLYSLWRGNLSNVIRYFPTQALNFAFKDQFKRMFNYKKDRDGYMKWFMGNMASGGLAGAVSLCFVYSLDYVRTRLANDTKSAKKGGERQYSGMVDCYIKTFKTDGLAGLYRGFCVSCVGIVAYRGFYFGLYDTLQPMLPVNNFLVNFMLGWIVTIVSGLISYPLDTVRRRMMMTSGTGKNYRNSFECFMQCVKNEGAVSLFRGAGANILRGVAGALVLSGVDAIKPYYISTRAAKN

SEQ ID NO: 20568 - protein, 322 aa, Chlamydomonas reinhardtii
MLAAKHAQATVRGVRAQAPMMAALRASSSVHPFTAASGASAFLSLAASSSAAPRAAAAPARGRAGLVVKAQAADASAERPVCLVTGASRGIGKAIALALGKQGARVAINYASSAGAAEEVAAAVVAAGGEAMVVGANVGKREEIDRMFKEVMDKWGRVDVLVNNAGITRDTLMMRMKPEMWDDVIATNLSGVFYCTQNATKIMGKQKKGRIINITSVVGIVGNAGQANYSAAKAGVIGLTKTTAREYSGRTITCNAVAPGFIASDMTAAIDKKYEETILKGIPLGRYGQPEEVAGLVRFLALDPAAAYITGQVYNVDGGMVM

SEQ ID NO: 20569 - protein, 342 aa, Chlamydomonas reinhardtii
MATAMDTGAGASAPAVPQGDRTSADYYFDSYSHFGIHEEMLKDSVRTRTYMNAILNNAYLFKDKIVLDIGCGTGILSLFSAKAGAKHVYGIECSTIAEQATQIVKDNKFDDRVTIIKGKVTLPVDKVDIIISEWMGYFLFYESMLDTVIYARDKWLVPGGIIMPDKATLSLCAIEDGEYKHDKIEFWDNVYGFNMSCIKQLAIAEPLVDIVEPDQIASTIQTVVSVDISTMKKEDATFTVPYELTMTRNDYVHALVGFFDVSFTRGHKPLSFTTSPRARATHWKQTVFYLEDTLMASKDETISGKLECKPNAKNPRDLDISIAYEFEGERGQVKNTQQYRMR

SEQ ID NO: 20570 - protein, 258 aa, Calystegia sepium
MAGRWSLQGMTALVTGGTRGLGHAIVEELSSLGAIAYTCSRNQKELDECLKNWKEKGYPVFGSTCDISQQSERENLIQLVCKQFDGKLHILVNSAATIIPKETLNLNAEDNSIVIGTNLMTSLNFSQLAHPLLKASGNGSIVFISSCASFVFVPVHTVYAATKGAINSLAKNLACEWANDNIRVNAVAPWAMRTSLTEAAREEAGGEILEALIQRTPQHRLVEPKEASAAVAFLCFPASSFVTGQVICVDGGATSYGL

SEQ ID NO: 20571 - protein, 487 aa, Silene latifolia
MSTQAHRNRLLGTENGNGGGGVKVVNNPKLTKKRPPLSNLTNHPRPSLVPSAITKSTKAKRDSSTGVRSTSFPAENPSATLNSKPSAVVPLKTAFTRSNVLVSCKASLPNGKGEQSHITRHPASCTMDTTPTPEDAQSVSMDESMSTCDSLKSPEVEYMDENDVAALCSIERKTSKNLYISDDMETTGSFCKREIVSAMEIDKVVDVDDNHMDPQFCSTIACDIYKHLRESETQKRPSTDFMEQTQKDINASMRAILVDWLVEVAEEYRLVPDTLYLTVNYIDRYLSGNAMNRQRLQLLGVACMMIAAKYEEICAPQVEEFCYITDNTYFKEEVLQMESGVLNFLKFEMTAPTTKNFLRRFVRAAQVMNEVPAFQLECLANYVAELSLLEYSMLKYAPSLIAASSVFLAKYMLTSSRPWNATLRHYTLYEASDLEECVKALHQLCLNSHISSLPAIREKYSHHKYKSVAKKHCPSSIPAEYFQNSSC

SEQ ID NO: 20572 - protein, 146 aa, Clostridium tetani E88
MVEYFMKEAVLEARKALNINEVPIGAVIVKENKIIGRGHNLVEKSKNPLAHAEIIAIREACKSINNWRLNGCHMYVTLEPCPMCAGAIIRSRMDKVYIGTFDPNSGACGTIINLTQNKYLNTNININWLYDEESSTLLKKFFYSRR

SEQ ID NO: 20573 - protein, 251 aa, Clostridium tetani E88
MISYKTLENKTAIITGGSRGIGKSIAIKLGKLGASIVLNYRNNTDALKNTIRELEDLNINVIAVQGDISNYKECEKIIKAALDKFNGIDILVNNAGITADNLILRMKEEEFDKVIETNLKGTFNCVKHCIPTMIKRRYGKIINISSVVGVAGNVGQCNYAAAKAGVIGFTKSLAKELASRSINVNAIAPGFIETDMTNALSDKVKENVISNIPLKRVGKAEDVAELVAFLASDSSSYITGQVINVDGGMVI

SEQ ID NO: 20574 - protein, 312 aa, Clostridium tetani E88
MYYFFNFIYKGAKILKKQNLWADISLLIVAIIWGSGFVATKNALDSISPFFITTLRFSISTLAIGIIFFKRIKNIDISHLKAGFIIGFFLFSAFSTQTIGLLYTTASKQAFLTGTNVVMVPFFYWFISKEKPNLYNITATFLCLIGISLLTLDGSMHINKGDLLTLICAIFFACHVVATGYFTKKYDPIILTFTQFFVTTILSFLSMIILEGVPSAIPKEGIFPVFYLGIFSTFIAFLIQTIAQRYTSPSHTAIVLCLESVFGTILSCILLGDKFTYKIFIGCVLIFLAIITAETKWEFLRDINKNVQAQEE

SEQ ID NO: 20575 - protein, 280 aa, Clostridium tetani E88
MSNCDSCPSKGKCGENKEACSKVVPKYGNIKHIIGVISGKGGVGKSTVTGILATKLKKAGYKVGVLDADITGPSMPRFFGINEERAYAMEGRTREEVKFLPVETSSGIKVMSLNLLTEHEEEPVIWRGPVVTGVLTQMYTDTDWGELDYLLIDMPPGTGDVALTIMQSMPVEGMVVVSTAQDMVSMIVKKVIIMAEKLNINVLGVVENMSYVKCSCGEKINLFSKKTAKEQAEYLEVPLISELPVNLDLTENMEKGNVENYIASCEEYDELLKGFMNQIK

SEQ ID NO: 20576 - protein, 186 aa, Clostridium tetani E88
MFKNLKYDIDNIIKNDPAARNSLEVLLLYPSIHAIINHRIAHFFYKKRMFFIARLISQISRFFTGIEIHPGAQIGNGLFIDHGMGVVIGETAEVGNDVTIYHGVTLGGTGKDKGKRHPTVGNNVIIGSGAKVLGPIVIGNNAKVGANSVVLKDVPENKTAVGAPAKIVGEKKSEVVDMNLYRTIVR

SEQ ID NO: 20577 - protein, 431 aa, Clostridium tetani E88
MKNYIEIIDVSARQVLDSRSNPTVEVDVILEDGTTGRAAVPSGASTGIFEAVELRDGDKSVYNGKGVLKAIENVNTIIAEELVGMNVLDQIAIDKTMIELDGTDNKGKLGANAMLGVSLACAKAAAEYLGLSLYQYIGGVNAKVLPVPMMNIINGGEHADNNVDLQEFMIMPAGASSFSEALRMCSEVYHSLKSLLKAKGYDTGVGDEGGFAPNLNSNEEAIQVIVEAIEKAGYKPGVEIFIALDPASSEIFEDGKYNLKGEGKVLTPQEMVDYYANLVAKYPIISIEDGMAEEDWEGWRLITERLGTKIQLVGDDLFVTNTDRLTMGIERGVANSILIKLNQIGTLTETLNAIEMAERAGYTAVVSHRSGETEDTTIADLVVAVNAGQIKTGAPARSERVAKYNQLLRIEDELGEMGEYRGLKAFYNIKK

SEQ ID NO: 20578 - protein, 673 aa, Clostridium tetani E88
MESFIVYSVLAGVIALIFAFMLSSFISKESAGNERMQEIAGHIHDGAMAFLKTEYKYLTGFIVIVTVILAIFVGWQTAACFILGAIFSIFAGYFGMNVATKANVRTAEAARHSQGKALNIAFSGGAVMGMSVVGLGVVGIGIMYYIFGGNMEFVTGFGLGASSIALFARVGGGIYTKAADVGADLVGKVEAGIPEDDPRNPAVIADNVGDNVGDVAGMGADLFESYVGSIISALTLGTVVYANKEGVMFPLILSSIGIVASIIGILFSRKSKAKDPQKALNTGTYIGGIIVIVSAAILSNTIFGNLKAFFAVASGLVVGMIIGKITEMYTSDAYSSVQKIANQSETGPATTIISGLAVGMYSTLWPIVLISIGVLVSFFVMGGGSNAMVGLYGISLAAVGMLSTTGLTVAVDAYGPIADNAGGIAEMSELPHEVREITDKLDSVGNTTAAIGKGFAIGSAALTALSLFASYAQATELESIDILNTVTLVGLFIGAMLPFLFGALTMESVGKAANEMIEEVRRQFKTIPGIMEGKATPDYKKCVDISTAAAIREMILPGVLAIVVPVAMGLLLGKEALGGLLAGALVSGVLVGILMSNAGGAWDNAKKYIEGGAHGGKGSEAHKAAVVGDTVGDPFKDTSGPSMNILIKLMTIVSLVFAPVVLQYGGILLNLIK

SEQ ID NO: 20579 - protein, 249 aa, Clostridium tetani E88
MKNKFLNGKVALITGASRGIGRGIAIELADKGACVIVNYRKDLKGAEETKKTIEERGGYCRIIKCDVSSYEDTKLMIEKIIRDFGKIDILINNAGISKIGLFIDMEEEDWDNIINTNLKGVFNCSRNVLPYMIGEKNGVIINISSMWGSVGASCEVIYSASKGGVDSFTKALAKEVGPSNIRVNAISPGVINTSMNEWMSCEEKDSLKDEIPLCRFGECEDIGKAVVFLCSDNAKYITGQILTIDGGMI

SEQ ID NO: 20580 - protein, 282 aa, Clostridium tetani E88
MEASNAKVVDDYINMYLKEIGQSDLLTAEEEIDLAKRIEKGDERAKSELIKSNLRLVVSIAKKYIGRGLSFLDLVQEGNLGLMKAVDKYDYKKGYRFSTYATWWIKQAVTRSIADQSRTIRIPVHMNEVISKMIRTKKKLEQELDREPTEEEIAETAEISIEKIKRIYNVSQDPVSLETPVGENEDTILQNFISDDRYLPEDKVTEQMLGDTLSNVLSTLSPREERIVRLRYGLVGDGESRTLEEIGREFNLTRERIRQIEARAIRKLRHPTRIKKLQGYFE

SEQ ID NO: 20581 - protein, 301 aa, Clostridium tetani E88
MKDVKKAHFLAIILMILWGMSYLSIKVVVHEIHPVLSAFYRFLIAAIILFIYLKVRYPEEKVLKEDKIKMALGGFFGVAMYFLFENYAVYFTTASNVAIIISSIPIFTLISQRIIFKEKINVVKAIGASLSIIGIGIILLSKGKVSLFSKGTIGDLMGIGAALCWVAYTVVISKLKGNYRSIVITTYQTIWGCIFLSPSIFIFQHSIMPSTKAIANLLYLSFFCTCIGYAIYIYCQNKLGATVITTYINLQPIVSIISAKILLNENINSKQILGSAIIIIGLFLASKSEKINKQIIEALKG

SEQ ID NO: 20582 - protein, 323 aa, Clostridium tetani E88
MIKQDIAMGLVRVTEAAALCSSKYMGRGDKIAADQAAVDGMEKAFSMLPIKGTVVIGEGEMDEAPMLYIGQKLGIGTDGMEEMDIAVDPLDGTVLIAKGLPNAVSVMAMGPKGSLLNAPDMYMKKIAVGASAKGVIDINKTNKENIINVAMALNKDVTELTIMVQERERHNDIIKDAREVGARVKLFSEGDVAAVLACGFESTGVDMMMGTGGAPEGVIAAAAIKCMGGDMQAKLVPQNEEEIRRCKSMGIENVEATLYINDLVKSDDIYFAATAVTDSDLLKGVVYSKNNWATTQSIVMRSKTGTIRFVDAQHHLSRSNLVL

SEQ ID NO: 20583 - protein, 571 aa, Clostridium tetani E88
MKKRLMRHMLATLTFSMIFVITFFAVITNYKYMENSKAMLKVNNEIVVKMLKSNDVKDKKTIVPYIFNDSDIRISCVDQNDKLIFDSHLKNHDGEFYGKREEIIEAREKGEGFKIRYSQSENMNTMYFAKLLENGFIIRTSTSLGDVSILRGKYFIYYLIIIILSTLGAFIFASKLSSSIVNPIKKLEFITSRIAAGELDRRVNINSKDEIGQLSNTFNNMADKLQYTINDSIEKQNKLEAILKSMDNGVIAVDKDFKIIMINPYAKEIFSIEQDIIGENLLDKIKSYELKEIFKEDNIEDYREVKILSPKEKNLRVKTTDIKIGKQLIGTVAVVQDVTEIKKLENIRSQFVANVTHELKTPLTSIRGFAETLKYVEDRETKDKFLNIINDESDRLTRLINDILALSHIENSNSMKLENISINEMLEDIVYLMENSAKDKNIELFIVGDKMQPIKGDRDRFKQMMINLVDNGIKYTEEGGKVYIGAKKEDNNCIVWVEDTGVGISKEHVERLFERFYRVDKARSRSQGGTGLGLAIVKHIVLGFGGTINIESEEGKGSKFIIRIPIKSNLV

SEQ ID NO: 20584 - protein, 397 aa, Clostridium tetani E88
MNKKNIVIGVTGGIAVYKALEVISKLKKKNFNIDVIMTKSACEFVTPLSFQSLSQNMVVTDMFDEPKHWEIQHISLAKKADLILIVPATANIIGKVANGIADDMLSTTIMATRAPVVFASAMNTNMYTNPIVQQNIEKLKSFGYSFIEPTSGMLACGDSGKGKLADTELIANIAESMLYPKKDLIGKKVLVTAGPTKAPIDPVRYVTNKSTGKMGYEIAKEARDRGADVTLISGTSNLQDPFGINTIHINTNEEMLKEVLDNFQKQDIVIKAAAVADYKPKTFSDKKIKKKDGEGLNLEMEKDTDILRELGSIKKNQVLVGFAAESNDLIENATEKLKKKNLDYIVANDITGHGIGFASDDNKVNILCRNGNNISLDKMSKKEVAREIFDLILKEKF

SEQ ID NO: 20585 - protein, 384 aa, Clostridium tetani E88
MKNICILGATGSIGTQTLEVIREEKENLKLYAASANKSSEKIISIIEEFEPKYVSMTDKEAFLKVKEFCMKNNKNTEVLYGIEGMNTIASLDKVDIVLTSVVGMIGLEPTLKAIRNKKDIALANKETLVVAGEIIKKEAHENKVNILPVDSEHGAIFQCLLGNLKGDINKIHLTASGGPFRGKKREELENVTVEQALKHPNWNMGKKISIDSATLMNKGLEVIEAHFLFDVDYEDIEVVVHPESIIHSMVEYKDGSVIAQLASPDMKLPIQYALNYPIRKDRVIEKLNLFEIEKLTFYKPDLKTFKCLDLAYRAGKIGGMMPTILNSSNEYAVELFLNKKIGFLEIPKIIEECMKKFYTKEEQSVEKIIHMDKIIGEYIREKYN

SEQ ID NO: 20586 - protein, 293 aa, Clostridium tetani E88
MDNETQFINSFPKSIPGQHQTKHPGIESIMNPRPIFDNPNYVASDKLKDKVALITGGDSGIGRAVALAYAKEGADISIVYYDEHEDAEETKALIENLGRKCILIPGDITDSNFCNNAVNETVNSLNGLHILVNNAAVQYTQNSIEDITEEQLEKTFRTNIFSMFYLVKASIPHLKQGSSIINTASITAYKGDELLIDYSCTKGAVVTFTRSLALSLASMGIRVNAVAPGPIWTPLIPSSFDVAKVEQFGKNTALTRPAQPVELAGAYVYLASCDASYVTGEIIHVNGGKFVSG

SEQ ID NO: 20587 - protein, 575 aa, Clostridium tetani E88
MKNPMTQPTKDPNTVYPKVPGIDYDKFKLSEDKMTSKQINDALEELHNYISNQQINFLGYQINQSFNYMKDLKEYLNVHMNNIGDPFVSGNFTVNTKFLERAVLDYFASLWNAQWPHESKGDSNTNDWKNSYWGYVVSMGSTEANFFGIWNARDYLSGKALLLDTSTHKRAKSASINGNPQSVEPRVLNYQAKSLEDNPNMYTPIAFYSQDTHYSIIKGMRILNFTTFNEAGSGKFECPLKYPEDYPKGFSINYLDENGWPFEVPSNNDGSVFIPALKKLVEAFASKGYPIFVNFNYGTTFKGSYDNVEKAIDELVPILKKYNLYEREIIFDKNNKNSDTRTGFWFHVDGALGAAYMPFLEMTTDNEDFPVFDFRLKDVHSISMSGHKWIGVPWPCGIYMSKIKYQLLPPDNPNYIGSPDSTFAGSRNAFSSLILWYYIATHSYEDCKNMILDCQDTAKYTVEKLNELSKKLGIDLWVEYSSKSLTIRFKEANPDIVFKYSLSGEILYVNGEKRAYSHIYIMPHVTKDLIDKFIKDLSKPGAFPEQVSHLEKDGVNFNSNSHKGIYVPQIGRGFK

SEQ ID NO: 20588 - protein, 620 aa, Clostridium tetani E88
MIMINTLDRYKDVYDIKNMSLDELNLLSRELRNFIIESVSQNGGHLASNLGVVELTLSLYNVFDFSYDKLIWDVGHQCYVHKILTGRRSGFQNLRKINGLSGFPKRCESKFDHFETGHSSTSISSALGMARARDLKGENYNVVAVIGDGALTGGMALEALNDVGDNKTKLTIILNDNQMSIGKNVGGLSTYLSSLRIDPNYNKFKRDVEGIIKKIPNIGKGVAKNLERVKDGVKQVLVPGMLFENMGIKYFGPIDGHNIKQLSKVMDKAKNMKEPVIIHVVTTKGKGYKFAEQNPDKFHGIGSFDYMTGCSKKSKGVTYSKAFGKAMVSIASKDKRVVAITAAMKDGTGLNEFSNKFKNRIFDVGIAEQHAVTMAAGMATAGLRPVFSVYSTFLQRAYDQVLHDVCIQNLPVVFAIDRAGLVGEDGETHQGVFDMSYLSHMPNMTIMAPKCVEELEFMLNWALSQESPIAIRYPKGESRLNLKPIKNFQKGKWEVLEDKGKISIIATGRMVEKAFNVKETLKERNIDIGLINATFVKPIDKEMLNKIIDEEKTIITLEDNVILGGFGNSVLNYVRDTNSNIKVVNLGFKDEFIPHGKVDDLFKMYGLDEEAILKEVMKLM

SEQ ID NO: 20589 - protein, 242 aa, Clostridium tetani E88
MSIAEECDVKEGLVKKYIPLVKYIASRVIIGKTKYIDYDDLVGYGMLGLMDAMQKFDPSKGMKFSTYASIRIRGSMIDELRRISPISKSAMDKLNRYNEAVEKLQMKNFKEPKLEEVAKELDMSLKEVAQIENYINYISIVSLEDFIFSDEEDMSLMATVVDKNSPSPEKILEEKELIEYLEKAINKLKERDRIVLSLYYYERLTLKEIGKVLDVSESRVCQLHSRAIVHLRSELKKLKIIN

SEQ ID NO: 20590 - protein, 571 aa, Clostridium tetani E88
MLKGISASNGIAIGKAFILKIGDVEIIKETIKDGEEENQRFITALEKGKKQLSKIMKDAKEKLGEEKSKIFEAHLFMLDDPEFTGQVSEKILKQKINAEYALKSTSEELVAIFEQIEDDYMRERVADIKDVTNRILRILTGNEGISISEIEEESILIGYDLTPSDTAQIDKNKILGFATEIGGVTSHSAIIARSIGIPSVLGVGKEIEEIKNGELIILDGNKGLIITNPDDEKINLYKKQIEEEKKLQKILGKYKNIEVITLDGRKVEVASNIGSIEDSENALKNGAEGIGLFRTEFLYMASSELPEEEFQYNAYKEVLEKMGEKPVIIRTLDIGGDKKLSYLTIDEEMNPFLGYRAIRLCLHRKDIFKTQLRALLRASYYGNLKIMFPMIANLQELREAKSILEECKEELRKESIAFNENIKVGIMVEIPSAAIMSDVLAKEVDFFSIGTNDLIQYTIAVDRMNEKVSYLYDFFNPAVLRLINNVIVNGHKEGKFVGMCGEMAGKKELIPLLLGMGLDEFSMSASSVLKAKKLITELNYEDCKKIVSKVMEMGTAEEVKAFLERNLNFNE

SEQ ID NO: 20591 - protein, 791 aa, Clostridium tetani E88
MELVKIKDILGKEILIFDGAMGTMLQKYGLAVGEIPEILNIKEREKIIEIHKKYIEAGANIITINTFGANDKKLLNTGYSVEDIIEAAVENAKIASKEKNIAIALDIGPIGELIEPMGTLSFEEAYNIFQKQVLQGVKRGVDLILIETMSDLYETKAAILAAKENSNLPIFCTMTFEEDGRTFTGCSIPSMVTVLQGLGVDALGVNCSLGPLELESIVKEMLKYSQIPVMVQPNAGLPKVIDGKTLYKITPEEFLQAQKRMVDNGVAIVGGCCGTDNNFIKLIAKEFKGKKVINKKVEKNTMICTPSKAVIVDEIKIVGERINPTGKKFLKESLKNKNMNYVLKEAINQVEEGADILDINVGLPDIDEGKIMVKVIKEIQSVLDIPLQIDSNDPEVIEKALRAYNGKAIVNSVNGEEENLNKILPIIKKYGASIIGLTFDEKGIPLRAEERFHVAKKIVDKAMEYGIKREDIIIDCLTLTTSAQQKEVLETLKALTLVKKNLGVKTTLGVSNISFGLPNRELLNRTFLNMALFAGLDLPIINTKNREMVDTIKAFKVLSNIDIGGEKFIKEYGGVKKNKEKVDIVKDEELKEIIIKGLRERAVYATKELLKKKTEIQIVEEDLVPALDIVGDRYEKGEVFLPQLIQSAETVQKAFEILKETLTLKDKKNISKGKIVLATVKGDVHDIGKNIVKTLLENYGYTVIDLGKDVSKEKIAEEVKKNEVKLVGLSALMTTTVKSMEETIEMLKNEGLDCKIMVGGAVLNEEYANMIKADYYAKDAKDAIKIARKVI

SEQ ID NO: 20592 - protein, 366 aa, Clostridium tetani E88
MIHSKVEGGKIMKDKNAKMKVLKNLIDKGKKSGSLTYKEIMDELEEIELTPEQIEKVYEALESMNIDVLGADEIKKEEEEEEIDISVPEGISIDDPVRMYLKEIGKVPLLTSEEEVDLAQRIEAGELKARKKLAEANLRLVVSIAKRYVGRGMLFLDLIQEGNLGLIKAVEKFDYRKGYKFSTYATWWIRQAITRAIADQARTIRIPVHMVETINKLIRVSRQLLQELGREPTPEEIAKEMEISVDRVREIMKIAQEPVSLETPIGEEEDSHLGDFIPDDDALAPAEAAAFTMLKEQLINVLDTLTPREEKVLRLRFGLDDGRARTLEEVGKEFNVTRERIRQIEAKALRKLRHPSRSKKLKDYLD

SEQ ID NO: 20593 - protein, 877 aa, Clostridium tetani E88
MESKKYVYLFKEGNAKMKNLLGGKGANLAEMTILGIPVPQGFTITTEACTKYYEDNKKLSDEVISQIYKALEEIEKETKKSFGSIDNPLLVSVRSGARVSMPGMMDTILNLGLNDDTVKAISRLTNNERFAYDSYRRFIQMFSDVVMGLDKRMFEDILEEVKKSINAKFDTDLSAENLKKIVEKYKEIYKKEVGEEFPQDPKIQLLESVNAVFRSWDNPRAIVYRRLNDIPGSWGTAVNIQTMVFGNMGDTSGTGVAFTRDPATGENKIFGEYLINAQGEDVVAGIRTPQAITKLKEDLPSCYEEFVNIAGKLENHYRDMQDMEFTIEQGKLYFLQTRNGKRTAQAALKIAVDMVNEGLITKEEALLKVEPKQLDTLLHPNFHEGELKKATFIAKGLPASPGAACGKVYFTAEEAKEKHELGEKVVLLRVETSPEDIEGMIAAEGILTVRGGMTSHAAVVARGMGKCCVVGCDDIEVFEKENTFQIGRIKFKKGDYISIDGSTGKVYGEAIKTVSPEISGYFGIFMKWADGIRSLKIRTNADTPKDSNQAVEFGAEGIGLCRTEHMFFDEKRIPAVRQMIMADNEDQRREALEKLLPMQREDFVGIYEAMEGRPVTIRFLDPPLHEFLPTEDEDLKELAKDMGVTFERVKYEIESLKEFNPMMGHRGCRLSISYPEIAEMQTRAVIEAAIDVKNRKGYNIKPEIMIPLVGEVKELKFLKDIVINVANKVIEESGVELEYFVGTMIEVPRATIVADEIAKEADFFSFGTNDLTQMTFGFSRDDAGKFLNNYYDNKIYDFDPFQKLDQKGVGQLVQNACELGRKAKENIKLGICGEHGGDPASVEFFHKVGLDYVSCSPYRVPIARLAAAQAEVKYPRK

SEQ ID NO: 20594 - protein, 255 aa, Clostridium tetani E88
MKFMSEGVVKKSSYDYDDNILLLEKAKNGDKKATDKLVELNLPLVSAISKKFLNRGYDYEDIYQIGCMGLVKAINNFDSSYNVKFSTYAVPMIMGEIKRFIRDDGIIKVSRSLKIMARKLYYHRETLCKKLGREPSIEELSEYTGLEIEEIVYAMESSSNLQYLHDVIHQDDGAPIMLIDKISENYSEDSDIINKLALKEALGKLDAKSRQIIMLRYFKDKTQIEVAKMLGISQVQVSRIEKRVLKTMKEKLGNW

SEQ ID NO: 20595 - protein, 484 aa, Clostridium tetani E88
MAIILKKGYTFDDVLLLPNKSEVLPKDVLLNTNLTKKIKLNIPLISAGMDTVTESRMAIAMAREGGIGIIHKNMSIEKQAEEVDRVKRQENGVITDPFHLSPDKKLQDALDLMSKYRISGVPITVEGKLVGIITNRDIVFEDDYSKKISELMTDEDLITAPENTTIDQAREILKKHKIEKLPLVDENFNLKGLITIKDIDKIKMYPNSAKDDKGRLLCGAAVGVTADMIERVDALVKAQVDVITIDTAHGHSRGVLEGVRKIKELYPELQIIAGNVATPEATRDLILAGADCVKVGIGPGSICTTRVVAGVGVPQLTAVMDCVEEAQKHGVPVIADGGIKYSGDIVKALAAGASVCMMGSLLAGCAESPGETEIYQGRSYKVYRGMGSLASMACGSKDRYFQEDNKKLVPEGVEGRVPYKGYLSDTVYQLVGGIRSGMGYLGSKTLKDLYESARFIVQTSAGLRESHPHDISITKEAPNYSTNA

SEQ ID NO: 20596 - protein, 432 aa, Clostridium tetani E88
MRLFGTMEVKDNNLYIGGVSCKELKNKYSTPLYIIDEDFLRGRCKEYYNNFGVEKHGNKVAYAGKSFLTIAMCQIIKEEGLFLDVVSSGELYTALKANFPMNKIYFHGNNKTLDEIEMGIELGVGKFVVDNFYEMNNINNMARKKGIKQSILLRITPGIEAHTHDYIKTGQVDSKFGFSMVGEEVYKAVETALSLPNINLSGIHCHIGSQIFETTPYEEAVDIMFEILKEIKNRYDYEISEVDLGGGFGIYYTKEDKPKETKEYCEAILKKALNKSKELGIKLPMLGIEPGRSIIGNAATLIYTIGAIKEIPGIRKYVSIDGGMNNNIRPALYDAKYECEVANNMNSDDRELVTIAGKCCETGDIVIEDVEISKSKSGDILAIPSVGAYGYSMSSNYNKIPKPAIVLVKDGESRVMCKRESFDDMLKNELSL

SEQ ID NO: 20597 - protein, 261 aa, Maackia amurensis
MASSKERETFVYVAKLAEQAERYEEMVDSMKNVATLDVELTVEERNLLSVGYKNVIGARRASWRILSSIEQKEEAKGNEVNAKRIKEYRQKVESELTNICNDVMRVIDEHLIPSASAGESTVFYYKMKGDYYRYLAEFKTGNEKKEAGDQSMKAYESATAAAEAELPPTHPIRLGLALNFSVFYYEILNSPERACHLAKQAFDEAISELDTLNEESYKDSTLIMQLLRDNLTLWTSDIPEDGEDAQKANGTAKLGGGEDAE

SEQ ID NO: 20598 - protein, 300 aa, Bombyx mori
MSNLADPVAFAKDFLAGGISAAVSKTAVAPIERVKLLLQVQHVSKQIAADQRYKGIVDAFVRIPKEQGLLSFWRGNFANVIRYFPTQALNFAFKDKYKQVFLGGVDKKTQFWRYFAGNLASGGAAGATSLCFVYPLDFARTRLAADVGKGDGQREFSGLGNCISKIFKSDGLIGLYRGFGVSVQGIIIYRASYFGFYDTARGMLPDPKNTPIVISWAIAQTVTTVAGIISYPFDTVRRRMMMQSGRAKSDILYKNTIHCWATIAKTEGTSAFFKGAFSNVLRGTGGAFVLVLYDEIKKVL

SEQ ID NO: 20599 - protein, 878 aa, Rickettsia sibirica
MKKLIYYFGSNGSDGNASMKNILGNKGAGLAEMSNLKLPIPDGFTITTELCNYFYTHNNNFPKNFQSDLKKAITELEIITGKIFGSTSNPLLLSVRSGSTVSMPGMMDTILNLGMNNEVCNALADSCGDKRFALDSYKRFLEMYGSTVLSIPSDLFEQIYEKHKMQADIHKDRDITVELLEKIIDDFKRLHIKYTKQLINDPYEQLESAIKAVLHSWMSNRAVIYRKINNISEDFGTAINIQAMVFGNLGKTSATGVAFTRSPSTGEKKLFGEFLINAQGEDIVSGTRTPMPIIANDSNSMQAMMPEVFKELSQIAQKLEEHYLDMQDIEFTIENNKLYILQTRTAKRTAIAAINIAVQMVEEKLISKEQALMRIDPESLNQLLHTRIDYSKGLTSIAEGLPASPGAATGIAVFSPYDAEKLSHHHKVILVRHDTSPEDINGMHVSSGILTIRGGMTSHAAVVARGMGKPCVCGTNNLSIDEKKQILTAGDIVIKQGDIITIDGGSGKIFLGEMPLIQPTFSEESKLILDWADEISSLKVRANAETVNDALVSVKFGAQGIGLCRSEHMFFDKNKIPLVRDMIIAPDIERRKLAVQKLLPLQTEDFKALFRVMKDKPVNIRLLDPPLHEFLPTTEEDKKNLANSLNLPLSMINQRLHAMHEVNPMLGHRGCRLGICSPEIYQMQIEAIFTAIFELHKKEHIECNLELMIPLISNVGEIQKLKMDIYAVIEELEQRYRYKFSFTLGTMIELPRAALGSKKIAKEVDYFSFGTNDLTQTTYGISRDDIASFLPYYLEEKIFESDPFTTLDEEGVGELIEIAIKRGKSSNANLKLGACGEHAGNPASIEFFHRMNLNYVSCSPYRIPIARIAAAQAKIKHG

SEQ ID NO: 20600 - protein, 511 aa, Rickettsia sibirica
MTINPSNIENSSSKINSYFSKLTDYIWPIKRHEVSKFLFITLLMFCILFIQNLIRALKDSIVTTMIGAEIISFLKFWGVMPSAFLMTAIYVKLVNKMKAENIFYLIISIFLTFFALFAYVIFPNHEMLHFSPVTVQNLTASLPNLKWFIWLLSKWSFSLFYIIAELWPNVVFALLFWQFVNNITTVEESKRFYPLFGLLSQTGIYLAGQFLENLSNINDYVTNKFALQSSFHTLSIQIILTIVLILGIIAIKTFWLLNHKVLDKEHMALLRFKAKKKSMTIAESFQMLLSSRHIRLIATLLICYGIAINLVEGPWKAAATKIYKTPTEYAAFIGSYLSYTGVFTILFVILGSNIVRRLGWFTAAVITPLIVFITGILFFAVNNFERFAGLIIANFILTDPALIAITIGAIQNVLSKSSKYTLFDSTKEMAYVPLDPEIKIKGKAAADVIGTKLGKSGSAFLQSLVFIILPSASYQSISTCLMIIFIITCLTWLWATKALNKEYKNSIKFSQ

SEQ ID NO: 20601 - protein, 507 aa, Rickettsia sibirica
MDSVDSNFTIWNKARNSKFRHIVWPIRSYELTKFIPMALLMFFILLNQNLVRSIKDSFVVTLISSEVLSFIKLWGEMPMGILFVIFYSKLCNIMTTEQVFRIITGTFLFFFAIFGFILFPYREFFHPDPELMKHYITVLPHLKWFLIIWGQWSLVLFYIMGELWPVIVFTLLYWQLANKITKVEEAPRFYSFFTLFGQTNLLISGTVIIYFAKSEHFLLPLFSHLNDTNEILLKSFITVILISGLICLALHKLIDKSVVEADKNIKFKNQRMDILKLSLVDSAKVILTSRYLGFICLLVMSYSMSISLIEGLWMSKVKQLYPATKDFIAYHGKVFFWTGILTLVSAFLGSSLIRICGWFWGAIITPIMMFGAGVMFFSFTVFENHLGNIVNTLGYSAPLVVIVFIGGLWHVLSKSVKYSLFDATKEMVYIPLDSEMKTKGKAAVDVMGAKIGKSIGAIIQFISFSIFPNAIHNDIAGLLMFSFIIVCLLWLYGVKVLSKYYNKMIQR

SEQ ID NO: 20602 - protein, 293 aa, Rickettsia sibirica
MTNNINALAISSESGFYSYLQKINKIPSLTQEEELLLAKSYLEGNDLQAAHKLVTSHLKLVAKIASGYRTYGLPMTELVSEGNIGLMQAVKKFNPALGFRLSTYAMWWIKAAIQEYILKSWSLVKMGTTAAQKKLFFSLNKVKHKITNLYSRAITTDDFVQIADELGVSVNEVSEMNTRISGPDLSLNNSINSDDAESGELIELLPETRPTPETMAINKQNSTSKRQLLSNAMKILNDRELRILTERKLTDTPKTLDILSNEYNISKERIRQIENTAFEKIKKFILNHSRKAA

SEQ ID NO: 20603 - protein, 326 aa, Rickettsia sibirica
MQITVREALRDAMQEEMIRDDKVFVIGEEVAEYQGAYKVTQGLLEQFGPKRVIDTPITEYGFAGLAVGAAFAGLRPIVEFMTFNFAMQAFDHIVNSAAKTHYMSGGQVKCPIVFRGPNGAASRVAAQHSQNYTACYSHIPGLKVVAPYSAEDHKGLMLTAIRDDNPVVFLENEILYGHSFDVPKTIEPIPFGQAKILREGSSVTIVTFSIQVKLALDAVNVVQNDNIDCEVIDLRTIKPLDTETIIESVKKTNRLVVVEEGWFFAGVGASIASIVMKEAFDYLDAPIEIVSGKDLPLPYAVNLETLALPSESDVIEAVKKVCYYSI

SEQ ID NO: 20604 - protein, 468 aa, Rickettsia sibirica
MIKEMIVKQVALEHTKIVELYTDNIWNTHQNVISKLHKFDYLKLLQDQEFINFAKITAQWFTNLNINISLYDLKGNKFITSNMLHMYSVDNYKDDSLVEIVTAKIDKFFLKSFTSKAPLRDAFEGITSHILLPKVVIENESDLTVEEASFVTSYIPVINNNLDFPVDAVFEINTNITSQWQNITSLEQKVFITFIIIFIIFCTIIISNTNYARQIIEEQLEINRNLKAQIVKVEKTSSSNTKFFTNISHELRTPLNAIIGFSEILMSERDAEKSKNYIKDINDAGKHLLSMINDILDLSKASADKLKVDSIDLDLNKLIRSSLILVKTRADQAEVALISRLPKEHVVIKADPKRLKQVFLNLLSNAVKFTNPGGSVTIALEKDELAKLVYIKVIDTGIGIEEKDIPKTLSAFGQIDSELSRKYEGTGLGLPLTKKLVELMNGKFDLQSKINEGTTITITFTYDCSIEI

SEQ ID NO: 20605 - protein, 319 aa, Rickettsia sibirica
MANLHQRQIIDKIQHITFKDGTFLNEVISDIIIKGNNIGFSIDISGKNKLEAEEIRLKAINKLNEISAVNKITIVFTESKPMEKKVQKPKHFVENVKKIILVASGKGGVGKSTISALIAQQLSLANYRVGIVDADIYGPSIPHIFGINEVPQTKDGRIIPVLAQSIEIISIGFFVKDHSAIIWRGPMASKTIYQLLSVTKWDNLDYLIIDMPPGTGDIHLSILENYHLDGVIIVTTPQKISEIDVIRSIDLYQKLNLPILGIIENMSYMLKNNSGGHLSQKYNIPLIAQIPITPQIAEACDKSLPLTNLLTLPLEKYLQ

SEQ ID NO: 20606 - protein, 501 aa, Rickettsia sibirica
MNTPKNDNYLSELSKVIWPIERYENKKFLPMAFMMFCILLNYSTLRSIKDGFVVTDIGAEAISFLKTYIVLPSAVIAMVIYVKLCDILKQENVFYVITSFFLGYFALFAFVLYPYPDLVHPDPETIESWSVAYPNFKWFIRIVGKWSFASFYTMAELWGTMMLSLLFWQFANQITKTDEAKRFYSMFGLLANLALPVTSVIIGYCLHEKTQIVAEHLKFVPLFVIMITSSFLVILTYRWMNKNVLTDPRLYDPALVKEKKAKAKMSLIDSFKMIFTSKYVGYIALLLIAYGVSVNLVEGVWKSKVKELYPTKEAYTIYMGKFQFYQGWVAIAFMLIGSNILRKVSWLTAAMITPLMMLITGAAFFAFIFFDSVIAMHLTGILASSPLALAVMIGMIQNVLSKGVKYSLFDATKNMAYIPLDKDLRVKGQAAVEVIGGRFGKSGGAIIQSTFFILFPAFGFVEATPYFASIFFVIVILWMYAVKGLNKEYKVLVNKTENRIC

SEQ ID NO: 20607 - protein, 241 aa, Rickettsia sibirica
MLELTIVTGGTRGIGKATALELKNKGLTVVANFFSNYDTAKEIEEKYSIKTKRWNIADFEECRKAVKEIEEEFKKPVSILVNNAGIAKDKMLHRTSHQDWNDVININLNSCFNMSSSVMEQIRNQDYGRIINISSINAQARQVGQTNYSAAKAGIISFTKALARETASKNITINCIAPGYIATKMVGAVPEDVLVKIVNSIPKKRLGQPEEIARAVAFLVDENAGFITGETISINGGHNMI

SEQ ID NO: 20608 - protein, 634 aa, Rickettsia sibirica
MSNSNIDNDLDKIDSLLKKAKSKKIPVTYDDINNALPLNKNPSIRQLEEAILKFSDAGVDILESNEDDEIKLDIGMDEEFKLSTNVDNEPEDEVEEENIGTTDDPVRLYLKDMGGVDLLTREHEVEIAKRIEEGHKTMTASLCRSPIAMRCFIVWYEDLVNEKMLLRDLIDLEANMLHDETPENDEENSSETEGEEHEDNHLSMSRVETQILPNVIERMKKIAFICEELLIEAKKCYEKSFEPKVLQNSKKYNNLELLINEVSEIHFNSKRTEEILGKMYGINRDLINKETAFLKLAEKYGVTRQNFLDEYIGSVINAAWKEKMLKNKKVAWKELMTKESDYIDQMIAELSVIESKTGLLVNDFKKLVNTIQKSERQTLQAKKDMIEANLRLVISIAKKYANRGLQFLDLIQEGNIGLMKAVDKFEYRRGYKFSTYATWWIRQAITRAIADQARTIRIPVHMIETINKILRTSRQMLNELGYEPTATEIANRLSMPLDKVRKVMKIAKEPISLENPVGDDSDGGQLGDFIEDKNAVAPIDAAIQSNLREVTTRVLATLTPREERVLRMRFGIGMNTDHTLEEVGQQFKVTRERIRQIESKALRKLQHPIRSKKLNSFRSGGKRGDGNPSDLLEA

SEQ ID NO: 20609 - protein, 168 aa, Rickettsia sibirica
MNILLDKEANFNNFFMEQALKQAKIAFDKNEVPVGAVVVDRLNQKIIASTHNNTEEKNNALYHAEIIAINEACNLISSKNLNDYDIYVTLEPCAMCAAAIAHSRLKRLFYGASDSKHGAVESNLRYFNSSACFHRPEIYSGILAEDSGLLMKEFFKRIRTVISSHRMT

SEQ ID NO: 20610 - protein, 241 aa, Rickettsia sibirica
MIDLTGKTSLITGASGGIGGAIARLLHKLGSHVIISGSNEEKLKALGKVVKDNYTIEVCNLADKEECSNLISKASKLDILVCNAGITSDTLAIRMKDEDFDKVIDINLKANFILNREAIKKMIQNRYGRIINISSIVGISGNPGQANYCASKAGLIGMTKSLSYEVATRGITVNTVAPGFIKSDMTDKLNEKQREAIIQKIPLGTYGMPEDVANAVAFLASDQASYITGQTIHVNGGMLMV

SEQ ID NO: 20611 - protein, 480 aa, Rickettsia sibirica
MHNYELGKFIPMSTLMFCILFNQNVLRILKDSILISEISAEIAGFAKVYCVTPAAALFVIIYAKMINYLTFEKIFYYLSAFFISFFVLFTFVIYPNIHIFHVHPDNLTDWMERYPHFKWYISLVGNWGYIVYYSLAELWPNIFYVLLFWQFANELTTTEEAKRFYTLFSLFGNSSLILVGFLMMNLSSEDTIIKKFMSIADSKITLVQVSTTIVAIVAIICCLLVRFISKNVFTNPLFYAKAKSGRSTSERMGLIKSFKYIAKSKYLWLLLICSAAFGFAINLVEAVWKAKIKELYPTVNTYAEFNSLYILWTGVAIMVMTVIGNNIMRMHNWFVAAVISPVIIMVTGILFFVLIVFDQQILSLFDGAILMSPLALAVSIGGIQNILAKGTKYSIWDTSREMLYIPLDEELKTKGKAAVDVISAKVGKSSSGLVQSIIFTLVPTATFTLISPILMVVFTFVCLAWIYAVRKIYFEYQKIA

SEQ ID NO: 20612 - protein, 501 aa, Rickettsia sibirica
MLPPKIFFEKVKEIMWPIERKELKLFIPMALMMLCILFNFGALRSIKDSLVVPSMGAEIISFLKLWLVLPSCVIFTVLYVKLSNNLNFEYIFYIIVGSFLLFFLLFAYIIYPNQDIYHPNDEMINKLIASYPNFKWFIKIGSQWSYALMYIFAELWSAVVINLMFWQFANHIFDTSKAKRFYPVLGMVGNIGLIIAGSVLVFCSSGQDVIDSELLPDSFNSSAGNAIMLQPIMSIIVTAGIIAMLLFRIINRFILTDSINVLDAKKVTAKMKTKLSVIESIKLVIHSKYIGRIALLIICYGLLINIVEGPWKAKIKELHPNTIDYVNFMGRFNIWMGISCVTFMIIGSNILRRLGWLISALLTPIMLSITGLMFFIFIIFIEEIGECFGDFNLLYAAIIVGAIQNILSKSSKYSLFDSTKEMAYIPLSLELRTKGKAAVEVIGTKFGKSLGAFIQSLIFIIIPTATFDSIIIYLLVTFIVMMSLWIWNVIKLNKEYVELCK

SEQ ID NO: 20613 - protein, 526 aa, Coprinellus congregatus
MFKFAVLSQFVALALAAIGPQADLFIGNANVAPDGFQRSAALAGTDANSMVFPGPVIQAFKGETFNINVRNRLADPSMLRTTSIHWHGFLQAGSAWADGPVGVTQCPIAPNRDFLYTFATARQAGTFWYHSHHRSQYCDGLRGAMVVYDPEDPHRSLYDVDNEDTIITLADWYHPPGPVLETLNVATANSTLINGKGRYPTGPTTPLAVVGVTAGKRYRFRLVSISCSPFFTFSIDGHRMTIIEADGESTQPLVVDSIDIHAGQRYSFVLEANQPVANYWIRSNPNRGNRGFAGGLNTAILRYVGAPDADPVKPSDVDVPVPALPLVETNLHPLENPAAPGPPALGGEGVTAIELQIGLQGREWTVNGATFHEPNEPILLQTLNGKQMNELLPNQGSLFPIPRNSVIELTMPGGGAGSPHPMHLHGHMFSVIRSASNSTPNFVNPVRRDVVSLGSNTADRVTVRFVTDNAGPWIMHCHIDWHLVHGLSVVFVEDIEGISDSQRVAEDHPWRQLCPIYEQEKPDNEP

SEQ ID NO: 20614 - protein, 233 aa, Lotus japonicus
EFGTRLDRVKNITGLVEWYGKNARLRELVNLVVVAGDRRKESKDLEEIAEMKKMYGLIETYKLNGQFRWISSQMDRIRNGELYRVICDTKGAFVQPAIYEAFGLTVVEAMTCGLPTFATCNGGPAEIIVHGKSGYHIDPYHGDRAAETLVEFFEKSKADPSYWDKISQGGLQRIHEKYTWKIYSDRLLTLTGVYGFWKHVTNLDRRENKRYLEMFYALKYSKLAESVPLAVEE

SEQ ID NO: 20615 - protein, 264 aa, Solanum tuberosum
MCGGAIISDYEPAGNFYRKLSARDLWAELDPISDYWSSSSSSSTVENPYSAQSPVTHSVDKPKKSDSGKSNQLKKGNKTVKVEKEKSTGPRQRKNKYRGIRQRPWGKWAAEIRDPQKGVRVWLGTFNTAEDAARAYDEAAKRIRGNKAKLNFPAPSPPAKRQCTSTVAADPPPALLLESSNIISYNNSPLMNFGYDVQSQTPYYPMEMPVASDDYELKEQISNLESFLELEPADSSDQFSGIVDPDPLNVFLMEDFASTQHQFY

SEQ ID NO: 20616 - protein, 119 aa, Dioscorea tokoro
  unsure (1)..(119): unsure at all Xaa locations
GGVMIGDGQSRFSINGKPIYHFVGTSTFSEYTVVHVGCVAKINPSAPLDKVCVLSCGISTGLGAALNVAKPVKGSSVAVFGLGAVGLAAAEGARIAGAXRIIGVDINPKRFNAAKKFGV

SEQ ID NO: 20617 - protein, 301 aa, Anopheles gambiae
MTKKADPYGFAKDFLAGGISAAVSKTAVAPIERVKLLLQVQAASKQIAVDKQYKGIVDCFVRIPKEQGIGAFWRGNLANVIRYFPTQALNFAFKDVYKQVFLGGVDKNTQFWRYFLGNLGSGGAAGATSLCFVYPLDFARTRLGADVGRGAGEREFNGLLDCLKKTVKSDGIIGLYRGFNVSVQGIIIYRAAYFGCFDTAKGMLPDPKNTSIFVSWAIAQVVTTASGIISYPFDTVRRRMMMQSGRAKSEVMYKNTLDCWVKIGKQEGSGAFFKGAFSNVLRGTGGALVLVFYDEVKALLG

SEQ ID NO: 20618 - protein, 590 aa, Nicotiana tabacum
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMDLPSDSYLLYNIDDIPGDGNKKAKQRLPHSKEFRFLDKAAIKVQDPESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTTPLQRIAVGLILSIIAMVAAALTEVKRLNVAHLHGLTNDANAKVPLSVFWLVPQFLLVGAGEAFTYIGQLDFFLRECPKGMKTMSTGLFLSTLSLGFFFSSILVTIVHKVTVKNPWLADNLNQGRLYDFYWLLATLSVLNLMIFLFISRRYVYKEKRLAECGIEMEDSEPACH

SEQ ID NO: 20619 - protein, 590 aa, Nicotiana tabacum
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMELPSDSSLLYNIDDIPGDGNKKAKQRLPHSKEFRFLDKAAIKVQDPESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTSPLQRIAVGLILSIIAMIAAALTEVKRLNVAHLHGLTNDANAKVPLSVFWLVPQFLLVGAGEAFTYIGQLDFFLRECPKGMKTMSTGLFLSTLSLGFFFSSILVTIVHKVTGKNPWLADNLNQGRLYDFYWLLATLSVLNLMIFLFISRRYVYKEKRLAECGIEMEDSEPACH

SEQ ID NO: 20620 - protein, 594 aa, Nicotiana tabacum
MALPETQQDSKALPDAWDYKGRPALRSSSGGWASGAMILGVEAVERLTTLGIAVNLVTYLTGTMHLGNATAANNVTNFLGTSFMLTLFGGFVADTFLGRYLTIGIFATVQAMGVTILTISTIIPSLRPPKCEQVGSSSCIPANSKQLMVLYIALYMTALGTGGLKSSVSGFGTDQFDDADKKEKGQMIKFFDWFFFFINVGSLGAVTVLVYIQDNLGREWGYGICACAIVIGLVVFLSGTRKYRFKKLVGSPLTQIASVIVAAWKKRHLELLSDSSLLFEIDDIFGEGNKKNKQKLPHSKEYRFLDKAAIKEDHDLESNGTNVVINKWKLATLTDVEEVKLLIRMLPTWATTIMFWTVYAQMTTFSVSQATTMDRHIGTFEIPPASLTVFFVGSILLTVIFYDRVIVPICRRFMNKPHGLTPLQRIFTGLVLSILAMIAAALTEVKRLKVAHLHGLTNDANATIPLSVFWLVPQFLLVGAGEAFTYIGQLDFFLRECPKGMKTMSTGLFLSTLALGFFFSSILVTIVHVVTGTTNPWLADNLNQGRLYDFYWLLAILSVLNLMFFLYFSRKYVYKEKRLAEMGIELEDDGPVCH

SEQ ID NO: 20621 - protein, 594 aa, Nicotiana tabacum
MALPETQQDSKALPDAWDYKGRPALRSSSGGWASGAMILGVEAVERLTTLGIAVNLVTYLTGTMHLGNASSANNVTNFLGTSFMLTLLGGFVADTFLGRYLTIGIFATVQAMGVTILTISTIIPSLRPPKCEQVGSSSCIPANSKQLMVLYIALYMTALGTGGLKSSVSGFGTDQFDDSDKKEKGQMIKFFDWFFFFINVGSLGAVTVLVYIQDNLGREWGYGICACAIVIALVVFLFGTRKYRFKKLGGSPLTQIASVIVAAWKKRHLELPSDSSLLFEIDDIFGEGNKKSKQKLPHSKEYRFLDKAAIKEDDDLESNGTNVVINKWKLATLTDVEEVKILIRMLPTWATTIMFWTVYAQMTTFSVSQATTMDRHIGTFEIPPATLTVFFVGSILLTVIFYDRIIVPICRRFMNKPHGLTPLQRIFTGLVLSILAMIAAALTEVKRLKVAHLHGLTNDANATIPLTVFWLVPQFLLVGAGEAFTYIGQLDFFLRECPKGMKTMSTGLFLSTLALGFFFSSILVTIVHVVTGTTNPWLADNLNQGRLYDFYWLLAILSVFNLMFFLYSSRKYVYKEKRLAEMGIELEDDGPVCH

SEQ ID NO: 20622 - protein, 245 aa, Arabidopsis thaliana
MENEREKLIYLAKLGCQAGRYDDVMKSMRKVCELDIELSEEERDLLTTGYKNVMEAKRVSLRVISSIEKMEDSKGNDQNVKLIKGQQEMVKYEFFNVCNDILSLIDSHLIPSTTTNVESIVLFNRVKGDYFRYMAEFGSDAERKENADNSLDAYKVAMEMAENSLVPTNMVRLGLALNFSIFNYEIHKSIESACKLVKKAYDEAITELDGLDKNICEESMYIIEMLKFNLSTWTSGDGNGNKTDG

SEQ ID NO: 20623 - protein, 222 aa, Oryza sativa (japonica cultivar-group); identical to SEQ ID NO: 3909

SEQ ID NO: 20624 - protein, 604 aa, Oryza sativa (japonica cultivar-group)
MPKHYRPAGKKKEGNAAKYITRTKAVKYLQISLATFRKLCILKGVFPRDPKKKVEGNHKTYYHMKDIAFLAHDPLIEKFREIKVHRKKVKKAFAKKNKDLADRLLNRPPTYKLDRLILERYPTFVDALRDLDDCLTMVHLFAALPAVEGERVQVQRIHNCRRLSHEWQAYISRTHSLRKTFISVKGIYYQAEVQGQKITWLTPHALQQVLTDDVDFNVMLTFLEFYETLLGFINFKLYHSINVNYPPVLDPRLEALASELYALCRYMSSGRVPGNSEPAGLIEDKEGEDNKESSKTDESELRLAQLQHQLPTNEPGALMHLVQESTAADADDADAKECRSLFKNLKFYLSREVPRESLLFIIPAFGGTVSWEGEGAPFDETDEDITHQIVDRPTQSHVFLSREYVQPQWIYDCVNARIILPTEGYIVGRVPPPHLSPFVDNDAEGYIPEYAETIKRLQAAAQSQVLPLPSLGDEDMENSLVEAIIDRSESNEIADKKRKLEMLEKQYHDELRMEYEGKTFSNRTADNQPDVVDKSDTKEADDHMEDSHKQAEKDAADISKTLMSRKQRGLLQAIEINQERKKDKVNLLKKRKKNADSSASAKGR

SEQ ID NO: 20625 - protein, 61 aa, Gossypium barbadense
LGANAILAVSLAVCKAGAEVKKLPLYKHIANLAGNSKLVLPVPAFNVINGGSHAGNKLAMQ

SEQ ID NO: 20626 - protein, 61 aa, Gossypium barbadense
LGANAILAVSLAVCKAGAEVKKLPLYKHIANLAGNSKLVLPVPAFNVINGGSHAQKQIGYA

SEQ ID NO: 20627 - protein, 78 aa, Gossypium barbadense
RIMKKALPANAKIAKDAKETVQECVSEFISFITSEASDKCQKEKRKTINGDDLLWAMATLGFEDYIDPLKIYLTKYRE

SEQ ID NO: 20628 - protein, 244 aa, Lycopersicon esculentum
MYQLPTSTELTFFPAEFPVYCRSSSFSSLMPCLTESWGDLPLKVNDSEDMVIYGFLQDAFSIGWTPSNLTSEEVKLEPREEIEPAMSTSVSPPTVAPAALQPKGRHYRGVRQRPWGKFAAEIRDPAKNGARVWLGTYESAEEAALAYGKAAFRMRGTKALLNFPHRIGLNEPEPVRVTVKRRLSESASSSVSSASESGSPKRRRKGVAAKQAELEVESRGPNVMKVGCQMFQLASSYWLVKIWS

SEQ ID NO: 20629 - protein, 260 aa, Lycopersicon esculentum
MCGGAILADIIPPRDRRLSSTDLWPTDFWPISTQNVPLNPKRARPSTGGEQMKKRQRKNLYRGIRQRPWGKWAAEIRDPRKGVRVWLGTFNTAEEAARAYDREARKIRGKKAKVNFPNEDDDHYCYSHPEPPPLNIACDTTVTYNQESNNCYPFYSIENVEPVMEFASYNGIEDGGEEMVKNLNNRVVEEEEKTEDEVQILSDELMAYESLMKFYEIPYVDGQSVAATVNPAAETAVGGGSMELWSFDDVSRVQPSYNVV

SEQ ID NO: 20630 - protein, 222 aa, Lycopersicon esculentum
MAPKEKIGAVTAMAMVNLNGISKEVHYRGVRKRPWGRYAAEIRDPGKKSRVWLGTFDTAEEAARAYDNAAREFRGAKAKTNFPKLEMEKEEDLKFAVKNEINRSPGQTSTVESSSPVMVDSSSPLDLSLCGSIGGFNHHTVKFPSSGGGFTGSVQAVNRMYYIEALARAGVIKLEQIGRKRLDYLGGGDSDSSTVIDFMRVDVKSTTAGLNLDLNFPPPENM

SEQ ID NO: 20631 - protein, 201 aa, Lycopersicon esculentum
MTKQDEGLTLELIRQHLLEDFTTTESFIDSLNSCFSDHISSSDDISPVFTSVKTEPSTSNSLSDSPNSSYPNEPNSPISRYFNLRSDFPEFKIDSDTILSPVFDSSAGSNEDNNKKKNYRGVRRRPWGKFAAEIRDPSRKGSRIWLGTFDTDIDAARAYDCAAFKMRGRKAILNFPLDAGKSGAPANVGRKRRRENKMELV

SEQ ID NO: 20632 - protein, 324 aa, Xenopus laevis
MALHKDSYVLLNDGNKMPVIGYGTYAPQKVPKSLAEEGTKVAIDVGYRHIDAAFMYQNEVEVGRAIREKIADGTVKREDLFYTGKLWSNFHTPERVRHGLEKSLEDLQLDYMDLFIIHTPFELKPGDDPFPVDENGKFLYHNTDLRDTWKAMEALKEAGLVKSIGVSNFNKTQLEWILSMPGLKYKPVCNQVECHLYLNQSKLLEFCKSKDIVLVGYSVLGSSRDENWIDQNSPVLLEDPVLNAIAKKHNRTPAQVAMRYQLQRGVVVLAKSFTPARIKQNFQLFDFQLNSEEMETLNGVDKNMRYLDLKPFADHPKYPFADEY

SEQ ID NO: 20633 - protein, 386 aa, Danio rerio
LEEARADEPGKAEVSQLASGDRSAGMSQKERPTFYRQEVNKTIWEVPVQYQNLSPVGSGAYGSVCSAFDAKTGFKVAVKKLSRPFQSIIHAKRTYRELRLLKHMRHENVIGLLDVFTPATSLKEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNVTVDIWSVGCIMAELLTGRTLFPGTDHINQLQQIMRLTGTPPSSLISRMPSHEARTYISSLPQMPKRNFADVFIGANPQAVDLLEKMLVLDTDKRITAAEALAHPYFAQYHDPDDEPEAEPFDQSFESRELDIEEWKRQTYEEMISFEPPVFDVDEMES

SEQ ID NO: 20634 - protein, 765 aa, Vigna radiata var. radiata
MGAAILPDLGTEILIPVCAVIGIAFALFQWLLVSKVKLSAVRDASPNAAAKNGYNDYLIEEEEGINDHNVVVKCAEIQNAISEGATSFLFTEYKYVGIFMVAFAILIFLFLGSVEGFSTSPQACSYDKTKTCKPALATAIFSTVSFLLGGVTSLVSGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGLNHELTAMLYPLIVSSVGILVCLLTTLFATDFFEIKAVKEIEPALKKQLVISTVLMTIGVAVVSFVALPTSFTIFNFGVQKDVKSWQLFLCVAVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRASITTVDVLTPKVFIGLIVGAMLPYWFSAMTMKSVGSAALKMVEEVRRQFNTIPGLMEGTAKPDYATCVKISTDASIKEMIPPGALVMLTPLVVGILFGVETLSGVLAGSLVSGVQIAISASNTGAWDNAKKYIEAGASEHARSLGPKGSDCHKAAVIGDTIGDPLKDTSGPSLNILIKLMAVESLVFAPFFATHGGLLFKIF

SEQ ID NO: 20635 - protein, 579 aa, Cucurbita maxima
MLQMGKAREPNFLILFFFGLILAFGISSEGSQIRHYKWEVEYMFWAPDCNENIVMGINGQFPGPTIRANAGDTVVVELINKLHTEGVVIHWHGILQRGTPWADGTASISQCAINPGETFFYNFTVDNPGTFFYHGHLGMQRSAGLYGSLIVDPPQGKKEPFHYDGEINLLLSDWWHQSIHKQEVGLSSKPIRWIGEPQTILLNGRGQFDCSIAAKYDSNLEPCKLKGSEPCAPYIFHVMPKKTYRIRIASTTALAALNFAIGNHPLLVVEADGNYVQPFYTSDIDIYSGESYSVLITTDQNPSENYWVSVGTRGRHPNTPPGLTLLNYLPNSVSKLPTSPPPETPAWDDFDRSKNFTYRITAAMGSPKPPVKSNRRIFLLNTQNVINGYVKWAINDVSLALPPTPYLGAMKFNLLHAFDQNPPPEVFPEDYDIDTPPTNEKTKIGNGVYQFKIGEIVDVILQNANMMKENLSEIHPWHLHGHDFWVLGYGDGKFTAEEESSLNLKNPPLRNTVVIFPYGWTAIRFVADNPGVWAFHCHIEPHLHMGMGVVFAEGVEKVGRIPTKALACGGTAKSLINNP

SEQ ID NO: 20636 - protein, 777 aa, Danio rerio
MSSNRTQTPHGLKQIGLDQIWDDLRAGIQQVYTRQSMAKSRYMELYTHVYNYCTSVHQSNQVRGGGPAPSKPSKKTPTPGGAQFVGLELYKRLKEFLKNYLTNLLKDGEDLMDESVLKFYTQQWEDYRFSSKVLNGICAYLNRHWVRRECDEGRKGTYEIYSLALVTWRECLFRPLNKQVTNAVLKLIEKERNGETINTRLISGVVQSYVELGLNEDDAFAKGPTLSVYKEYFETQFLADTERFYTRESTEFLQQNPVTEYMKKAEARLLEEQRRVQVYLHESTQDELARKCEQVLIEKHLEIFHTEFQNLLDADKNEDLGRMYNLVSRITDGLGELKKLLETHIYNQGLAAIEKCGESALNDPKMYVQTILDVHKKYNALVMSAFNNDAGFVAALDKACGRFINNNAVTKMVQSSSKSPELLARYCDSLLKKSSKNPEEAELEDTLNQVMVVFKYIEDKDVFQKFYAKMLAKRLVHQNSASDDAEASMISKLKQACGFEYTSKLQRMFQDIGVSKDLNEQFKKHLTNSEPLDLDFSIQVLSSGSWPFQQSCTFALPSELERSYQRFTAFYASRHSGRKLTWLYHLSKGELVTNCFKNRYTLQASTFQMAILLQYNTEDVYTVQQLTDSTQIKIDILVQVLQILLKSKLLVLEDENANVDEVEFKPDTLIKLFLGYKNKKLRVNINVPMKTEQKQEQETTHKNIEEDRKLLIQAAIVRTMKMRKVLKHQQLLAEVLNQLSSRFKPRVPVIKKCIDILIEKEYLERVDGEKDTYSYLA

SEQ ID NO: 20637 - protein, 532 aa, Daucus carota
MGGCFSKKEYQADGNGYRSAPTAYHTVTDQSYEKSSQRSQPQAQPQPQVQQTGPSLKPRQVHRPESNTILGKPFEDIRGKYTLGKELGRGQFGCVYQCTENSSGQLYACKSILKRKLVSKNDKEDIKREIQILQHLSGQPNIVEFKGVFEDRQSVHLVMELCAGGELFDRIIAQGHYSERAAATICRQIVNVVHVCHFMGVMHRDLKPENFLLSSKDKDAMLKATDFGLSVFIEEGKVYRNIVGSAYYVAPEVLRRSYGKEIDIWSAGVILYILLSGVPPFWAENEKGIFDAILEGVIDFESEPWPSVSNSAKDLVRKMLTQDPRRRITSAQVLDHPWMREGGEASDKPIDSAVLSRMKQFRAMNKLKQLALKVIAESLSEEEIKGLKSMFANMDTDKSGTITYEELKSGLARLGSKLSEVEVQQLMDAADVDGNGTIDYLEFITATMHRHKLESYEHQAFQYFDKDNSGFITKDELESAMKEYGMGDEATIKDIISEVDSDNDGRINYDEFCAMMRRARNRRKLFSVSLTS

SEQ ID NO: 20638 - protein, 386 aa, Danio rerio
MEMHALRNASNPIYVGAKGGPVSGAVRRPVFGELSNLSHKPVQTKKVVPMQSVKPTGRSAVVHPKSAQVQHEAPKPAATVPPAQADVSMKEEELCQAFSNSLFPVDDIDEGDADMPQLCSEYVKDIYSYLRRLEGQQSVRPRYMEGYDINGRMRALLVDWLIQVHSRFQLLQETLYMTVAILDRFLQVQPVTRRKLQLVGVTAMLIACKYEEMYVPMVGDFAYIADDAFTKAQIREMEMLMLSGLNFKLGRPLPLHFLRRASKAGNADAEKHTLAKYFLELTLLDYDMVHYNPSETAAAALCLSQLVLDGQKWSSTQQHYSTYDEAHLKPIMQLIAKNVVMVNEGLSKHLTVRKKYASSRLMKISLLPQLKSSLVKDLAAPLMPSS

SEQ ID NO: 20639 - protein, 300 aa, Danio rerio
MVKDQEVERIAKKLDKMVHKKNTDGAIDLLQELKNMKMSLETLQSTRIGMSVNAVRKQSSDEEVQTLAKSLIKAWKKLLDGSEGKPEEKKGESPLQSSSSKDPGSSDTSNKPETPKTPTTPVTPKFTMFPPAPVTTDSVRTKCRELLVAALQTDGDHQTIGADCEHMAAQIEDYIYQEFKSTDMKYKTRLRSRISNLKDQKNPDLRRNVLCGNISPERIASMTAEEMASPELKEIRKALTKESIREHQLSKVGGTETDMFVCGKCKGKNCTYTQVQTRSADEPMTTFVLCNECGNRWKFC

SEQ ID NO: 20640 - protein, 392 aa, Danio rerio
MAESGSSAAAAGAAGSNSSAAGPGGAVAPGGPSGAAGSKPGLESVKGQNFDVGPRYTDLQYIGEGAYGMVCSAFDNVNKIRVAIKKISPFEHQTYCQRTLREIKILLRFHHENIIGINDILRARHIDYMRDVYIVQDLMETDLYKLLKTQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGVLGSPSQDDLNCIINMKARNYLQSLPQKPKIPWNKLFPKADNKALDLLDRMLTFNPLKRINVEQALAHPYLEQYYDPSDEPVAEEPFTFNMELDDLPKEKLKELIFEETARFQANYQGS

SEQ ID NO: 20641 - protein, 397 aa, Danio rerio
MALRVTRNTRLASSENQNALPGKAVVANKPGLRPRAALGEIGNNPQTRQALKKKEVKVAPAAEVVVEKAPVVQQPKKDSPKVQHGVKVVSEPSSPVPMETSGCASDDLCQAFSDVLLNIKDVDADDYDNPMLCSEYVKDIYLYLRQLETEQAVRPKYLAGKEVTGNMRAILIDWLVQVQIKFRLLQETMYMTVAIIDRFLQDHPVPKKQLQLVGVTAMFIASKYEEMYPPEIADFAFVTDRAYTTSQIREMEMKVLRVLNFGFGRPLPLQFLRRASKIGDVTAEHHTLAKYFLELTMVDYDMVHYPPSQMASAAYALTLKVFNCGDWTPTLQHYMGYTEDELVPVMQHIAKNVVRVNEGLSKHLAVKNKYSSQKQMRIATISQLKSSLIKDLAKQIS

SEQ ID NO: 20642 - protein, 433 aa, Danio rerio
MSEKLPFKVADISLAEWGRKAIEIAENEMPGLMKMRELYGQSKPLKGARIAGCLHMTLQTAVLIETLTALGAEVQWSSCNIFSTQDHAAAAIAKTGVPVYAWKGETDEEYVWCIEQTIYFKDGQPLNMILDDGGDLTNLVHQKYPKLLAGIKGISEETTTGVHNLYKMLKSGELKVPAINVNDSVTKSKFDNLYGCRESLIDGIKRATDVMIAGKVAVVAGYGDVGKGCVQALRGFGARVIVTEIDPINALQAAMEGYEVTTMDEACKEGNIFVTTTGCEDILLGRHFEHMKDDSIVCNIGHFDCEIDMKWLNEHAAKKINIKPQVDRYRMKNGRHIIVLAEGRLVNLGCAMGHPSFVMSNSFTNQVLAQIELWKNNSKYPLGVYFLPKKLDEEVAAAHLDKLGVKLTKLTEKQAKYLGLPSEGPFKPDHYRY

SEQ ID NO: 20643 - protein, 410 aa, Danio rerio
MLSRLRGAAAKNRVENRENVNPNPKAANNRTVLGELENSQRRQLGLRGAKQGSGPQIIACKPEENARSFGERPSNRQPAAFQIHVDEPDGACSKKAPLQRSTMDCSPLTLNPTVTRLRQPLATIDLPLEASFDSPMDMSVIDCEERPTNVNEVSDYAAEIHTHLREMEVKSKPKAGYMRKQPDITNSMRAILVDWLVEVGEEYKLQNETLYLAVNYIDRFLSSMSVLRGKLQLVGTAAMLLASKFEEIYPPEVAEFVYITDDTYTKKQVLRMEHLVLTVLSFDLAAPTINQFLTQYFLHQPVSSKVESLSMFLGELSLIDCDPFLKYLPSQMAAAAFILANHTLASGSWSKSLVDLTGYSLEDLLPCVQDLHQTYLAASQHAQQAVREKYKGSKYHEVSLIEPPEKLMLN

SEQ ID NO: 20644 - protein, 286 aa, Danio rerio
MDEEMSRQTATALPTGTSKCPPSQRVPTLSGTTASNSDLASLFECPVCFDYVLPPILQCQSGHLVCSNCRPKLTCCPTCRGPLGSIRNLAMEKVANSVLFPCKYASSGCEVTLPHTDKAEHEELCEFRPYSCPCPGASCKWQGSLDAVMPHLLHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 20645 - protein, 505 aa, Danio rerio
MSLVCAISNEVPEHPCVSPVSNQVFERRLIEKYIAENGADPINGQPLSEEQLIDIKVSHPIRPKAPSATSIPAILKSLQDEWDAVMLHSFTLRQQLQTTRQELSHALYQHDAACRVIARLTKEVTAAREALATLKPQAGLVAPQAAPASQPAAVGAGGEAMEVSEQVGMTPEIIQKLQDKATVLTTERKKRGKTVPEELVRAEDLSKYRQVGSHAGLHSASVPGILSLDLCPTDTNKVLTGGADKNVVVFDRREEQIVATLKGHTKKVSSVIYHPAQAVVFSASSDSTIRVWSVTGGNCVQVVRAHESAVTGLSLHATGDYLLSSSEDQYWAFSDIQTGRVLTKVTDETAGCALTCAQFHPDGLIFGTGTGDSQIKIWDLKERTNVANFPGHSGPVTAIAFSENGYYLATGAQDSSLKLWDLRKLKNFKTITLDNNYEVKSLVFDQSGTYLAVGGSDIRVYICKQWSEVLNFSDHSGLVTGVAFGEHAQFLASTGMDRSLKFYSL

SEQ ID NO: 20646 - protein, 354 aa, Xenopus laevis
MGCTLSAEDKEAAERSKMIDRNLREDGEKASKEVKLLLLGAGESGKSTIVKQMKIIHEDGYSEEECRQYKVVVYSNTIQSIIAIIRAMGRLRIDFGDVARADDARQLFVLASSAEEGVMSPELAGVIQRLWEDSGVQACFSRSREYQLNDSASYYLNDIERIAQGSYIPTQQDVLRTRVKTTGIVETHFTFKDLYFKMFDVGGQRSERKKWIHCFEGVTAIIFCVALSDYDLLLAEDEEMNRMHESMKLFDSICNNKWFIDTSIILFLNKKDLFEEKISRSPLTICYPEYSGSNTYEEAAAYIQCQFEDLNRRKDTKEIYTHFTCATDTKNVQFVFDAVTDVIIKSNLMECGLY

SEQ ID NO: 20647 - protein, 362 aa, Danio rerio
MACPTHFLCKALRTVGLVLFYYAFSIGITFYNKWLMKDFHFPLFMTLVHLTIIFCLSTLTRSAMQCWTGKPRVTLPWKVYLSKVAPTALATTLDIGLSNWSFLFITISLYTMTKSSAVLFILFFSLLFKLEEPNPFLILVVVLISSGLFMFTLKSTQFNLEGFIMVLLASFIGGIRWTLTQLLMQKAELGLQNPIDTMYHLQPLMFLGLFPLFLLNEGLSVSTTEKLFRVSELSHLLYSLVTLSVGGMLAFGLGFSEFLLVSRTSSLTLSIAGIFKEVCTLLLAVEFLGDKMSTVNWLGFAVCLSGISLHIGLKTYRNKVGNGPMVRNLQVRENPHLELPLLQTKDDYCEDTNDEEEHEILY

SEQ ID NO: 20648 - protein, 255 aa, Danio rerio
MGDREDLVYQAKLAEQAERYDEMVDSMKKVAGMDVELTVEERNLLSVAYKNVIGARRASWRIISSIEQKEENKGGEDKLKMIREYRQTVENELKSICNDILDVLDKHLIPAANSGESKVFYYKMKGDYHRYLAEFATGNDRKEAAENSLVAYKAASDIAMTDLQPTHPIRLGLALNFSVFYYEILNSPDRACRLAKAAFDDAIAELDTLSEESYKDSTLIMQLLRDNLTLWTSDMQGDGEEQNKEALQDVEDENQ

SEQ ID NO: 20649 - protein, 229 aa, Danio rerio
MSGESLLDRKPAPDCCGGFNNLEFSQMDVSVLWELWSLVDLTEPRFCVAVIAIIFNPFFWNVVARWEHRTRGLTRLFGGPYVACYSLAVLILLLNVYRSHSVTVAMKGQSRWDLLENLQVYYAGAALMAVGSLLVISSFLALGVTGTFLGDYFGILMDQKVTGFPFNVMDNPMYWGSTANYLGLALMNASPIGIVLTAVVALSYKVAIAYEGPFTQEIYRQRSQRCKHK

SEQ ID NO: 20650 - protein, 241 aa, Danio rerio
MGEPQQVSALPPPPMQYIKEYTDENVRKGLAPKPPPPIRDSYMMFGNQFQCDDLIIRPLESQGIERLHPMQFDHKRELKKLNMSILVNFLDLLDILIKSPGSIKREEKLEDLKLLFVHMHHLINEYRPHQARETLRVMMEVQKRQRLETAERFQKHLERVVEMIQGCLSSLPDDLPLPNSSSMGEAGSAAGSSRLKTEPMDVDDVAGASCMVLQTDKNVPVKKDGVCDNDVVMCRIIDEMT

SEQ ID NO: 20651 - protein, 504 aa, Xenopus laevis
MSLTCYISNEVTDRPCISPVSGHIFDRRLIEKYLAENGTDPVTNQPLSEDQLIDIKVAHPIRPKPPSATSIPAILKSLQDEWDAVMLHSFTLRQQLQTTRQELSHALYQHDAACRVIARLTKEVTAAREALATLKPQAGISVPQASPMPPTGAAGSAEAMELGELVGMSAEIIQKLQDKATVLTTERKKRGKTVPEDLVKPEELSKYHQVSSHVGLHSASVPGILALDLCPTDTNKTLTGGADKSVVVFDALSQQILATLKGHTKKVTSVVFHPSQELVFSSSPDSTIRVWSVPDASCAQVLRAHEGAVTGLSLHATGDYLLSCSDDQYWAFSDVHVGRVLTKVTDESSGCALTCAQFHPDGLIFGTGTVDSQIKIWDLKERSNVANFPGHSGPVSCIAFSENGYYLATAADDSSVKLWDLRKLKNFKTLQLEEGYQVCSLVFDQSGTYLAVGGTDIQVYICKQWAEVLHFTDHSALTTGLAFGQNAKFLASTGMDRSLRFYSL

SEQ ID NO: 20652 - protein, 195 aa, Zea mays
APLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 20653 - protein, 195 aa, Zea mays
APLDKVCVLSCGISTGLGASINVAKPPKGSTVAIFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 20654 - protein, 195 aa, Zea mays
  unsure (1)..(195): unsure at all Xaa locations
APLDKVCVLSCGISTGLGASINVAKPPKXSTVAIFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKA

SEQ ID NO: 20655 - protein, 576 aa, Thanatephorus cucumeris
MARTTFLVSVSLFVSAVLARTVEYGLKISDGEIAPDGVKRNATLVNGGYPGPLIFANKGDTLKVKVQNKLTNPEMYRTTSIHWHGLLQHRNADDDGPSFVTQCPIVPRESYTYTIPLDDQTGTYWYHSHLSSQYVDGLRGPLVIYDPKDPHRRLYDVDDEKTVLIIGDWYHESSKAILASGNITRQRPVSATINGKGRFDPDNTPANPDTLYTLKVKRGKRYRLRVINSSEIASFRFSVEGHKVTVIAADGVSTKPYQVDAFDILAGQRIDCVVEANQEPDTYWINAPLTNVPNKTAQALLVYEEDRRPYHPPKGPYRKWSVSEAIIKYWNHKHKHGRGLLSGHGGLKARMIEGSHHLHSRSVVKRQNETTTVVMDESKLVPLEYPGAACGSKPADLVLDLTFGLNFATGHWMINGIPYESPKIPTLLKILTDEDGVTESDFTKEEHTVILPKNKCIEFNIKGNSGIPITHPVHLHGHTWDVVQFGNNPPNYVNPPRRDVVGSTDAGVRIQFKTDNPGPWFLHCHIDWHLEEGFAMVFAEAPEAVKGGPKSVAVDSQWEGLCGKYDNWLKSNPGQL

SEQ ID NO: 20656 - protein, 280 aa, Petunia x hybrida
MGRAPCCEKMGLKKGPWTPEEDQILVSYIEKNGHGNWRALPKLAGLLRCGKSCRLRWTNYLRPDIKRGNFTREEEDTIIQLHEMLGNRWSAIAARLPGRTDNEIKNVWHTHLKKRLKNYQPPQNSKRHSKNNHDSKAPSTSKMLDNSESFSTIQENINEPMTGPNSPQRSSSESSTVTADSLAATDVTNDDQTFIKHEEMDSYENFPEIDESFWTEDLSMGDNLDLDMEVAGEKSQVQFPYSHDMKEQSVDMVGAKLEDDMDFWYNVFIKAEDLLDLPEF

SEQ ID NO: 20657 - protein, 421 aa, Petunia x hybrida
MGRSPCCDKVGLKKGPWTPEEDQKLLAYIEEHGHGSWRALPAKAGLQRCGKSCRLRWTNYLRPDIKRGKFTLQEEQTIIQLHALLGNRWSAIATHLPKRTDNEIKNYWNTHLKKRLVKMGIDPVTHKPKNDALLSHDGQSKNAANLSHMAQWESARLEAEARLVRQSKLRSNSFQNPLASHELFTSPTPSSPLHKPIVTPTKAPGSPRCLDVLKAWNGVWTKPMNDVLHADGSTSASATVSVNALGLDLESPTSTLSYFENAQHISTGMIQENSTSLFEFVGNSSGSSEGGIMNEESEEDWKGFGNSSTGHLPEYKDGINENSMSLTSTLQDLTMPMDTTWTAESLRSNAEDISHGNNFVETFTDLLLSTSGDGGLSGNGTDSDNGGGSGNDPSETCGDNKNYWNSIFNLVNSSPSDSAMF

SEQ ID NO: 20658 - protein, 621 aa, Podospora anserina
MMKSFFSAAALLLGLVAPSAVLAAPSLPGVPREVTRDLLRPVEERQSSCHTAANRACWAPGFDINTDYEVSTPNTGVTRTYTLTLTEVDNWLGPDGVVKQKVMLVNGDIFGPTITANWGDWIQVNVINNLRTNGTSIHWHGLHQKGTNMHDGANGVTECPIPPKGGSRIYRFRAQQYGTSWYHSHFSAQYGNGVVGTIVVNGPASVPYDIDLGVFPITDYYHKPADVLVEETMNGGPPPSDTVLFKGHGKNPQTGAGKFANVTLTPGKRHRLRIINTSTHDHFQLKLQNHTMTIIAADMVPVQAQTVDSLFLAVGQRYDVTIDANKSVGNYWFNATFGGGLACGASLNPHPAAVFRYQGAPNTLPTNIGTPAADANCMDLNNLTPVVSRSVPTSGFTPRPNNTLPVSLTLGGTPLFVWKVNGSSINVDWDKPIVDYVIAQNTSYPPQANVITVNSVNQWTYWLIENDPTGPFSIPHPMHLHGHDFLVVGRSPDQPAGVPQTRYRFNPATDMALLKSSNPVRRDVAMLPANGWLLIAFKSDNPGAWLFHCHIAWHVSGGLSVQYLERPNDLRNGFSQADKNQHNNNCNAWRAYWPTNPFPKIDSGLKVKKWVGEHPDWYIKN

SEQ ID NO: 20659 - protein, 737 aa, Drosophila melanogaster
MAFVSNAIVGPENCKSVTVSLPPIPYPKSVAFIISNEFCERFNYYGMRTILVLYLTNKLGYNEETATVLFHTFTMLVYIFPLIGALIADGWLGKYKTILYLSLVYSLGAMVVSFGAVPLSGMPTKAVTVVGLLLIAIGNGGINPCVSPFGGEQFSLPAQSFQLAKFFSLFYFAINAGSLISTTFTPILRADVHCFGDQDCFSLAFGVPAILMIFSVIIFMAGKRLYRCQPPAGNMIFGVSRCIADAFKGWQKRRHSEPMESFLDYAKPTVGSRMVQETKCLGRILRLFLPFPVFWALFDQQGSRWTFQATRMDGNVLGFQIKPDQMQVVNPLLILGFLPLFDYIIYPALARCGIRRPLQKLTLGFLLAALGFFLSAGLEMKMEQAAYRATPIEPDMTHLRIYNGMPCRYEISSAVVQTPRVIEPLNVWEDLSLQMTESKEYTFNAQPVSGECPSIIDKLRLQPGKSVSYFLAQDKLVEFADGLQMAATDTGRTSVRALLNTPDGEGPVLLSTESATSQEPPLTLDKGNVPQLHRITPGFARVDINGKKVASFEAKEGRLYSILVTGSARDGYQHNVIEVVAPSTVSILWQLPQIVVMTAAEVMFSVTGLEFSYSQSPPSMKSVLQACWLLSVAIGNMLVVVIAEFKFTSSQSGEFTLFASLMLVDMMIFLWLARSYQYKDQREDFEDDDDATIDSVMQSKPKATTVDTTARKTNGIEAEPGYGAYRNHAYDNDFSEA

SEQ ID NO: 20660 - protein, 120 aa, Mangifera indica
GLDYLFHLYEQCRDFLIQVQNIAKERGEKCPTKVTNQVFRFAKKAGASYINKPKMRHYVHCYALHCLDEEASDALRRVFKERGENVGAWRQACYKPLVGIAARQGWDIDTIFNAHPRLAI

SEQ ID NO: 20661 - protein, 808 aa, Oryza sativa; identical to SEQ ID NO: 3286

SEQ ID NO: 20662 - protein, 529 aa, Rattus norvegicus
MPSVYGFPAFTSATELLLAVTTFCLGFWVVRVTRTWVPKGLKSPPGPWGLPFIGHVLTLGKNPHLSLTKLSQQYGDVLQIRIGSTPVVVLSGLNTIKQALVKQGDDFKGRPDLYSFTLIANGQSMTFNPDSGPLWAARRRLAQNALKSFSIASDPTLASSCYLEEHVSKEAEYLISKFQKLMAEVGLFDPFKYLVVSVANVICAICFGRRYDHDDQDLLSIVNLSNEFGEVTGSGYPADFIPIPRYLPNSSLDAFKDLNKKFYSFSKKLIKEHYRTFEKGHIRDITDSLIEHCQDRRLDENANVQLSDDKVITIVFDLFGAGFDTITTAISWSLSYLVTNPRIQRKIQEELDTVIGRDRQPRLSDRPQLPYLEAFILETFRHSSFVPFTIPHSTIRDTSLNGFYIPKGHCVFVNQWQVNHDQELWGDPNEFRPERFLTSSGTLDKHLSEKVLSEKVILFGLGKRKCIGETIGQLEVFLFLAILLQQMEFNVSPGEKVDSTPAYGLTLKHARCEHFQVQMRSSGPQHLQA

SEQ ID NO: 20663 - protein, 1013 aa, Oryza sativa (japonica cultivar-group)
MGVGGGGGGGGGEAAAAVAVEGDEAGKGRRWWRVKVKLSTVAVVAWVLASAALWAGLHWRFRRAALHKAEEALVCMCEERARMLQDQFAVSVNHVHALAILVATFHYDKHPPALDQDTFAVYAARTSFERPLLSGVAYAQRVVHADRESFERQQGWIIKTMKHEPSPAQDEYAPVIYSQETISYIEGLDVMSGEEDRENILRARATGKAVLTRPFRLMSNHLGVVLTFPVYLVDLPNDTAVEDRVAATAGYLGGAFDVESLVENLLRQLAGNQELVVNVYDVTNHSNPLVMYGSEVPLGIPSPSHTYTLDFGDPLRKHQMVCRYRNKLHVSWSAITTPSGVFVICMLVGYIIYAAWSRYDNVKEDCRKMEALKKRAEAADIAKSQFLATVSHEIRTPMNGVLGMLDMLLDTELKSTQRDYAQTAQVCGKALISLINEVLDRAKIEAGKIDLESVPFDLRSILDDVISLFSSKSREKGIELAVYVSERVPEILLGDPGRFRQIITNLVGNSIKITIFTLSQFTERGHIFVQVHLADHSNLATEAKIEPVVNGMNGHKDEAIAIPTSGSHNTLSGFEAADSRNNWENFKLLLSYEKNEMPYESDSDKVTLVVSVEDTGIGIPLHAQGRVFTPFMQADSSTSRNYGGTGIGLSISKCLVEIMGGQINFVSRPLVGSTFTFTAVLRRCDKNAISDSKTVALHPLPSSFKGLSALLVDKRPVRATVTKYHLQRLGITSEVVGTIDPTFGVLSGRNGSSLTSIGKKQPCMLLIESDSWGPQMDVSLHARLQEMKQSDRIHVLPKVFLLSAAESDKVKKIHAVDSVIPKPLKASALAACLFQALGITQPSHEKRDDSGSLHGRDGSGSLHGLLLGKNILVVDDNKVNLRVAAGTLKKYGAKVECVESGKDALSLLQVPHKFDLCLMDIQMPEMDGFEATRQIRAMEGKANEQADDSESGSEIAAKTAKWHLPILAMTADVIQATHEECTKCGMDGYVSKPFEEKQLFQAVQKFLGPCVSS

SEQ ID NO: 20664 - protein, 385 aa, Populus nigra
MAIDCIKTMPSITTPHHHPKDQDQCKDDGKSFVFDAQVLRHQTNIPQQFIWPDHEKPNINAPELQVPLVDLGDFLSGNPVAAVEASRLVGEACQKHGFFLVVNHGVDKTLIAHAHNYMDTFFELPLSEKQKAQRKIGESCGYASSFTGRFSSKLPWKETLSFRYTAEKNSSKHIEEYFHNRMGEDFAEFGRVYQDYCEAMSTLSLGIMELLGMSLGVSREHFREFFNENDSIMRLNYYPPCQKPDLTLGTGPHCDPTSLTILHQDQVGGLQVFVDNEWRSISPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQQSFS

SEQ ID NO: 20665 - protein, 476 aa, Sphingomonas paucimobilis
MTAYPSLHMIIDGEAVTGGDRRTQTIVNPATGETLGELPLADTADLDRALETAQRGFQRWRNSTPQERAAVLSGAARLLMERQETLARIATMEQGKTLAESRIEVMMVAGLFNFYAGEVFRLYGRALVRPAGTRSTVTYEPVGPLAAFSPWNFPLGNPGRKLGAPIAAGCSVIMKSAEETPASALGVLQCLLDAGLPSDVAQAVFGVPDEVSRYLLASPVIRKLSFTGSTVVGKHLAKLAADDLKRTTMELGGHGPVLVFNDVDVDRVLEVMVGHKYRNAGQVCVSPTRFIVQEDVYETFRDGFAERAKALRVGNGLEDGIQMGPMANARRPDAMERLNRSAVDAGATLNAGGERIGNQGFFYAPSVLSDVPLDAEIMNEEPFGPVALINPYRTADEMIAEANRLPYGLAAYSWTNDVKMQRRIAREVETGMLGINSVAIGGADSPFGGVKWSGHGHEDGPEGVQACLVTKAVHEG

SEQ ID NO: 20666 - protein, 509 aa, Prunus cerasus
MTDRRAQDNAVSGQPLLKKKPKRNLYAIGCAILASMTSILLGYDIGVMSGASIYIQKDLKISDVEVEILIGILNLYSLIGSAAAGRTSDWIGRRYTIVFAGAIFFTGALLMGLATNYAFLMVGRFVAGIGVGYALMIAPVYNAEVSPASSRGALTSFPEVFVNIGILLGYVANYAFSGLPIDLGWRLMLGVGVFPSVILAVGVLSMPESPRWLVMQGRLGEAKQVLDKTSDSLEEAQLRLADIKEAAGIPEHCVEDVVQVPKHSHGEEVWKELLLHPTPPVRHILIAAIGFHFFQQLSGIDALVLYSPRIFEKAGITDSSTLLLATVAVGFSKTIFTLVAIGFLDRVGRRPLLLTSVAGMIASLLCLGTSLTIVDHETEKMMWASVLCLTMVLAYVGFFSIGMGPIAWVYSSEIFPLKLRAQGCSMGTAVNRIMSGVLSMSFISLYKAITMGGTFFLYAGIATVGWVFFYTMLPETQGRTLEDMEVLFGKFWRWREGYALLRNKRAVVC

SEQ ID NO: 20667 - protein, 506 aa, Drosophila melanogaster
MDEMDNKRGENIRHAVPFVRQITEDGKPKLEVYRPTTNPIYIWTQVLAALSVSLGSLVVGFVSAYTSPALVSMTDRNITSFEVTQDAGSWVGGIMPLAGLAGGIAGGPLIEYLGRRNTILATAVPFIVSSLLIACAVNVAMVLCGRFLAGFCVGIASLSLPVYLGETVQPEVRGTLGLLPTAFGNIGILLCFVAGSFMNWSMLAFLGAALPVPFLILMFLIPETPRWFVGRGLEERARKALKWLRGKEADVEPELKGLMRSQADADRQASRNTMLELLKLNNLKPLSISLGLMFFQQFSGINAVIFYTVQIFKDAGSTIDGNLCTVIVGIVNFLATFIGIVLIDRAGRKILLYVSDIAMVLTLFVLGGFFYCKTYGPDVSHLGWLPLTCFVIYILGFSLGFGPIPWLMMGEILPAKIRGSAASVATAFNWFCTFVVTKTFQDLTVAMGAHGAFWLFGAICFVGLFFVIIYVPETQGKTLEDIERKMMGRVRRMSSVANIKPLSFNM

SEQ ID NO: 20668 - protein, 733 aa, Drosophila melanogaster
MGSFWQQHVATPSSSTPFDSPFFSATHGLVQTHPSIGGSHSGPAPLNGNSLGSGAPSSILAGTKPALTAGSGYLNSRGSLPTSARYPANKITGTVVEPNPKSPFRHLDFSTSATAELRRNPALSAPDECARACREGEPPRICYYHFTLEYYAVLGAACQVCTPNATNTVWSHCQCVLADGVERGILTANRMIPGPSIQVCENDKVVIDVENHMEGMEVTIHWRGIWQRGSQYYDGVPFVTQCPIQQGNTFRYQWTGNAGTHFWHAHTGLQKLDGLYGSVVVRQPPSRDPNSHLYDFDLTTHIMLISDWLHEDAAERYPGRLAVNTGQDPESMLINGKCQFRDPNTGFMTNTPLEIFTITPGRRYRFRMINAFASVCPAQVTIEGHGMTVIATDGEPVHPVDVNTIISFSGERYDFVISADQPVGAYWIQLRGLGECGIRRAQQLAILRYARGPYQPASSPPTYDVGIPQVVVMNPLDAQCNRQRNDAICVSQLKNALEIDRGILAEKPDVKIFLPFRFFVYRAEDLFQPNTYNRFLVAPTGDHVISLIDEISYLSAPAPLTSQYNDINPDQFCNGDNRPADCGPNCMCTHKIDIPLNAIVEVVLVDEVQQPNLSHPFHLHGYGFSVIGIGRSPDSSVKKINLKHALDLDRRGLLHRQYNLPPTKDTIAVPNNGYVVLRFRADNPGFWLFHCHFLFHIVIGMNLILQDGTNADLPPVPPGFPTCGDHTPSIPIN

SEQ ID NO: 20669 - protein, 348 aa, Drosophila melanogaster
TSNMCDRVREGILVGCGNPLLDISAVVPLNFLQKYSMNEDDAILAEDRHMPIYGELVEGYQAEFLAGGSVQNSLRIAQWILRQPRVAVFFGCVGEDRYANILKEKAQAAGLDVHYQVKKDVPTGTCAVLITGTHRSLCANLAAANNFTIDHLEEPSNKALVDNAQYYYISGFFLTVNPPSIMQVAATAHAKQRPFLMNLSAPFISQFYMAPLLAALPYVDIIFGNEAEAQAFAEAQQWPSGDLREIGKRLVAMEKKNPTRPRIAILTQGCDPVLLIQQDSVQEFPVTKLAVHEIVDTNGAGDAFVGGFLSQFVQGKSLDVCIRCGNYAAGHIIKNPGCTYSGEPEFVE

SEQ ID NO: 20670 - protein, 182 aa, Drosophila melanogaster
PISYFSLNHSFVVVWQIERQGKPKMDAPTIKLESSDGVIFSTEVKAAKLSETIKTMLEVSAVENDENAVVPLPKVNAFILDKILTWAYHHKDDDDQAAEGEELTPQSPHDISPWDANFINVDQPILFEITVAANYLEIKGLEDLCCKTLANMIRGKTPEEIRQTFNIEDDLPIDTAELGEDL

SEQ ID NO: 20671 - protein, 582 aa, Drosophila melanogaster
DQKMREPPRYCSLAQFVEGNDIARQSFKQLMLEQHRGGDNDSDYPEHEQTPTNKGANLLATTSEDELSTQTAIKIEIQDIDATVRNLNSSMKPNTILTTSTSPTKKSGHGQDISVVVRPPTPLRGDCIKPTVSLLPVSSGGAMTVSMTCSGMLGVRAMNASEIRRHSSHAPGLAVREFDKDKDRRHSGFNPNQLTLDPEHARFLSSSPAASRRISCGSLFKPNEALPNLQTLKGSKSSLFMGSTLFGFDHLASAEKDKEEKSGKDKEKTPTDETNRKLPIINPLVRLPNWPNLANGGGFISKCLLANADTLCAAVSPLMDPDETLLAGYHEKCVMNNYFGIGIDAKISLDFHNKREEHPEKCRSRARNYMWYGVLGSKQLLQKTCKNLEQRVQLECDGQRIPLPELQGIVILNIPSFMGGTNFWGSSKKDDIFLPPSFDDRVLEVVAVFGSVQMAASRLINLQHHRIAQCQSVQINILGDEEIPIQVDGEAWLQPPGMIRILHKNRVQMLCRNRSLELSLKSWQEKQRQHSISIQRDASSTASEHANSTDEVISERECYVLLNFIEAVSSLVKWVKFLIISQ

SEQ ID NO: 20672 - protein, 708 aa, Homo sapiens [sequence omitted]

SEQ ID NO: 20673 - protein, 304 aa, Arabidopsis thaliana
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDSAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGGGGEGRRGEFMTVVQEMIKAEVRSYMAEMQKTSGGFVVGGLYESGGNGGFRDCGIITPKVE

SEQ ID NO: 20674 - protein, 116 aa, Rhizobium etli
MGNQMKIVMAIIKPFKLDEVREALTAIGIQGLTVTEVKGYGRQKGHTEIYRGTVYAVSFLPKLKIEIAVASELVDRAVEAIGASAKTGQIGDGKIFVYSIDHAVRIRTGETDSEAL

SEQ ID NO: 20675 - protein, 140 aa, Bacillus sphaericus
DLGREPSPEEIGEEMDLTPEKVREILKIAQEPVSLETPIGEEDDSHLGDFIEDSEAQSPSDHAAYELLKEQLEDVLDTLTDREENVLRLRFGLDDGRTRTLEEVGKVFGVTRERIRQIEAKALRKLRHPSRSKRLKDFLE

SEQ ID NO: 20676 - protein, 599 aa, Thanatephorus cucumeris
MARSTTSLFALSLVASAFARVVDYGFDVANGAVAPDGVTRNAVLVNGRFPGPLITANKGDTLKITVRNKLSDPTMRRSTTIHWHGLLQHRTAEEDGPAFVTQCPIPPQESYTYTMPLGEQTGTYWYHSHLSSQYVDGLRGPIVIYDPHDPYRNYYDVDDERTVFTLADWYHTPSEAIIATHDVLKTIPDSGTINGKGKYDPASANTNNTTLENLYTLKVKRGKRYRLRIINASAIASFRFGVQGHKCTIIEADGVLTKPIEVDAFDILAGQRYSCILKADQDPDSYWINAPITNVLNTNVQALLVYEDDKRPTHYPWKPFLTWKISNEIIQYWQHKHGSHGHKGKGHHHKVRAIGGVSGLSSRVKSRASDLSKKAVELAAALVAGEAELDKRQNEDNSTIVLDETKLIALVQPGAPGGSRPADVVVPLDFGLNFANGLWTINNVSYSPPDVPTLLKILTDKDKVDASDFTADEHTYILPKNQVVELHIKGQALGIVHPLHLHGHAFDVVQFGDNAPNYVNPPRRDVVGVTDAGVRIQFRTDNPGPWFLHCHIDWHLEEGFAMVFAEAPEDIKKGSQSVKPDGQWKKLCEKYEKLPEALQ

SEQ ID NO: 20677 - protein, 572 aa, Thanatephorus cucumeris
MARTTFLVSVSLFVSAVLARTVEYNLKISNGKIAPDGVERDATLVNGGYPGPLIFANKGDTLKVKVQNKLTNPDMYRTTSIHWHGLLQHRNADDDGPAFVTQCPIVPQASYTYTMPLGDQTGTYWYHSHLSSQYVDGLRGPLVIYDPKDPHRRLYDIDDEKTVLIIGDWYHTSSKAILATGNITLQQPDSATINGKGRFDPDNTPANPNTLYTLKVKRGKRYRLRVINSSAIASFRMSIQGHKMTVIAADGVSTKPYQVDSFDILAGQRIDAVVEANQEPDTYWINAPLTNVANKTAQALLIYEDDRRPYHPPKGPYRKWSVSEAIIKYWKHKHGRGLLSGHGGLKARMMEGSLHLHGRRDIVKRQNETTTVVMDETKLVPLEHPGAACGSKPADLVIDLTFGVNFTTGHWMINGIPHKSPDMPTLLKILTDTDGVTESDFTQPEHTIILPKNKCVEFNIKGNSGLGIVHPIHLHGHTFDVVQFGNNPPNYVNPPRRDVVGATDEGVRFQFKTDNPGPWFLHCHIDWHLEEGFAMVFAEAPEAIKGGPKSVPVDRQWKDLCRKYGSLPAGFL

SEQ ID NO: 20678 - protein, 531 aa, Thanatephorus cucumeris
MLSSITLLPLLAAVSTPAFAAVRNYKFDIKNVNVAPDGFQRPIVSVNGLVPGTLITANKGDTLRINVTNQLTDPSMRRATTIHWHGLFQATTADEDGPAFVTQCPIAQNLSYTYEIPLHGQTGTMWYHAHLASQYVDGLRGPLVIYDPNDPHKSRYDVDDASTVVMLEDWYHTPAPVLEKQMFSTNNTALLSPVPDSGLINGKGRYVGGPAVPRSVINVKRGKRYRLRVINASAIGSFTFSIEGHRLTVIEADGIPHQPLPVDSFQIYAGQRYSVIVEANQTAANYWIRAPMTVAGAGTNANLDPTNVFAVLHYEGAPNAEPTTEQGSAIGTALVEENLHALINPGAPGGSAPADVSLNLAIGRSTVDGILRFTFNNIKYEAPSLPTLLKILANNASNDADFTPNEHTIVLPHNKVIGAQHHRGADHPIHLHGHVFDIVKSLGGTPNYVNPPRRDVVRVGGTGVVLRFKADNPGPWFVHCHIDCTWRLGSHLSLPRPPARFARVSSRSSPTMPGTSSAPSTRLFLPICSKW

SEQ ID NO: 20679 - protein, 591 aa, Cryphonectria parasitica
MPSFFRALFSGLIASQLSWAAPSLLHPLEPRQQPNCNTASNRACWISGSYDITTDYEVKTPLTGVVRQYDLTLTQAENWLGPDGVVKEDVMLVNGNILGPVIHAQWGDTISVTVTNNLKYNGTTIHWHGIRQLNTNLQDGVNGITECPIPPNGGSKTYTFIAHQYGTSWYHSHFSAQYGNGIVGAIQIDGPASLPYDIDLGPLVLSDYYYKTADELVVYTQSNAPPASDNVLFNGTNINPANTTQGQYKTITLTPGKRHRLRIINTSVENNFQVSIVGHSMTVIESDFVPVDSFTTDSLFVGIGQRYDVTIDASQATDNYWMNVTFGGGGFCGKSNNPYPAAIIHYNGASNSHPTNKGVAPADHECLDLLNLVPVVPRSIPTSGFVAASDNTLDVQLSTTTRKWTINGSTLDVDWGHPITQYVINKSTAWPSTDNVWLVEEANQWAYWLIENDPTATGNALPHPIHLHGHDFVVLGRSPNVSPTAQTPYTFTSSDVSSLNGNNPIRRDVVMLPPKGWLLIAFQTTNPGAWLMHCHIAWHVSAGLGNTFLEQPSAFVAGLNTNDVNQLNSQCKSWNAYYPSKDIFKQDDSGV

SEQ ID NO: 20680 - protein, 520 aa, Agaricus bisporus
MRLSNALVLVAACISSVVAKTRTFDFDLVNTRLAPDGFERDTVVINGEFPGTLIQVNKGDSVRIPLHNKLTSPTMRRSVSIHWHGFFQARTSGQDGPSFVNQCPQPPNTTFTYEFSVAEQSGTFWYHSHLSTQYCDGLRGAFIVYDPRDPLRHLYDVDDESTVITLAEWYHILAPDATNEFFSSGIIPVQDSGLINGKGRFNGGPLTPFAVVNVRRGKRYRLRVIAISCRPFFTFSVDNHSLVFMEADGVEHDPVEVQNVDIYAAQRVSVILHANQPIDNYWIRAPMTGGNPDRNPNLNISLTLAILRYHGARHVEPTTVNVPGHKLLDQEMHPIRQEGPGKLGDGPPDKHITLNIAQPNAPFFDINGISYISPTVPVLLQILSGAKRPEDVLPSEQIFFVPKNSLIEVNIPGEGAHPFHLHGHNFDVVLASNDDTFNFKNPPRRDVYPINGGNTTFRFFTDNPGAWFLHCHIDWHLEAGLAIVFAEAPEDNVSGPQSQITPQDWLDLCPEYNAIEPEFQ

SEQ ID NO: 20681 - protein, 520 aa, Agaricus bisporus
MRFSNAFVLVAACISSVLADTKTFNFDLVNTRLAPDGFERDTVVINGEFPGTLVQVNKGDSVRIPVNNKLTSSTMRRSVSIHWHGFFQARTSGQDGPAFVNQCPQPPNTTFTYEFSVADESGTFWYHSHLSTQYCDGLRGAFVVYDPEDPLGHLYDVDDETTVITLAEWYHVLAPDINNEFFSSGIIPVQDSGLINGKGRFNGGPETPFAVVNVEQGKRYRFRVIAISCRPFFTFSVDNHNLTFMEADSVEHDPVEIQNVDIYAAQRVSVILNANQPVDNYWMRAPMTGGNPDRNPNLNISLTLAILRYKGAPEVEPTTVNVPGHKLLDQEMHPIAQEGPGKLGDGPPDKHITLNIAQPNAPFFDINGISYISPTVPVLLQILSGAKRPEDVLPSEQIFFVPKNSLIEVNIPGEGAHPFHLHGHNFDVVLASNDDTFNFVNPPRRDVYPINGGNTTFRFFTDNPGAWFLHCHIDWHLEAGLAIVFAEAPEDNVSGPQSQITPQDWLDLCPEYNAIEPEFQ

SEQ ID NO: 20682 - protein, 527 aa, Trametes versicolor
MGKFHSFVNVVALSLSLSGRVFGAIGPVTDLTISNADVTPDGITRAAVLAGGVFPGPLITGNKGDEFQINVIDNLTNETMLKSTTIHWHGIFQAGTNWADGAAFVNQCPIATGNSFLYDFTVPDQAGTFWYHSHLSTQYCDGLRGPLVVYDPDDANASLYDVDDDTTVITLADWYHTAAKLGPAFPAGPDSVLINGLGRFSGDGGGATNLTVITVTQGKRYRFRLVSISCDPNFTFSIDGHNMTIIEVGGVNHEALDVDSIQIFAGQRYSFILNANQSIDNYWIRAIPNTGTTDTTGGVNSAILRYDTAEEIEPTTNATTSVIPLTETDLVPLDNPAAPGDPQVGGVDLAMSLDFSFNGSNFFINNETFVPPTVPVLLQILSGAQDAASLLPNGSVYTLPSNSTIEISFPIITTDGALNAPGAPHPFHLHGHTFSVVRSAGSSTFNYANPVRRDTVSTGNSGDNVTIRFTTDNPGPWFLHCHIDFHLDAGFAIVFAEDTADTASANPVPTAWSDLCPTYDALDSSDL

SEQ ID NO: 20683 - protein, 519 aa, Trametes versicolor
MGLQRFSFFVTLALVARSLAAIGPVASLVVANAPVSPDGFLRDAIVVNGVVPSPLITGKKGDRFQLNVDDTLTNHSMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATLINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTTSVIPLIETNLHPLARMPVPGSPTPGGVDKALNLAFNFNGTNFFINNATFTPPTVPVLLQILSGAQTAQDLLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLDAGFAIVFAEDVADVKAANPVPKAWSDLCPIYDGLSEANQ

SEQ ID NO: 20684 - protein, 520 aa, Trametes versicolor
MGRFSSLCALTAVIHSFGRVSAAIGPVTDLTISNADVSPDGFTRAAVLANGVFPGPLITGNKGDNFQINVIDNLSNETMLKSTSIHWHGFFQKGTNWADGAAFVNQCPIATGNSFLYDFTATDQAGTFWYHSHLSTQYCDGLRGPMVVYDPSDPHADLYDVDDETTIITLSDWYHTAASLGAAFPIGSDSTLINGLGRFAGGDSTDLAVITVEQGKRYRMRLLSLSCDPNYVFSIDGHNMTIIEADAVNHEPLTVDSIQIYAGQRYSFVLTADQDIDNYFIRALPSAGTTSFDGGINSAILRYSGASEVDPTTTETTSVLPLDEANLVPLDSPAAPGDPNIGGVDYALNLDFNFDGTNFFINDVSFVSPTVPVLLQILSGTTSAADLLPSGSLFALPSNSTIEISFPITATNAPGAPHPFHLHGHTFSIVRTAGSTDTNFVNPVRRDVVNTGTAGDNVTIRFTTDNPGPWFLHCHIDFHLEAGFAIVFSEDTADVSNTTTPSTAWEDLCPTYNALDSSDL

SEQ ID NO: 20685 - protein, 729 aa, Homo sapiens
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRHDWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAARVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIRWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 20686 - protein, 783 aa, Caenorhabditis elegans
MGYSESRSESVSSKAVLTFYLLNVLKFTDSQSTIFFNGFTVLCYTTPLLGSIVADGYIGKFWTIFSVSILYAIGQVVLALASTKNFQSSVHPWMDLSGLLIIAFGTGGIKPCVSAFGGDQFELGQERMLSLFFSMFYFSINAGSMISTFISPIFRSQPCLGQDSCYPMAFGIPAILMIVATLVFMGGSFWYKKNPPKDNVFGEVSRLMFRAVGNKMKSGSTPKEHWLLHYLTTHDCALDAKCLELQAEKRNKNLCQKKKFIDDVRSLLRVLVMFLPVPMFWALYDQQGSVWLIQAIQMDCRLSDTLLLLPDQMQTLNAVLILLFIPLFQVIIYPVAAKCVRLTPLRKMVTGGLLASLAFLITGFVQLQVNTTLPTLPEEGEASISFWNQFETDCTITVMSGIHKRVLPHDKYLHEDKKNKSGIYNLFTTKSPAKGNGDWTLTYDLSYDGACGDTSKLEKTVKVTAKSKKIIYVGVGSFGYYQNTANTDKPTDGTGEFSMGIVTVFNSSYGGNFAMCRQNTSDFDVNHPCNPRHPADFYFWETDYNSHTDDRDQNATITGSLSSQPAVTYKQKSVKPGYWQLYYLLNTPKDVDRQTYNKTATLVAPTNYGFHRVKQGGVFIYALTGTYENPKIHELQIVQSNSVSILWQIPQIVVITAAEILFSITGYEFAYSQSAPSMKALVQALWLLTTAAGDSIIVVITILNLFENMAVEFFVYAAAMFVVIAIFALLSIFYYTYNYYTTDEEDGEIGVDDEEEIEDHNPRYSIDNKGFHPDEKDTFDMHF

SEQ ID NO: 20687 - protein, 301 aa, Anopheles gambiae
MTKKADPYGFAKDFLAGGISAAVSKTAVAPIERVKLLLQVQAASKQIAVDKQYKGIVDCFVRIPKEQGIGAFWRGNLANVIRYFPTQALNFAFKDVYKQVFLGGVDKNTQFWRYFLGNLGSGGAAGATSLCFVYPLDFARTRLGADVGPGAGEREFNGLLDCLKKTVKSDGIIGLYRGFNVSVQGIIIYRAAYFGCFDTAKGMLPDPKNTSIFVSWAIAQVVTTASGIISYPFDTVRRRMMMQSWPCKSEVMYKNTLDCWVKIGKQEGSGAFFKGAFSNVLRGTGGALVLVFYDEVKALLG

SEQ ID NO: 20688 - protein, 487 aa, Pseudomonas sp. TW3
MRETKEQPIWHGKVFSSNWVEAQGGVANVVDPSNGNIIGVTGVANGKDVDAAVNAAKRAQKEWAAIPFSERAAIVRMAAEKLKEREHEFADWNVRECGAIRPKGLWEAGIAYEQMHQAAGLASLPNGTLFPSAVPGRMNLCHRVPVGVVGVIAPWNFPLFLAMRSVAPALALGNAVILKPDLQSAVTGGALIAEIFSDAGMPEGVLHVLPGGVDVGESMVANSGINMISFTGSTQVGRLIGEKCGRMLKKVALELGGNNVHIVLPDADLDGAVRCAAWGTFLHQGQVCMAAGRHLVHRDVAQQYAEKLALRANNLVVGDPNSDRVHLGPLINDKQVVRVHALVESAQRAGAKVLAGGTYQDRYYQATVIMDVKPEMEVFKSEIFGPVAPITVFDSIEEAIELANSSEYGLAASIHTTALATGLDIAKRLNTGMVHINDQPINCEPHVPFGGMGSSGSGGRFGGLASIDEFTQSQWISMVEKSASYPF

SEQ ID NO: 20689 - protein, 113 aa, Chironomus tentans
AEKPKRPLSAYMLWLNSARESIKKENPDFKVTEIAKKGGELWRGMKDKSEWEAKAAKMKEEYEKAMKEFERNGGDKSSGASTKKRGKAAEKKKPAKKSKKKDSEDDEEEDESD

SEQ ID NO: 20690 - protein, 345 aa, Drosophila melanogaster
MAENKQVDTEINGEDFTKDVTADGPGSENGDAGAAGSTNGSSDNQSAASGQRDDDRKLFVGGLSWETTEKELRDHFGKYGEIESINVKTDPQTGRSRGFAFIVFTNTEAIDKVSAADEHIINSKKVDPKKAKARHGKIFVGGLTTEISDEEIKTYFGQFGNIVEVEMPFDKQKSQRKGFCFITFDSEQVVTDLLKTPKQKIAGKEVDVKRATPKPENQMMGGMRGGPRGGMRGGRGGYGGRGGYNNQWDGQGSYGGYGGGYGGYGAGGYGDYYAGGYYNGYDYGYDGYGYGGGFEGNGYGGGGGGGNMGGGRGGPRGGGGPKGGGGFNGGKQRGGGGRQQRHQPY

SEQ ID NO: 20691 - protein, 202 aa, Brassica napus
MGVYETEKPTKDAAVVETQSPEDFDQPSPLRKIISVASIAAGLQFGWALQLSLLTPYVQLLGIPHKWSSLIWLCGPVSGMIVQPIVGYHSDRCTSRFGRRRPFIAAGAALVAVAVFLIGYAADIGHKMGDKLEQKSPRVRAIGIFAFGFWILDVANNTLQGPCRAFLADLSAGDAKRTRVANGFFSFFMGVGNVLGYAAGLF

SEQ ID NO: 20692 - protein, 182 aa, Trichoderma atroviride
  unsure (1)..(182): unsure at all Xaa locations
QRQAEGKPTDKPNIIMSSAVQVCWEKAARYFEVEEKYVYCTPDRYTIDPQQAVDLXDENTIGIAAILGTTYTGHYEDVKGINDLLEEKGLDVSIHVDAASGGFVAPFVLPDLEWDFRLPRVVSINASGHKYGLVYPGVGWVVWRSHEYLPQDLIFNINYLGAEQSSFTLNFSKGASQVIGQY

SEQ ID NO: 20693 - protein, 327 aa, Trichoderma viride
  unsure (1)..(327): unsure at all Xaa locations
ENQLKRDKXMQRNEIKMLLLGAGESGKSTILKXMKLIHEGGYSRDERESFKEIIFSNTXQSMRVILEAMESLELPLQDXRMEYHVQTIFIQPAQIEGDVLPPEVGGAIEALWKDHGVXECFKRSREYXLNDSARYYXDXIVXIAGXXYMPXDQDVLRSRVKTTGITETTFIIGDLTYXMFDVGGQRSEXKKWIHCFENVTTILFLVAISEYDQLLFEDETVNRMQEALTLFXSICNSRWFIKTSIILFLNKIDRFKEKLPVSPMKNYFPDYEGGDDYXAACXYILNRFVSLNQHETKQIYTHFTCATDTXXIRFVMAAVNXXIXXDN

SEQ ID NO: 20694 - protein, 245 aa, Populus tremuloides
MGRGRVELKRIENKINRQVTFAKRRNGLLKKAYELSVLCDAEVALIIFSNRGKLYEFCSTSNMLKTLERYQKCSYGAEEVNKPAKELENSYREYLKVKARFEGLQRTQRNLLGEDLGPLNTKDLEQLERQLESSLNQVRSTKTQYMLDQLADLQNKEHLLQEANRGLTIKLDEISARNSLRPSWEGDDQQNMSYGHQHAQSQGLFQALECNPTLQIGYNPVGSDQVSAITHATQQVHGFIPGWML

SEQ ID NO: 20695 - protein, 237 aa, Populus tremuloides
SGTENKINRQVTFAKRRNGLLKKAYELSVLCDAEVALIIFSNRGKLYEFCSTSNMLKTLERYQKCSYGAEEVNKPAKELENSYREYLKVKARFEALQRTQRNLLGEDLGPLNTKDLEQLERQLESSLNQVRSTKTQYMLDQLADLQNKEHLLLEANRGLTIKLDEISARNSLRPSWEGDDQQNMSYGHQHAQSQGLFQALECNPTLQIGYNAVGSDQVSAITHATQQVHGFIPGWML

SEQ ID NO: 20696 - protein, 291 aa, Yersinia enterocolitica
MLMKNFLVILLFIMVSVTWGTTWLAMKLTVETIPPIFATGIRFMLAAPVLILISVLTKTRLLFPDGQKFFQLFVCIFYFSIPFSLMIYGETYISPALASIIFSSMPVCVLFFSWLLLNEKVGIIAILGLVTSTVSLLAILFIETNIGNNNQWVGIISLVIAVIMHALVYVQCKKRSCSISVLTFNAIPSLVAGILLCIVGWIAEQPVISKFSQQSLLSVIYLGIIAGVFGILCYFQLQNKASAFQASTVFLVFPIIALLLDGYVYGRYFSLYSILLIIPLLTGVLLISLRK

SEQ ID NO: 20697 - protein, 503 aa, Tritrichomonas foetus
  unsure (1)..(503): unsure at all Xaa locations
MAKYYNEPCHTFNEYLLIPGLSTVDCIPSNVNLSTPLVKFQKGQQSEINLKIPLVSAIMQSVSGEKMAIALAREGGISFIFGSQSIESQAAMVHAVKNFKAGFVVSDSNVKPDQTFADVLAISQRTTHNTVAVTDDGTPHGVLLGLVTQRDYPIDLTQTETKVSDMMTPFSKLVTAHQDTKLSEANKIIWEKKLNALPIIDDDQHLRYIVFRKDYDRSQVCHNELVDSQKRYLVGAGINTRDFRERVPALVEAGADVLCIDSSDGFSEWQKITIGWIREKYGDKVKVGAGNIVDGEGFRYLADAGADFIKIGIGGGSIXITREQKGIGRGQATAVIDVVAERNKYFEETGIYIPVCSDGGIVYDYHMTLALAMGADFIMLGRYFARFEESPTRKVTINGSVMKEYWGEGSSRARNWQRYDLGGKQKLSFEEGVDSYVPYAGKLKDNVEASLNKVKSTMCNCGALTIPQLQSKAKITLVSSVSIVEGGAHDVIVKDRINDYHPK

SEQ ID NO: 20698 - protein, 374 aa, Equus caballus
STAGKVIKCKAAVLWEEKKPFSIEEVEVAPPKAHEVRIKMVATGICRSDDHVVSGTLVTPLPVIAGHEAAGIVESIGEGVTTVRPGDKVIPLFTPQCGKCRVCKHPEGNFCLKNDLSMPRGTMQDGTSRFTCRGKPIHHFLGTSTFSQYTVVDEISVAKIDAASPLEKVCLIGCGFSTGYGSAVKVAKVTQGSTCAVFGLGGVGLSVIMGCKAAGAARIIGVDINKDKFAKAKEVGATECVNPQDYKKPIQEVLTEMSNGGVDFSFEVIGRLDTMVTALSCCQEAYGVSVITGVPPDSQNLSMNPMLLLSGRTWKGAIFGGFKSKDSVPKLVADFMAKKFALDPLITHVLPFEKINEGFDLLRSGESIRTILTF

SEQ ID NO: 20699 - protein, 392 aa, Homo sapiens
GSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLGSSGAQGSGGGSTSAHYAVNSQFTMGGPAISMASPMSIPTNTMHYGS

SEQ ID NO: 20700 - protein, 191 aa, Oryza sativa (japonica cultivar-group)
MSSSSASAVPPEDDVCSVCHDRFRIPCQANCSHWFCGECIIRVWNHGPSVQPCKCPICRRLINLLVPANVSIDNDDDPQIQHVLGEVQHYNRIFGGTPRNLTQRLQDLPFFIRRLFRELLDPQRTLPLVFRARMVMMVALSAIYVLSPIDILPENVLGLFGFFDDFLVLLIVFLHLAAVYRSLLLYRHGGH

SEQ ID NO: 20701 - protein, 1092 aa, Oryza sativa (japonica cultivar-group)
MEASAGLVAGSHNRNELVVIRRDGEPGPKPVKHTNGQVCQICGDDVGLTPDGEPFVACNECAFPVCRDCYEYERREGTQNCPQCKTRFKRLKGCARVPGDEEEEDVDDLENEFNWRDKTDSQYVAESMLHGHMSYGRGGDLDGVPQHFQPIPNVPLLTNGEMADDIPPEQHALVPSFMGGGGKRIHPLPYADPNLPVQPRSMDPSKDLAAYGYGSVAWKERMESWKQKQERLHQMRNDGGGKDWDGDGDDADLPLMDEARQPLSRKIPISSSLVNPYRMIIIIRLVVLGFFFHYRVMHPVPDAFALWLISVICEIWFAMSWILDQFPKWFPIERETYLDRLTLRFDKEGQQSQLAPVDFFVSTVDPMKEPPLVTANTVLSILAVDYPVDKVSCYVSDDGAAMLTFEALSETSEFAKKWVPFCKRYSLEPRAPEWYFQQKIDYLKDKVAPNFVRERRAMKREYEEFKVRINALVAKAQKVPEEGWTMQDGTPWPGNNVRDHPGMIQVFLGQSGGHDVEGNELPRLVYVSREKRPGYNHHKKAGAMNALVRVSAVLTNAPYMLNLDCDHYINNSKAIKEAMCFMMDPLVGKKVCYVQFPQRFDGIDRHDRYANRNVVFFDINMKGLDGIQGPIYVGTGCVFRRQALYGYDAPKSKKPPSRTCNCWPKWCICCCCFGNRTNKKKTAKPKTEKKKRLFFKRAENQSPAYALGEIDEGAPGAENEKAGIVNQQKLEKKFGQSSVFVASTLLENGGTLKSASPASLLKEAIHVISCGYEDKTDWGKEIGWIYGSVTEDILTGFKMHCHGWRSIYCIPKRAAFKGSAPLNLSDRLHQVLRWALGSIEIFFSNHCPLWYGYGGGLKCLERFSYINSIVYPWTSIPLLAYCTLPAICLLTGKFITPELTNIASLWFMSLFICIFATGILEMRWSGVGIDDWWRNEQFWVIGGVSSHLFAVFQGLLKVIAGIDTSFTVTSKGGDDEEFSELYTFKWTTLLIPPTTLLLLNFIGVVAGVSNAINNGYESWGPLFGKLFFAFWVIVHLYPFLKGLVGRQNRTPTIVIVWSILLASIFSLLWVRIDPFLAKNDGPLLEECGLDCN

SEQ ID NO: 20702 - protein, 223 aa, Lactobacillus plantarum WCFS1
MVKFAAIKGFVFDLDGVITDTSTFHSQAWHQIADKVGVSWNDQLADALKGISRMDSLNLILAQGHRENDFTPAQKQALATEKNTNYLQLVNQMTPANILPGITAFLTELTTAGYALSLASASKNAPLVLRKLGLSDYFTKAVDPASLKHGKPDPEIFRRGAEILGLNPADCIGVEDAAAGVQSIKGAGETAIGIGDPTVLAAADINFTDTTQLTLANIKAQLN

SEQ ID NO: 20703 - protein, 282 aa, Lactobacillus plantarum WCFS1
MTVLTTMYQLANGVNIPKVAFGTWQIPGGEATYQAVRAALAAGYRHIDTALAYQNEASVGQAIRDSGIPREQIFVTTKLPAETKSYQGALNDFDRSLKNLGLDYVDLYLVHAPWPWGQVGRVYDEANLDVWQAMEAIYQSGRAKAIGVSNFAVRDLKNILNQATIPPMVNQIQYYLGFTEPKITKFSEEHAMLVEAYSPLATGGVLDNPQVQAYADKYGVSVAQLALRFVLQNGVLPLPKAVNPAHIEANTQLDFAISVADMQALNDLPDAAGSYMHNPTQG

SEQ ID NO: 20704 - protein, 276 aa, Lactobacillus plantarum WCFS1
METYTLRDGLTVPKIGFGTYKLNGAHGVQVIDSAIDRGYRLLDTAFNYENEGAVGKAVRRSSVPRSELLISSKLPGRHHTYTEAINTIQESLYRAGLDYYDLYLIHWPNPKEDHYVEAWQALINAQKLGLIRSIGVSNFLPEHLERLNKETGVLPVINQVELHPYFNQQAQRDYDQAHGILTQDWSPLGRASEMLQNETLKEIAVHYHKNVGQLILRWELQLGTLPIPKSSTPSRQAGNMDVFDFEISAADMATINGLSQVDGRLNNQDPAVYQEF

SEQ ID NO: 20705 - protein, 180 aa, Lactobacillus plantarum WCFS1
MFQTARAILNRDPAAINLRTVMLTYPGIHALAWYRVAHYFETHRLPLLAALLSQHAARHTGILIHPAAQIGHRVFFDHGIGTVIGATAVIEDDVTILHGVTLGARKTEQAGRRHPYVCRGAFIGAHAQLLGPITIGANSKIGAGAIVLDSVPAHVTAVGNPAHLVATQLHAYHEATSNQA

SEQ ID NO: 20706 - protein, 168 aa, Lactobacillus plantarum WCFS1
MTEPTAEDWMQEALHEARMAYLIGEVPIGAVIVHQGEIIGRGHNLREHGQDATMHAEIIAIQEACEYLHSWRLADCQLYVTLEPCLMCSGAIINARLPELYFGARDPKAGAVRSLYQVMDDTRLNHQVTVHERILARPAGEMLENFFRGIRKRKKAAKKARREAAEKN

SEQ ID NO: 20707 - protein, 442 aa, Lactobacillus plantarum WCFS1 [sequence omitted]

SEQ ID NO: 20708 - protein, 709 aa, Lactobacillus plantarum WCFS1
MPIIELVILLACLVLLSNVLSHYLVAIPVSLIQVGLGLGVALLLNVQVKLQTDWFMLVFIAPMLYNDGREFPKQELWELRGAIFANAIVLVFITTILGGFLIHVLIPTIPLAVGIALAAILSPTDPIAVQSISEGVKLPKEILHLVSGESLINDASGLIGFKYALAAAVTGTFVLGEAVGDFFYISLVGLAVGLALITIIQLIRDVLRREGINDIVFNVVLQILTPFAIYFIAEEWFHASGVVAVVAAGVLSHLQNSHESEDAPELRLVTERVWNVVVYLLNGIVFLILGIELPAATQATIKGAHTNTFHAVFDVLIVWGILLLIRVAWTYAYMLFNWLRHHKKAKPSLRIAALSGLSGVRGAITMAGVFTIPTVVASGKAFPERALVLFIAAGVIIVSLVAAAAILPLMAAKSLPFVTRGSSPDEDDAVLAEGTDDGDDSSGQLPQLTYKQARIYILQLAIQNIEEHRRPANQRAAYDLILDQQFQIRRLEVASQTADELAPMLTDELELRLVALNGERAAVREMIANKQTSKLAGQVYLRRVDRREQRFLQATHRQGLPTLRSLRLLLTRAMQGIRLWLAPGDSEELRVALLDIQREASKAAIKALSQYLKQANVDEQQFDRQALYHLIVHYRNRIENAKNDHTLSRDDYEQQLHGLRIKSLGAERAGVQHLLESGQISLRTAAKLRQFINYSENLLMLNDIEADED

SEQ ID NO: 20709 - protein, 380 aa, Lactobacillus plantarum WCFS1
MKSGKHRVSLLILLCLMVVGLAGCHNKAYSQSIEKGLNAVAENKYQKALTYFDNALAQKPKDEKAQAYRDQTQAYLTTTSELKAGKVKTALTTVDKGVKITNGATSLTNKLKQLKVTVTSDYQEYQQLSDDVKAQLKVKNGNYSADVLKRCAAINWDKKPYLKPLKAKVKQLLAAAKKAKTNMKVSAAEAKRAAALRRKIAAAKNKWNMAALDDVPDWFILALFADDSDVDDAAEELDDEYADQADDNDDYSDWDEQTTDSNDDTNDTDADSADDDWSDQDTDSNDDTDDDSDTNSDADSDSDYSEDDDDEDSNRDDADDSETQSDDDYDDDTDSESDDDDYDTDDQYDDDDDYDDAESLLNPAPVQPSVADRLFASASC

SEQ ID NO: 20710 - protein, 576 aa, Lactobacillus plantarum WCFS1
MAEKVLKGIAASDGVAIAKAYMLVDPDLSFEKTTVSDTDAEVARLHDAFDASKAELKVIKDKAVENLGEEEAEVFEAHITILSDPEMLGQIEGKIKDDKVNAEEALKEVTDTFISMFEAMTDNAYMQERAGDIRDVTKRVLSHLLGVTLPSPALIDSEVIVVAHDLTPSDTAQLDRKYVKGFITDIGGRTSHSAIMSRTLEIPAVVGSESATTDIKEGDTVVLDGINGDALVAPTDAEVADYQQKAKDFVAQKAEWAKLKNEATVSKDGKHFELASNIGTPDDMDGVLDAGSEAIGLFRSEFLYMNSSELPDEDTQFEAYKKVVEGMNGKPVIVRTMDIGGDKELPYLPLPDEMNPFLGYRAIRISLDRDDIFRTQLRALLRASHYGQLRIMFPMIATLDEFRKAKAIFEEEKAKLVAAGTPVADDIKLGIMIEIPAAAILADQFAKEVDFFSIGTNDLIQYSFAADRGNEQVSYLYQPYNPSLLRLIKHVIDAAHANGRFTGMCGEVAGDQIAVPLLMGLGLDEFSMSSTSVLKTRSLMKKLDTKEMAKLADKALNECVTNEEVKELVEKNVFGK

SEQ ID NO: 20711 - protein, 309 aa, Lactobacillus plantarum WCFS1
MLSLTEQLNRGPVVSDGAMATELEKRGVATNSALWSATAMLDHPDAIQAVHQSYLDAGAKIMTTNTYQANVPAFEQAGIAAVQARQLIQQAVTIAHTARDASHVTDAVIAGSIGPYGAYLADGSEYTGAYQLTPSAYQDFHRERLALIMAAGVDVLALETMPRLDEVQALVQLITTTWPQQPYWVSFSIKDPQTLCDGTSLAVAAKWVAAQPNVVAVGVNCTTLENIAPALTTLKAAVAVPLIVYPNSGDQYDPVTKTWQETHLSHQFASFVPQWLAAGARIIGGCCRTTPKDIATVARALSVSDSAKL

SEQ ID NO: 20712 - protein, 618 aa, Lactobacillus plantarum WCFS1
MKFKQALQQRVLVADGAMGTLLYGNYGINSAFENLNLTHPDTILRVHRSYIRAGADIIQTNTYAANRLKLTRYDLQDQVTTINQAAVKIAATAREHADHPVYILGTIGGLAGDTDATVQRATPATIAASVTEQLTALLATNQLDGILLETYYDLPELLAALKIVKAHTDLPVITNVSMLAPGVLRNGTSFTDAIVQLNAAGADVIGTNCRLGPYYLAQSFENLAIPANVKLAVYPNAGLPGTDQDGAVVYDGEPSYFEEYAERFRQLGLNIIGGCCGTTPLHTSATVRGLSNRSIVAHDQPATKPQPPTLVTTKSQHRFLQKVATQKTALVELDPPRDFDTTKFFRGAERLKAAGVDGITLSDNSLATVRIANTTIAAQLKLNYGITPIVHLTTRDHNLIGLQSEIMGLHSLGIEDILAITGDPAKLGDFPGATSVSDVRSVELMKLIKQFNSGIGPTGKSLKEASDFRVAGAFNPNAYRTSISTKSISRKLSYGCDYIITQPVYDLANVDALADALAANHVNVPVFVGVMPLVSRRNAEFLHHEVHGIRIPEPILTRMAEAEQTGNERAVGIAIAKELIDGICARFNGVHIVTPFNRFKTVIELVDYIQQKNLIKVQ

SEQ ID NO: 20713 - protein, 396 aa, Lactobacillus plantarum WCFS1
MTVEDAQTSTRWRAYLALGLATVAMIVCFMSWSNFAPLAGELAIKFHLSVSQRTLLLATPVLLGSIMRIPVGILSDRYGGKKVYLILMAFILIPLLMITKVHTYGMLLVAALLVGMAGTSFAVGVSYASVWFPPEKQGLALGIVSMGNMGNAVAALTLPSISTSYGFNMVYYFLMVLTVILAVLFAIFCREMPVDKTKTVTGALAVAKESSTWYLSLFYFLTFGLFVSFTNLTPLFLEDIFRVPQVTAGLYAALFAGLCTVVRPIGGAAADKWRPMQMLQWIFIGITVFAVIITLTFSNQSLFIFGIVGAGLIAGFGNGVIFKMVPYVLQGNTGAVTGFVGALGGLGGFFPPLLVGWIHTWTGSYRLGIVLLALTGLVCWYALWRRFIHGDVHIVK

SEQ ID NO: 20714 - protein, 408 aa, Lactobacillus plantarum WCFS1
MSIWTKRHVTVVVSGGIASYKALVLIRSLMKQGAVVRVAMTTHAAKFITPLTFQTLTQQPVVIDEFTTTDPHHVVHVALADWTEVMILVPATANLIAKVANGLADDAATTTILATTAPKFVVPAMNSHMYVNPATQRNLKQLTTDGLHVLTPATGMLAEGYSGQGRLPEPAVILAWLTDQLIQLTPDLPLAGRRVVVTAGGTREALDPVRFITNRSSGKMGYAVAQVARELGATVTLISATTHLAAPSGVKVVTVDSAQSLLTAVSDIFDDTDILVMAAAVSDYRPAELADQKIKKPADHADLTLRLTETPDILKTLAARKHQQYVIGFAAETQSLLANANRKLTSKKLDLIVANDVSKPGVGFNGDTNQVTLLRPEQQPVTTELTTKTAIAKQILMTAIADGAGTQA

SEQ ID NO: 20715 - protein, 347 aa, Lactobacillus plantarum WCFS1
MKSTIFEKAGLVSVQEVDKPTLQSDDDVIVRIVRTCVCGSDLWSYAHGDDKAAHSINEGHEAIGIVEAIGSAITTVKPGDFVITPFTHGCGECAACLAGFDGTCDRHPGHTNWSNGFQAEYIRFTYGNWALVKIPGQPSDYTEGMLKSLLTLADVMPTGYHAARCANVQKGDKVVVIGDGAVGQCAVIAAKLRGAAQIVLMSRHEDRQQMALASGATAVVAERGDEGIAKVREILGGGADAALECVGTEAAIDQALGVLHNGGRVGYVGVPHYNNRPLGSTFAQNIAVAGGSASVTTYDKQFLLKAVLDGNINPGRVFTQTYPLADINQAYQDMQNRKTIKAMITID

SEQ ID NO: 20716 - protein, 242 aa, Lactobacillus plantarum WCFS1
MSVDEVILVTGAAKGIGLATVKRLAAQGASVILNVHHEIEAADWQALTAEYPRLTQLVGDVSDDQTAADLIETVMTNFGRLDGLVNNAGVTHDQLLTRLHAEDFMSVIQTNLLGTFNMTKYALKVMQRQRQGAIVNVASVVGLHGNIGQANYAASKAGIIGLTKTTAKEAARRQVRCNAVAPGMITTAMTAQLNDRVTAAALSDIPLKRFGTPDEIAQAIDFLLHQPYLTGQVLTVDGGMTI

SEQ ID NO: 20717 - protein, 448 aa, Lactobacillus plantarum WCFS1
MKETSKTTAGLPKLSSNKIWMMSLGFLGVQMAFTLQSSQMSRIFQTLGADPNNLGWFFILPPLAGLIVQPIIGSLSDRTWAPRLGGRRLPYLILGTVVAAIVMLLLPNSGSFGFGYASMAALVFGAITVAFLDLSSNVAMQPFKMMVGDMVNDDQKSYAYGIQSFLLNTGAVIAAIFPFLLTLFGVANTASKGVIPNSVIWSFYIGAAILVVSTIITIARVREYDPVTYAKYHGIDESANKSGGNWLALLKKAPKVFWLVALVQFFCWMAFQYLWTYSTGAMAANVWHTTNASSAGYQAAGNWYGILSAVQSVAAVVWSYVLAKVPNNRHKLGYALSLLLGAIGFFSIFFIHSQSALVVSFILVGMAWAAMNTYPLTMVTNALSGEHMGTYLGLFNGSICLPQIVASLLSFALYPLFGNSQANMFIFAGIVLAVGAGTVGLIKETYKN

SEQ ID NO: 20718 - protein, 798 aa, Lactobacillus plantarum WCFS1
MSSRDTANVLWFDELHREDVNLVGGKSSSLGEMTSSMDVPVPYGFATTARAYQYFMTQTGLNDKVNDLLASIQDYENSDELHTACEQIRNLIVNATMPADLAADIEQAYADLAKKMGQTDPFVAIRSSATAEDLPNASFAGQQESYLNIKGAADVVNRVQQCYSSLFTDRATYYRHKQHFPHEKVALSAAIQMMVFSKASGIMFSVNVADGDASKIVIDAIYGLGEYIVLGKVTPDHFVIDKQSMKIVEKNIIKQPVQLMRLPGGGTKEESVPDELQGQPVLTDAQVIELAGYAKEIERHYGCYMDMEYALDTNTNRLWIVQARPETVWSQRNKHKDAADDEDVVDEADAKVIVRGLPASPGLASGVVHVIDNPKDIDQFKQGEVLVTLMTSPDWVPAMKKAAAIVTNNGGMTCHAAIVSREMQIPCIVGTKSKEVAATDVLKTGDVVTVDAKNGVVYQGKVASMLKPKSGATAVAGQVVAAESFAPTATGVMMNLGDPDLADKYSSLPADGIGLMREEFLWTTFIHEHPLYLIEQGHPEKVVNMLADGIAKVVRAMAPRPVVLRFSDFKSSEYRNLKGGDKYEPHEPADLLGWRGASRYYDSKYIEAFKLELAAVKKVRNEFGLKNLNVMIPFVRTVDEAQKVTTIMRDEGLARSADFKVYMMAEIPTNIILADQFNQFVDGYSIGSNDLAMLILGCDRNNDTVAHLFDERNLAVKRAIRHLIKTAHKDGKTVSICGQAPSEYPEFTNFLIQSGIDYVSVNPDMVKETKRNVAHFEQRIMLDKATGRGLQDPIDYKW

SEQ ID NO: 20719 - protein, 429 aa, Lactobacillus plantarum WCFS1 [sequence omitted]

SEQ ID NO: 20720 - protein, 368 aa, Lactobacillus plantarum WCFS1
MAKAKATTEYDKAVKALIKEYKKTGSIQYDELSDKLAAPYKLDASGIDKLLQKVEDAGISVVDEKGDPDARAVKSVKKVSKKELSDAGSASGIKINDPVRMYLKEIGRVDLLTADEEVALALRIEQGDESAKQELAEANLRLVVSIAKRYVGRGMQFLDLIQEGNMGLMKAVEKFDYRKGFKFSTYATWWIRQAITRAIADQARTIRIPVHMVETINKLIRIQRQLLQDLGREPTPEEIGAEMDMPTEKVREILKIAQEPVSLETPIGEEDDSHLGDFIEDQDATSPADAAAYELLKEQLEGVLDTLTDREENVLRLRFGLDDGRTRTLEEVGKVFGVTRERIRQIEAKALRKLRHPSRSKQLKDFLE

SEQ ID NO: 20721 - protein, 325 aa, Lactobacillus plantarum WCFS1
MSKKTYIQAITDALRLELGSDEKTLVFGEDVGKNGGVFRATDGLQAEFGEDRVFDTPLAESGIGGLSIGLALEGFRPIPEIQFLGFIFETLDSIAGQMSRERFRTGGTRHMPITIRSPYGGGTHTPEMHADSLEGYLAQIPGLRVVTPSNPYDAKGLLISSIRNNDPVFFLENLKLYRSMKADIPDEAYTVPLDKANVVREGTDISLIAYSAQVNQSLKVAEKLEKEGISVEVVDLRTLSPLDEETILKSVQKTGRAVAIQEAQRQAGIAANVASLIAEKGALYLSAPVGRVYAPDTVYPFGLAEDDWLPAEDEIEAKTREILNY

SEQ ID NO: 20722 - protein, 236 aa, Lactobacillus plantarum WCFS1
MAKLDAQSIINYIGSAKKKTPVKVYVKGALDQLNVPAGIKTFFSGNAGVLFGDWADVEPFLKANAANIEDYELENDARNSAVPMADLKQYNARIEPGAIIRDQVLIGDNAVIMMGAVINIGAEIGEGSMIDMGAILGGRAIVGKNCHIGAGTVLAGVVEPPSAKPVQIDDDVLIGANAAVLEGVHVGKGAVVAAGAIVIEDVAPNTVVGGVPARKLKDIDDKTKSKTELMAELRNL

SEQ ID NO: 20723 - protein, 667 aa, Lactobacillus plantarum WCFS1
MQTVFLVLLLVAAVVVANAVYARFNQIPVAFLQIGAGLILSLIPLYRNFELEPEIFLFVIISILMFNDGQNTNIRKLSHQFGTTLSLSVVLAIVTILIVGTVTHLLIPEFSLALAFALGAIITPTDAVAVSSITTKVAIPGEVMTTLENESLFNDASGIVAFNLAIAAIVTGKFSVWHGVTNFLYVFAGGIFVGLIIGYIIVAVRIMLIRMRVDTPSVIVPYTLLTPFVVYFLAESLGVSGILAVVATGLIHGVQSDQLRLTTSRLQIVMTTTWSIVASILNGIVFVLLGVSLPSVINHLQQRDTSSVAVLVGLGILLYLIMTFARFLWTRFDLARIRAWDNHEKTRNAFVMGLSGVHGTITLAMAFSLPLTLNGSAFPYRNDIIFVAAVVILTSLMVPTLLLPLTLPKQVVKVTEDELATAKADMVTHAIDLMQARHGNNAGTSKVIAILSGQRVLDGRPKRSQLASLFDATFKVEQTTIDEMVANNEITPQAAEKYMRVASQTRLQNQQTFFERLKLFFRFTLSKWSLSKKARARRKMFRQYRPHGGQSRAELMTRNRQMWQQMRQIEQKPYEAVLAYLADTITADNQQAIGIVRRAYDERHRRLSGERDFQETQNELLIEAFQLEYNFIQTQLANKTFSSELGNQLYEQISTDQLVYLQSINTD

SEQ ID NO: 20724 - protein, 583 aa, Lactobacillus plantarum WCFS1
METPILARIDQPADLKQLSLPELTQLASELRHVLLNKVSQTGGHVGPNLGVVELTIAFHTIFNSPVDKVVWDVSHQSYTHKILTGRKQAWLDPAHYNDVSGYTTPEESPHDYFNIGHTSTSIALATGMAVARDLEGKTGNVMAVIGDGSLSGGLALEGLNIAATLKSNLIILVNDNGMAIAEDHGGIYQNLRELRETNGTSSHNLFKDFGLDYRYVDDGNDLETMLTTFKEIKDVDHPIVLHVHTEKGHGYQPAITNKEAFHWHVPFDLATGQTLHPNTKETYTDVIHATLADELAAKTPITAITAAVPGTYDLKRFARQYPDRYFDVGIAEQESITFAAGQAQQGLRPIVFHSGTFLQRAYDQLSHDLGINKLPVTIMVAGGRINAGDPTHQGIFDVAMLSNIPNLTYLAPTTKEELQAMMHWALHQNNGPVAIRVPSNDVQSVPLAPDFDATKMHTLHAGQQVALLGVGSLLPLATAVQQQLAEQHIDATLIDPRDISDPDTMTLANLKADHQLVVTVEEASLSGGFGEKVSRYYGNSAMRVLNFGAAKRFNDRETTNELRHEFKLTPDQIVTAITDQLAE

SEQ ID NO: 20725 - protein, 288 aa, Lactobacillus plantarum WCFS1
MTKTPTITLNDGRAIPAIGFGTFQIPDDGSTYQAVKEALVIGYRHIDTAVAYFNEDEVGQAIKDSGIPRDQIWVTSKLWLQDYGFDAASRAIDRSLTKLRLDYIDLYLIHQPYGDVPGAWQAMEAAQKAGKLKSIGVSNMTPTLWQKFVPQFETIPAVNQVEFNPYFQQQPLRQLLAAQDVKLEAWAPLGQGNQALFKEPIIQQLAIKYHKDAGQIILRFEHQEGVIVFPKSVHSARIKSNRDIFDFELTSTEMAQLRALDTGKGHHDPDAPGVSEQLLHAFDVHADD

SEQ ID NO: 20726 - protein, 288 aa, Lactobacillus plantarum WCFS1
MMVPTTKLNNGVVMPQLGFGVFQVPDLNECEAAVTAALKAGYRLIDTATAYQNETAVGRAIQKSGLRRDELFVTSKLWVSEFTYERAKQGIDASLQRLGVDYLDLYLLHQPYGDVMGAWRALEEAYHAGKIRAIGVSNFYADQLKNLELTMSVQPAVNQIEVNPWYQQADEVRFNQDEHVRVEAWAPFAEGKHAIFSNPSIQTIAQAHGKTTGQVILRWLLQRGITVIPKSVHPERMAENIAVFDFELTAAEMSAMAELDQGVSQFFDHRDPVTIEQIFGASLRQLHE

SEQ ID NO: 20727 - protein, 373 aa, Lactobacillus plantarum WCFS1
MKIKAAVVDKVNDPFVIKDDIELAEMKATDLQIKMVATGICHSDEAIRRGDASLGYPVILGHEGSGIVEKVGSEVTNFEVGDHVILSFYADGTCDNCLKGMPTKCRNYADYNLSGTRPDGSDHFQENGHHISDMFDQSSFTTHTVVDQRNAVKVPKELDLRRLGPLGCGYVTGSGTVLNSLQPRPGQTIAVFGTGAVGLAAMMAGKISGCTEVIAVDIVDSRLELAKELGATHAINSKEEDPVEAIKKLTHGYGVDFAVDTTGVEPVMVSAIHALAQGGTAALIAVTAKNITISSWNDLCVDDKKVIGVNMGDAIPGVDIPRLIDFYQHGMFPFEKTEKFYKFEDINQANADSGSGKTIKPVLIIDEDYQPGK

SEQ ID NO: 20728 - protein, 217 aa, Lactobacillus plantarum WCFS1
MTKAVIFDLDGLLIDSEVISLKMYQRIVQDYGQTLSMATYAQEYSGKSAVTNMQHLIERFDLPFDVDTGLKRALALEKTFMQDGVELKPGARVLLQFLHRNHYSVALASSSIKSRALDILTSHDVAQYFDQFTFGPDVDRGKPYPDIFLMACAKLQQQPADCLVLEDSEAGIQAATSAKIPVICVPDMKRPNQPYADQATAIVPSLTDVITYLKSVR

SEQ ID NO: 20729 - protein, 325 aa, Lactobacillus plantarum WCFS1
MGMEIFDYEDIQLIPNKCVINSRSEADTTVELGGRRFKIPVVPANMATVINDEIAKWLATNDYFYIMHRFAPETRRAFIETMHAAQLYASISVGVKSSEYDFIDDLATNQIVPEYITIDIAHGHADSVIAMIKHIKDVLPDSFVIAGNVATPAAVRDLENAGADATKVGVGPGKACITKVKTGFGTGGWQLAAVRWCAKAARKPIIADGGVRTNGDIAKSIRFGATMVMIGSMLAGHQESPGNILKIDGKTYKQYYGSASETQKGEHKNVEGKQMLVPYRGRLVDTLNEMQEDLQSSISYAGGRDLKAITKCDYVVVKNSIYNGD

SEQ ID NO: 20730 - protein, 555 aa, Lactobacillus plantarum WCFS1
MLSSRFIILKSKNIDWWVYLPTIGLFAAASVVLLMGGHSLETSLSGILNWLTNNMSWLYMSVYVITFIFFIYLGFSKLGKTKLGDPDDKPEFSTYHWGSMVYATGIDASILMLSMVDPLRYLQSPSFGVKPFSTSAYNYAHMLGQFNWGPMAWMMFAPATIAIAYAMYVKHIKVQRLSAAISVLQGPGKGKQIARNTIDFLVIIGIMGGVGTSVGMEIPVISKVLSAVTGIADTMTLKLGLFALLFVIFAMAVFNGLKKGIGRLSAAHVWLAIGFLIVVLIVGPTLYILNSETNSIGLFVNKFITLSTNTAPNGHATAMQRQTIFYWGWWLSFMPVMGLFIARISRGRTIRQVLGGMLLWGSLGCVSFYAILGGYALYLQRMGIVNLVHILNTQGQAAVIAAVLSTLPLKMIMLALYCLSCFIFLATTVSSFAFITSSFTSKKLAAGEQPSRFNRMSWVVIFLVFSLGLVTVGGFESIQSICAMSGFPLTIVALVLLYSIHHDLTTDPVKEAAKANAKAAELARRKRLARDVEITTKTDYARERRTARKRETEAD

SEQ ID NO: 20731 - protein, 286 aa, Lactobacillus plantarum WCFS1
MTALTKLTDTYTLNNGTKIPIVGFGTWQTPDGQVAYDSVLAALKAGYRHIDTAAAYGNEESVGKAIADSGVAREDLFVTTKLWNADHGYDAAKKALDTSLAKLGLDYVDLYLIHWPNPAAMRDNWEQLNADTWRAMEEAYTARKARAIGVSNFRPKHLDALLKTAKVVPAVNQIFLNPSDMEDEVVAYNRKHDILSEAYSPLGTGKIFSIPELKTLADKYDKSVAQVVLRWSLQHGFLPLPKSVHADRIEQNTELFDFELSDDDMKVIDGFHGVAGLANDPDQVNF

SEQ ID NO: 20732 - protein, 469 aa, Lactobacillus plantarum WCFS1
MAMLYGKHNHEAEEYLEPVFGAPSEQHDLPKYRLPKHSLSPREADRLVRDELLDEGNSRLNLATFCQTYMEPEAVELMKDTLAKNAIDKSEYPRTAEIENRCVNIIANLWHAPDDEHFTGTSTIGSSEACMLGGLAMKFAWRKRAQAAGLDLNAHRPNLVISAGYQVCWEKFCVYWDVDMHVVPMDEQHMALDVNHVLDYVDEYTIGIVGIMGITYTGQYDDLAALDKVVTHYNHQHPKLPVYIHVDAASGGFYTPFIEPQLIWDFRLANVVSINASGHKYGLVYPGVGWVVWRDRQFLPPELVFKVSYLGGELPTMAINFSHSAAQLIGQYYNFIRFGMDGYREIQTKTHDVARYLAAALDKVGEFKMINNGHQLPLICYQLASREDREWTLYDLSDRLLMNGWQVPTYPLPANLEQQVIQRIVVRADFGMNMAHDFMDDLTKAVHDLNHAHIVYHHDAAPKKYGFTH

SEQ ID NO: 20733 - protein, 473 aa, Lactobacillus plantarum WCFS1
MNQPAVHPNKPIADVSSKPKTSTIANSLPNLPLKTIFAITFGFCGVNMAFSLQSSQMSRIFQTIGADPTKLGLFFILPPLAGLFVQPLVGKYSDRTWTRFGRRMPYLLFSAPLAALVMVLLPNAGSFGFGYASTAALLFGAIAILFMDLSSNVCMQPFRMIIGDMVNENQKDKAWSWQQAFSNLGGVLATILPFVLTYFGVANTAQKGVVPLSVRIAFYIGAIILLGISAYTIHTVKEYDPDTYALYHHINPEQHKHTKPIWQLVKEAPKAFWEVALVQLFAWIGIQYMWTYTTGAIAENVWHTTNAASAGYQAAGNWYGILTFIQSMAAVLYGFLVLSRTNPYKRKFWYRFGLASFAVGLVWVFFIHNQYLLIAPFCLIGIGFFTVHVEPFNIFTSSLDGANEGSYIGIFNGTICLPQILASVASFMVFKFVGNSMPGMMLIAGISMFIAVLAISIIKQDNPQEDLSENPTK

SEQ ID NO: 20734 - protein, 466 aa, Lactobacillus plantarum WCFS1
MNKQKKVSSKFIFFFGSFGGILFGYDIGVMTGALPFLKTDWALTNATLVGWVTSAVMFGAIFGAAIAGQLADRLGRRRMILMSSLIFAIGSILCGFSPNNGTYYLIGMRIFLGLAVGAASALVPAYMSEMAPARLRGSLSGINQTMIVSGMLISYIVDYILKDLPENMSWRLMLGLAAVPAIILFLGVLKLPESPRFLIKANRLDEARQVLSFVRKPDEVDSEVKAIQSTAQTEANNLEKTSWATLFNGKYRYLVMAGVGVAAFQQFQGANAIFYYIPLIVEKATGSAASSALMWPIVQGILLVLGSLLYIWIAEKFNRRTLLMLGGSVMALSFLLPAVINSLVPNASPMMIVVFLSIYVAFYSFTWAPLTWVLVGEVFPLAVRGRASGLASSFNWIGSWAVGLLFPIMTASMSQEAVFAVFGVICVLGVLFVRFCVPETRGHSLEEIEAAGTNHHKQVPVQQASH

SEQ ID NO: 20735 - protein, 470 aa, Lactobacillus plantarum WCFS1
MDVSESTNKKSNSHTGFLWLATFIAAMGSLLFGYDTGIVNGSLEFMAVKGQLDLTAFQQGIVSSGLTLGAAFGAIIGGPFADKIGRKKILTILGIIFSVGALGCAFATNITILIVFRFILGLAVGSASANVPVYIAEIAPTELRGKMVTTAQVMIVSGQFVAFGVNAALTPLGAQNAAIWRWMLGLGTIPGIILWIGMYLIPESPRWLVSQGKMDKALGVLRRIRSAASVESEMKEIQDKDKADKELNAEQATFKELISKRWVVQILITGAMLGIIQQFAGINSIMYYGGKIIQESGFDTTVAAILNAGNGFLSIVGAVLGMFTIDWLGRRKLEFAGLTICGITLVSAGVIHTVAPNASWAGITIVVLVYLYIIFFQGTLGPVTWLINSEIFPQRYRGIGTGITIFVLWIGNFIVGLLSPVLLEWNMSNTFYIFAVCCVLGIIFVALRVPETKGVPLEEIEKYFRTKYDK

SEQ ID NO: 20736 - protein, 488 aa, Lactobacillus plantarum WCFS1
MSAEKSISSDHVPLSDPALKTINRNAGRNLNHIAFISTLGGLLFGVDTGVINGAIGYMATPAELNLSPNNEGLVTSGITLGAAFGAVFAGHLSDRIGRKRLLKYLALLFFVCTLACSLAPNALFMIISRVLLGLAVGGASVIVPTYLSEISTPEIRGRLVTQNELMIVTGQLLAFIVNAILGNWFGHISNIWRYMIGFGMIPAVALFFGMMVVPESPRWLVMVNQLDNAFDSLRKIRSHPETCNEEITQIQDTLNQESEIKQATFKDLSTPWIRRLVFIGIGLGVMQQFIGINIMMYYGTTILTNSGFAHNAALIANIGNGLVSVIATFIGMSIMNRVNRRSMLIAGIIGTTTSLILIVGVSAFLSQSPLLPILVVLCTMMFLGFFQGFISPLVWLLLSEIFPQNLRGLGMGVSTFFLWFANFLVGYFFPILLSAVGMTWTFLIFVFFNILSFIFAYKYAPETRGKSLELIQMEFKYGDTTGINPEDK

SEQ ID NO: 20737 - protein, 267 aa, Lactobacillus plantarum WCFS1
MTTDWLGLKDKIVLVTGGSSGIGDAIVESLLNNGAKVVDLDLHSSSRKNQHFDFVECDVSSEEAVTEAIDQILDKFGRIDGLVNNAGINLPRLLVDEQMPRGQYELCTEVFNKMFAVNVRSTFLMSQTVGRQMVKQRSGTIVNMSSEAGLEGSQGQSVYAATKGAINGLTRSWSKELGVFNIRVVGVAPGIMDATGLRTPSYEEALAYSRHQTVQQLRSGYTSKSTTPLGRSGHLYEVADLVSYLLSERASYITGITVNVAGGKSRG

SEQ ID NO: 20738 - protein, 461 aa, Lactobacillus plantarum WCFS1
MMKKVSAEDTVKTSVKEDQTSFGFDNSLPNLPIKTILAMTFGCIGVNMAFTLQGSQMSRITQTIGVNPNSLGWFFLLPPLLGMFVQPLLGKYSDSTWTRWGRRIPYLLVGAPITVIVMIMLPFTGSFGFGYGSMTAMVYAAIAIALMDLFSNVCLAPYKMLAGDMVNEKQKNLAWSWQQVFGYAGGILAALLPYILTKVGIANTASKGQVPATVIWAYLIGAVMLLVTSLVTIFNVHEYDPKTYAKYHKINESKQKVTPSLWKLLKTAPRSFWELAIVQLFSWIGIMYTWTYATGAMANNIWNTTNPASSGFQAAGNWYGVMTAFYSVAALLWGLFYAKTKATQRKFWYSFGLFADAISIIIVATTHNQWVALIAFALYGIGNFTINTLPYTMLTTSLDGRNNGSYLGLFNIAVCLPQIIGSLASFIIFPLVGNSQSMMMIIGFVAMVIGGFSVAIVHEGK

SEQ ID NO: 20739 - protein, 267 aa, Lactobacillus plantarum WCFS1
MNNSWINISGKVYVVTGGSSGIGKAIVTELLNNGAIVYNADLNQGDQQNDNLHFVETNVTDAEAVNRLVLKVVDEQGKIDGLVNNAGINLPRLLADAKDPHGKYEFAESDFVKMFAVNVKSVFLVSQAVTHQFEKQQYGVIVNMSSEAGLEGSQGQSVYSATKGAINGFTRSWAKELGEHNIRVVGVAPGIMEATGLRTRSYEEALAYTRHKTVDDIRAGYKSTSTTPLGRSGKLSEVADAVNYLLSERASYITGVTINVAGGKSRG

SEQ ID NO: 20740 - protein, 406 aa, Homo sapiens [sequence omitted]

SEQ ID NO: 20741 - protein, 485 aa, Taxus cuspidata
MDALKQLEVSPSILFVTLAVMAGIILFFRSKRHSSVKLPPGNLGFPLVGETLQFVRSLGSSTPQQFIEERMSKFGDVFKTSIIGHPTVVLCGPAGNRLVLSNENKLVQMSWPSSMMKLIGEDCLGGKTGEQHRIVRAALTRFLGPQALQNHFAKMSSGIQRHINEKWKGKDEATVLPLVKDLVFSVASRLFFGITEEHLQEQLHNLLEVILVGSFSVPLNIPGFSYHKAIQARATLADIMTHLIEKRRNELRAGTASENQDLLSVLLTFTDERGNSLADKEILDNFSMLLHGSYDSTNSPLTMLIKVLASHPESYEKVAQEQFGILSTKMEGEEIAWKDLKEMKYSWQVVQETLRMYPPIFGTFRKAITDIHYNGYTIPKGWKLLWTTYSTQTKEEYFKDADQFKPSRFEEEGKHVTPYTYLPFGGGMRVCPGWEFAKMETLLFLHHFVKAFSGLKAIDPNEKLSGKPLPPLPVNGLPIKLYSRS

SEQ ID NO: 20742 - protein, 305 aa, Mus musculus
MAEASAAGADAGSAVAAHRFFCHFCKGEVNPKLPEYICPRCDSGFIEEVTDDSSFLGGGGSRTDNSTATHFAELWDHLDHTMFLQDFRPFLSSNPLDQDNRANERGHQTHTDFWGPSRPPRLPMTRRYRSRGSTRPDRSPAIEGIIQQIFAGFFANSAIPGSPHPFSWSGMLHSNPGDYAWGQTGLDAIVTQLLGQLENTGPPPADKEKITSLPTVTVTQEQVNTGLECPVCKEDYTVEEKVRQLPCNHFFHSSCIVPWLELHDTCPVCRKSLNGEDSTRQTQSSEASASNRFSNDSQLHDRWTF

SEQ ID NO: 20743 - protein, 232 aa, Homo sapiens
ELWGHLDHTMFFQDFRPFLSSSPLDQDNRANERGHQTHTDFWGARPPRLPLGRRYRSRGSSRPDRSPAIEGILQHIFAGFFANSAIPGSPHPFSWSGMLHSNPGDYAWGQTGLDAIVTQLLGQLENTGPPPADKEKITSLPTVTVTQEQVDMGLECPVCKEDYTVEEEVRQLPCNHFFHSSCIVPWLELHDTCPVCRKSLNGEDSTRQSQSTEASASNRFSNDSQLNDRWTF

SEQ ID NO: 20744 - protein, 513 aa, Drosophila melanogaster
MLDVPHEAKVRGHQRAPSDSKEFHEVTKRDALRLLEHDVDRLLETTEKARQPALKAEMGRFADLFGRFIQEEGPALDWNKIQKLPENAVMNYSNLKSPKNEQNEIRNMLDKLVVIKLNGGLGTSMGCHGPKSVIPVRSDLTFLDLTVQQIEHLNKTYDANVPLVLMNSFNTDEDTEKIVRKYKGFRVQIHTFNQSCFPRISREHYLPVAKDFDVEKDMEAWYPPGHGDFYDTFRNSGLLKKFIEEGREYCFLSNIDNLGATVDLNILNKLVGEERATTPVEFVMEVTDKTRADVKGGTLIQMENKLRLLEIAQVPPEHVDDFKSVKTFKFFNTNNIWANLAAIDRVLRERTLNMEIIVNNKTLENGTRVIQLETAVGAAMKCFDGAIGINVPRSRFLPVKKSSDLLLVMSNLYTLKNGSLVMSPQRMFPTTPLVKLGENHFSKVKEFLGRFANIPDIIELDHLTVSGDVTFGRGVSLRGTVIIIANHGDRIDIPAGAILENKIVSGNMRILDH

SEQ ID NO: 20745 - protein, 280 aa, Drosophila melanogaster
MKFVILLCVLSALLLQIEASPLQRLSRSERAVSRQQTVNNEVAPAVAPASDDDDDDDDEDDDDEPDLGDLIDDDDDDDEEEDDDEDEEDDTPQGQAAPAATASDDDEEEDDDDDDYLDRLFDDILGDDEDEDDDDETPAATAQQSAVAAAPAQTLDEVAPAAASSVSAGISDGVDLPAESGNAAEVLAAGNAADESVSAAVAPAQNAAASSSNNEGIAGDDDEEADDDDDDDDDDIIGDDIIEARREARESKSKSETATKETKAKKSTSPSKKAKKELKH

SEQ ID NO: 20746 - protein, 366 aa, Mus musculus
MSLTRKRGFYKQDINKTAWELPKTYLAPAHVGSGAYGAVCSAIDKRTGEKVAIKKLSRPFQSEIFAKRAYRELLLLKHMHHENVIGLLDVFTPASSLRSFHDFYLVMPFMQTDLQKIMGMEFSEDKVQYLVYQMLKGLKYIHSAGIVHRDLKPGNLAVNEDCELKILDFGLARHTDTEMTGYVVTRWYRAPEVILSWMHYNQTVDIWSVGCIMAEMLTGKTLFKGKDYLDQLTQILKVTGVPGAEFVQKLKDKAAKSYIQSLPQSPKKDFTQLFPRASPQAADLLDKMLELDVDKRLTAAQALAHPFFEPFRDPEEETEAQQPFDDALEHEKLSVDEWKQHIYKEISNFSPIARKDSRRRSGMKLQ

SEQ ID NO: 20747 - protein, 248 aa, Populus tremuloides
MGRGRVQLKRIENKINRQVTFSKRRTGLLKKAHEISVLCDAEVALIVFSHKGKLFEYSTDDCMEEILERYERYSYAERQLVATDLDSQGDWTLEYNRLKAKVELLQRNHRNYVGEDLDSMSLKELQNLEQQIETALKHIRARKNHLMSQSISEMQRKEKAIQVQNNMLVKQIKEKEKKDKAVAQPAFWDQQNHGPDASSFLLSQPAGLPLPCLNIGGSYQEEAPEARRNGLGHTLEPIYSFHLGGYGA

SEQ ID NO: 20748 - protein, 240 aa, Populus tremuloides
MGRGRVQLKRIENKINRQVTFSKRRAGLLKKAHEISVLCDAEVALIVFCHKGKLFEYSTNACMEKILERHERYSYAERQLVATDLDSQGNWTLEYNRLKEKVELLQRNHRHYLGEDLDSVSLKELQNLEKQIDTALELIRERKNHLMYQSISELQIKEKAIKEQNNMLVKQIKEKEKALAQPALWDQQDHGPNASSFLLPQPPLPCLNISYQEEDPIARRNELDLTLEPIYSCHLGCFGT

SEQ ID NO: 20749 - protein, 325 aa, Mus musculus
MTASSVLLHTGQKMPLIGLGTWKSEPGQVKAAIKHALSAGYRHIDCASVYGNETEIGEALKESVGSGKAVPREELFVTSKLWNTKHHPEDVEPALRKTLADLQLEYLDLYLMHWPYAFERGDNPFPKNADGTVRYDSTHYKETWKALEVLVAKGLVKALGLSNFNSRQIDDVLSVASVRPAVLQVECHPYLAQNELIAHCHARGLEVTAYSPLGSSDRAWRHPDEPVLLEEPVVLALAEKHGRSPARILLRWQVQRKVICIPKSINPSRILQNIQVFDFTFSPEEMKQLDALNKNWRYIVPMITVDGKRVPRDAGHPLYPFNDPY

SEQ ID NO: 20750 - protein, 503 aa, Arabidopsis thaliana
MVIGLSTMLEKTEALFASDHASVVSMNLFVALLCACIVLGHLLEETRWMNESITALIIGSCTGIVILLISGGKSSRILVFSEDLFFIYLLPPIIFNAGFQVEKKQFFRNFMTIMLFGAIGTLISFVIISFGAKHLFEKMNIGDLTIADYLAIGAIFSATDSVCTLQVLNQDETPLLYSLVFGEGVVNDATSVVLFNAIQRFDLTNINSAIALEFAGNFFYLFILSTALGVAAGLLSAFVIKKLYIGRHSTDREVALMMLLAYLSYMLAELFHLSSILTVFFCGIVMSHYTWHNVTDKSKVTTKHTFAAMSFLAEIFIFLYFGMDALDIEKWDVVRNSPGQSIGVSSILLGLILLGRAAFVFPLSFLSNLTKSSPDEKIDLKKQVTIWWAGLMRGAVSMALAYNQFTTSGHTKVLGNAIMITSTITVVLFSTVVFGLLTKPLVKHLQPSSKQSSTTALQITLRSSFHDPILHEPLLSTQGQSEYDPEQHVSFRMFWKSPSRFTH

SEQ ID NO: 20751 - protein, 250 aa, Arabidopsis thaliana
MGRGRVELKRIENKINRQVTFAKRRNGLLKKAYELSVLCDAEVSLIVFSNRGKLYEFCSTSNMLKTLERYQKCSYGSIEVNNKPAKELENSYREYLKLKGRYENLQRQQRNLLGEDLGPLNSKELEQLERQLDGSLKQVRCIKTQYMLDQLSDLQGKEHILLDANRALSMKLEDMIGVRHHHVGGGWEGGDQQNIAYGHPQAHSQGLYQSLECDPTLQIGYSHPVCSEQMAVTVQGQSQQGNGYIPGWML

SEQ ID NO: 20752 - protein, 259 aa, Arabidopsis thaliana
MASSQRYFALLAPFAVSLKFCYCQNETIDVAGSGTAGVTWYGEPFGAGSTGGACGYGSAVANPPLYAMVSAGGPSLFNNGKGCGTCYQVVCIGHPACSGSPITVTITDECPGGPCASEPVHIDLSGKAMGALAKPGQADQLRSAGVIRVNYKRAACLYRGTNIVFRMDAGANPYYISFVVEYENGDGDLSNVEIQPAGGSFISMQEMRSAVWKVNSGSALRGPFNIRLTSGESHKVIVAYNVIPANWKPDESYRSIVNF

SEQ ID NO: 20753 - protein, 304 aa, Arabidopsis thaliana
TGAKFPSVGLGTWQASPGLVGDAVAAAVKIGYRHIDCAQIYGNEKEIGAVLKKLFEDRVVKREDLFITSKLWCTDHDPQDVPEALNRTLKDLQLEYVDLYLIHWPARIKKGSVGIKPENLLPVDIPSTWKAMEALYDSGKARAIGVSNFSTKKLADLLELARVPPAVNQVECHPSWRQTKLQEFCKSKGVHLSAYSPLGSPGTTWLKSDVLKNPILNMVAEKLGKSPAQVALRWGLQMGHSVLPKSTNEGRIKENFNVFDWSIPDYMFAKFAEIEQARLVTGSFLVHETLSPYKSIEELWDGEI

SEQ ID NO: 20754 - protein, 535 aa, Arabidopsis thaliana
MEVSSVKKLEQLEYSLESVTDLSSSSVSSSSPAVATFSYVDGVTELRFLQSDSTHCFNFDLASAQLFKLGPVHFICVSDGSSSSEEKSFSKGVNIKFKNEKDSKDFCESFEEWRNDSVVQGSSLQNGTVSANKSKFDNKIEASSAKMYFHYYGQLLHQQNMLQDYVRTGTYYAAVMENHSDFAGRVVVDVGAGSGILSMFAAQAGAKHVYAVEASEMAEYARKLIAGNPLFADRITVIKGKVEDIELPEKADILISEPMGTLLVNERMLESYVIARDRFMTPKGKMFPTVGRIHMAPFSDEFLFIEMANKAMFWQQQNYYGVDLTPLYGSAHQGYFSQPVVDAFDPRLLVASPMFHMIDFTQMKEEDFYEIDIQLKLTASMCTRMHGLACWFDVLFDGSTVQRWLTTAPGAPTTHWYQIRCVLSQPIYVMAGQEITGRLHLIAHSAQSYTIDLTLSAKMWGPGASQGGILQSSTCKFDLKEPYYRMSQPQAYPVAQEPPLQPQPELSTQQDIQTPNDELEEELLQQLPQNPSAQL

SEQ ID NO: 20755 - protein, 312 aa, Arabidopsis thaliana
TNPPQNLHFISSSSSLKPHLCLSFKRINPKHKSSSSSVFVPYASQSSIAITSKERWSLNGMSALVTGGTRGIGRAIVEELAGLGAEVHTCARNEYELENCLSDWNRSGFRVAGSVCDVSDRSQREALMETVSSVFEGKLHTLVNNVGTNIRKPMVEFTAGEFSTLMSTNFESVFHLCQLAYPLLRESKAGSVVFISSVSGFVSLKNMSVQSSTKGAINQLTRSLACEWAKDNIRINAVAPWYIKTSMVEQVLSNKEYLEEVYSVTPLGRLGEPREVSSAVAFLCLPASSYITGQILCVDGGMSINGFFPRHD

SEQ ID NO: 20756 - protein, 346 aa, Arabidopsis thaliana
MVTSSDQIQNGSEEQSKRSEIYTYEAPWQIYAMNWSIRRDKKYRLAITSLIEQYPNRVEIVQLDESNGEVRSDPNLCFEHPYPPTKTSFIPDKECQRPDLLATSSDFLRLWRISDDESRVELKSCLSSDKNSEFSGPITSFDWNEAEPRRIGTSSIDTTCTIWDIEREVVDTQLIAHDKEVYDIAWGGVGVFASVSEDGSVRVFDLRDKEHSTIIYESGEPSTPLVRLSWNKQDPRYMATVIMGSAKIVVLDIRFPALPVVELQRHQASVNAIAWAPHSSSHICSAGDDSQALIWDISSMGQHVEGGLDPILAYTAGAEVEQLQWSSSQPDWVAIAFSNKLQILRV

SEQ ID NO: 20757 - protein, 425 aa, Arabidopsis thaliana
MKPSSPISLTSSSIARKARFSPYLFTLLAFILFVSVLYGEDFMCIFGQLEPNFVLPPSRTPEKNKKSEKLAFAIGKTEESCDVFSGKWVRDEVSRPLYEEWECPYIQPQLTCQEHGRPDKDYQFWRWQPNHCDLPSFNASLMLETLRGKRMMYVGDSLNRGMFVSMICLLHRLIPEDQKSIKTNGSLTVFTAKEYNATIEFYWAPFLLESNSDDAIVHRISDRVVRKGSINKHGRHWKGVDIIIFNTYLWWMTGLKMNILQGSFDDKEKNIVEVSTEDAYRMGMKSMLRWVKNNMDRKKTRVFFTSMSPAHAKGIDWGGEPGQNCYNQTTLIEDPSYWGSDCRKSIMKVIGEVFGRSKTPITLLNITQMSNYRKDAHTSIYKKQWSPLTAEQLENPTSYADCVHWCLPGLQDTWNELLFAKLFYT

SEQ ID NO: 20758 - protein, 359 aa, Burkholderia pseudomallei
MPKSKRHDPQAESEKISRAKQASVERTGASADEDEDAADNERDYESRDADPDESGEGRGDAQPDLDDFRALLQAELTADTIQHYLNRISVKPLLTVEEEQRYSRLAKAGEFEARQVMIERNLRLVVSIAKGYLNRGVPLLDLIEEGNLGLMHAIEKFDPTRGFRFSTYATWWIRQSIERAIMNQARTVRLPVHVIRELNQVLRAKRHLEKNSMSTGEAAERREASIDDIAYLTGKTAEEVTDILALNEHTASLDAPLDLDPASSLLDLLPDDQSQSPDAEVQHRELETLTRAWLSRLSDKHRHVIERRFGLNHIEPATLEELADEMGLTRERVRQIQQEALVRLKRFFASNGVRKDAVL

SEQ ID NO: 20759 - protein, 324 aa, Hypocrea jecorina
MASPTLKLNSGYDMPQVGFGLWKVDNAVCADTVYNAIKAGYRLFDGACDYGNEKECGEGVARAIKDGLVKREDLFIVSKLWQTFHDEDKVEPITRRQLADWQIDYFDLFLVHFPAALEYVDPSVRYPPGWFYDGKSEVRWSKTTTLQQTWGAMERLVDKGLARSIGVSNYQAQSVYDALIYARIKPATLQIEHHPYLQQPDLVSLAQTEGIVVTAYSSFGPTGFMELDMPRAKSVAPLMDSPVIKALADKHRRTPAQVLLRWATQRGIAVIPKTSRPEVMAQNLDNTSFDLDSEDLAKIADMDLNIRFNKPTNYFSANKLYLFG

SEQ ID NO: 20760 - protein, 249 aa, Pantoea agglomerans
MSKKVVLITGGGRGIGREICMEFASENTHIALTYTRDARSAEQVRQTLEDSNVTCSVHKLDVQDFHMCQSVVETVEREYGTINILVNNAGVTLSKQFVNCDEAENKAVLSTNLQGVMNMTLATVPSLKKSTSNDEPGRIVNISSNTSLCGNAGQVAYSVTKAGVNGFTRLCARTLASHNIFVNAVAPGYIDTDMTQDLPESAYSHVLQVSAIKRTGCVKDVSSIVRLLCGDNCHYMTGQVLHIDGGKFC

SEQ ID NO: 20761 - protein, 211 aa, Anopheles gambiae
MALLLRVTVACGAVLALVTVRGQAANPTTEAFGRNEIVPGLIDVAPEQTIKITYPQSDVEVSLGNQLTPTQVKARPKLCWEVEPSALYTLLMADPDAPSRSNPEMRSWKHWLVGNIPGADVDAGDVLADYVGSGPPQGTGLHRYVFLVYKQPSRIVFNETVLSSRNPNRGKWNPAEFVKEYELGVPVAGNFYQAQYDDYVPELYATFTDTA

SEQ ID NO: 20762 - protein, 370 aa, Arabidopsis thaliana
  unsure (1)..(370): unsure at all Xaa locations
MSAIMKSLCFSFLILASFATFFSVADAWRFNVGGNGAWVTNPQENYNTWAERNRFQVNDSPYFKYAKRSDSVQQVMKADFDGCNARNPIKNFENGESVVTLDRSGAFYFISGNQDHCQKGQKLIVVVLAVRNQPSAPAHSPVPSVSPTQPPKSHSPVSPVAPASAPSKSQPPRSSVSPAQPPKSSSPISHTPALSPSHATSHSPATPSPSPKSPSPVSHSPSHSPAHTPSHSPAHTPSHSPAHAPSHSPAHAPSHSPAHAPSHSPAHSXSHSPATPKSPSPSSSPAQSPATPSPMTPQSPSPVSSPSPDQSAAPSDQSTPLAPSPSETTPTADNITAPAPSPRTNSASGLAVTSVMSTLFSATFTFLMFA

SEQ ID NO: 20763 - protein, 252 aa, Lactobacillus brevis
MSNRLDGKVAIITGGTLGIGLAIATKFVEEGAKVMITGRHSDVGEKAAKSVGTPDQIQFFQHDSSDEDGWTKLFDATEKAFGPVSTLVNNAGIAVNKSVEETTTAEWRKLLAVNLDGVFFGTRLGIQRMKNKGLGASIINMSSIEGFVGDPSLGAYNASKGAVRIMSKSAALDCALKDYDVRVNTVHPGYIKTPLVDDLPGAEEAMSQRTKTPMGHIGEPNDIAYICVYLASNESKFATGSEFVVDGGYTAQ

SEQ ID NO: 20764 - protein, 375 aa, Homo sapiens [sequence omitted]

SEQ ID NO: 20765 - protein, 765 aa, Sclerotinia sclerotiorum
MNRYDDGELEISLAPSANHRAQHRSSEASSNPRRDSQNGGNRRMESAPQKKTEQRVGAYSVVRTLGEGSFGKVKLAVHRVTQQQVALKIIARRKLISRDMAGRVEREIEYLQLLRHPHIIKLYTVIKTPHEIIMVSEYAGNELFDYIVQHGKMREDEARRFFQQIICAVEYCHRHKIVHRDLKPENLLLDENLNVKIADFGLSNIMTDGNFLKTSCGSPNYAAPEVINGKLYAGPEVDVWSCGVILYVLLVGRLPFDDEHIPSLFAKIARGQYNVPSYMGREAAALIKKMLAVNPVYRATIAEIRDDPWFTTNLPAYLQPPVEEFIDTGVDPAKAINPRAIAPHASPAIQEKLHVQVTEKISKTMGYGIKDVQEALAAEEPSAIKDAYLIVRENKLMQANPNLTDDKNQLLFQIPSPPTYDSTIPPSMPDSPSPLVKERPGNIPPTAPPFQPRPSPLLDAVSPRSSSSIGTDRSFVRPYVSKIGILPSSIPQYHKEFMETHKSGHQESTLSNSHSETIEPSPQTEAEKAETVRRLNPHSRSLAKLDEGKKPAGMTPVPVKKAKPTKWQFGIRSRNQPLEAIGCIYRALQKLGAEWLVGDEWTPGQSENNGNKRNDDNDDNDDPNGSGASLHRETSMNDNSKKNRFSGIDKKGNYKLPEDPWVLHVRWKKTDIRRHSIASLNSSTSSPAHPSSMPKDEGLDSIDGGVIMHLDIQLYEMEPGVYLVDFKCAGYETADGMMCEEKDVTSPFPFLDLASKLIIQLAEAD

SEQ ID NO: 20766 - protein, 183 aa, Raphanus sativus
KGKIQGYGSKLANNASGQLEWEDYFFHLVYPEDKRDLSLWPKTPTDYIEATSEYAKCLRLLATKVFKALSIGLGLEPDRIEKEVGGLEELLLQMKINYYPKCPQPELALGVEAHTDVSALTFILHNMVPGLQLFYEGKWVIAKCVPDSIVMHIGDTLEILSNGKFKSILHRGLVNKEKVRVSW

SEQ ID NO: 20767 - protein, 1081 aa, Oryza sativa (japonica cultivar-group)
MDGDADAVKSGRHGSGQACQICGDGVGTTAEGDVFAACDVCGFPVCRPCYEYERKDGTQACPQCKTKYKRHKGSPAIRGEEGEDTDADDVSDYNYPASGSADQKQKIADRMRSWRMNAGGGGDVGRPKYDSGEIGLTKYDSGEIPRGYIPSVTNSQISGEIPGASPDHHMMSPTGNIGKRAPFPYVNHSPNPSREFSGSIGNVAWKERVDGWKLKQDKGAIPMTNGTSIAPSEGRGVGDIDASTDYNMEDALLNDETRQPLSRKVPLPSSRINPYRMVIVLRLVVLSIFLHYRITNPVRNAYPLWLLSVICEIWFALSWILDQFPKWFPINRETYLDRLALRYDREGEPSQLAAVDIFVSTVDPMKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKVRINGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKKGSFLSSLCGGRKKASKSKKKSSDKKKSNKHVDSAVPVFNLEDIEEGVEGAGFDDEKSLLMSQMSLEKRFGQSAAFVASTLMEYGGVPQSATPESLLKEAIHVISCGYEDKTEWGTEIGWIYGSVTEDILTGFKMHARGWRSIYCMPKRPAFKGSAPINLSDRLNQVLRWALGSVEILFSRHCPIWYGYGGRLKFLERFAYINTTIYPLTSIPLLIYCVLPAICLLTGKFIIPEISNFASIWFISLFISIFATGILEMRWSGVGIDEWWRNEQFWVIGGISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQTCGINC

SEQ ID NO: 20768 - protein, 284 aa, Oryza sativa (japonica cultivar-group)
MASSSRPEEAAAAAPPWSRLEGRVVLVTGASSGLGREFCLDLARAGCLVVAAARRADRLRSLCDEINASAPRASAAAAAVELDVASGGPALEAAVQSAWDAFGRIDVLINNAGLRGGVHSPLDWPEDEWETLIKTNLTGSWLVAKHVCRRMRDAKLKGSVINISSVSGLNRGHLPGSTGYAASKSAMHYATKLMALELGAYGIRVNSIAPGIFKSEITAPLLQKKWLSTVVSKIVPLKTHGTTDPALTSLVRFLIHETSSYVTGNIFIVDSGATLPGVPIFSSL

SEQ ID NO: 20769 - protein, 502 aa, Vigna unguiculata
MDFTPPPIEDGFTAEKLFSQGFSYTYDDVIFLPHYIDFAADAVDLSTRLTRRLPLAVPLVASPMDTVSESAMASAMASLGGIAIVHSNVPAAAQASLVRAAKSRRVPILSEPAFAAPSAVIEHEDDFAASPFLLVTDIGAAGGKLLGYVAKRDWTNQKDKSLRVGDYMAPPPRRAPWNADLNKIHEIMENEKSGAVALERDGEVVDLVVREEVERVKGYPKLAAPATVGPDGEFMVGAAMGTREDDKERLKHLVKAGVNVVVLDSSQGNSIYQLEMVKYVKSVYPELDVIGGNVVTMYQAENLIQAGVDGLRVGMGSGSICTTQEVCAVGRGQATAVYKVSSIAYKSGVPVIADGGISNSGHIVKALSLGASTAMMGSFLAGSHEAPGAYVYQNGQRVKKYRGMGSLEAMTKGSDARYLGDTAKLKIAQGVVGAVKDKGSVLNFIPYTLQAVRQGFQDIGASSLQSAHDLLRSRVLRLEVRTGAAQVEGGVHGLVSYEKKYY

SEQ ID NO: 20770 - protein, 250 aa, Bacillus thuringiensis serovar oswaldocruzi
MTVKKLYFIPAGRCMLDHSSVNSTLAPGNLLNLPVWCYLLETEEGPILVDTGMPESAVNNEGLFNGTFVEGQILPKMTEEDRIVNILKRVGYEPDDLLYIVSSHLHFDHAGGNGAFTNTPIIVQRKEYEAALHREEYMKECILPHLNYKIIEGDYEVVPGVQLLYTPGHSPGHQSLLIETEKSGPVLLTIDASYTKENFEDEVPFAGFDSELALSSIKRLKEVVAKEKPIIFFGHDIEQEKGCKVFPEYI

SEQ ID NO: 20771 - protein, 250 aa, Bacillus thuringiensis serovar jinhongiensis
MTVKKLYFIPAGRCMLDHSSVNSTLTPGNLLNLPVWCYLLETEEGPILVDTGMPESAVNNEGLFNGTFVEGQILPKMTEEDRIVNILKRVGYEPDDLLYIVSSHLHFDHAGGNGAFTNTPIIVQRTEYEAALHREEYMKECILPHLNYKIIEGDYEVVPGVQLLYTPGHSSGHQSLFIETKKSGPVLLTIDASYTKENFEDEVPFAGFDSELALSSIKRLKEVVAKEKPIIFFGHDIEQEKGCKVFPEYI

SEQ ID NO: 20772 - protein, 258 aa, Ralstonia eutropha
MNPDTPSNKVALVTGAASGIGQALALAYAQAGIAVAGSYYPRDPHDPGQTLELVERAGGRCVMEAVDVGDAEQVEHLARVAVDRFGRLDFAVANAGLLRQAALVEMSDAQWLEVINIDLGGVMRTFRASARHMAAGGAMVAVSSIAGGVYGWEQHAHYAAAKAGVPGLCRAVAMELAPRGIRCNAVIPGLIETPQSLDPVNSLGPEGLAQAARGIPLGRVGQAREIAALIRFLTSDEASYITGQSIIADGGLTVRWPS

SEQ ID NO: 20773 - protein, 252 aa, Ralstonia eutropha
MSTSKPLDGRRAVVTGAGSGIGEAIALAYAQAGAQLLLADIDAARADSVARRCRALGAQAETVIGDVGDESTAHRIIDRCVQAFGGIDILVNNAGMLTQSRCADMSTAMWDEMLRVDLRSVFLCARRAVPHMQAQRWGRIISIASQLGIKGGVELSHYAAAKAGVIGFTKSLALEVAPDNVLVNAIAPGPIATPLVDGISADWKRAKEASLPLGRFGRADEVAPTAVLLASDPGGNLYVGQTLGPNSGDVMP

SEQ ID NO: 20774 - protein, 559 aa, Phanerochaete chrysosporium
MLFALLALGAAIGVGAAPSSGPPVVQVPSMDNFVLGSGVAGQPPQVRHYEFVVEEMLGAPDGVTKPMLVVNGLFPGPTIEVNQYDRLVVRVINRIQNATTIHWHGIPQNGTAYYDGTAGITECGIPPGQSLTYDFTFGDFSGTTWWHSHYDTQYTDGVTGALIVHPTFPDPPGFPTWDEELVIELTDVYHTFSTILNAQYLSPSGPIGGSAGDEPVPDSGALNGLGQYHGLGNYFNFTLQPNKTYRLRLIHTGSLADIRFSVDNHPLTVIEADGTLTEPTVVAGLTLAVAQRYSVLLTTNQTNGSYWMRTLQQTDMFTYKLPGQNPDNRGIISYGTGTGPTLPPAKEDPGATLGGMQLNDLDPYTLPPAVPEAVPDNTKFYQVSFEFDNLPSGASRAYMNGTSWDPLPKTNILLEIQRAYNAGRAFAPEGASVQFGNQFLITEDKIEVLDLVLENNDNGDHPFHLHGYSPWMIGVGDSPYDPNNVTLNTVNPLSRDTVEIPANGWVRLRFITYNPGAWTLHCHISWHMSAGLLMQFVTLPSVAATLPIPQVIANMCSAA

SEQ ID NO: 20775 - protein, 428 aa, Xenopus laevis
MKGPWLVLAALCLALANLGAWAEDGLDFPEYDGEDRVININLKNYKAALKKYEVLALLYHEPIEDDKASQRQFEMEELIFELAAQVLEDKGVGFGLVDSEKDAAVAKKLGLDEEDSIYVFKDDEVIEYDGEFAADTLVEFLLDVLEDPVEFIEGSHELAAFENIDEDQKLIGYFKNEDSDHYKAYLDAAEEFHPYIPFFATFDSKVAKKLDLKINEIDYYEPFHDEPVTIPNKPNSEEEIVDFLHLHKRPTLRKLKPDSMYETWEDDLDGIHIVAFAEEDDPDGYEFLEIIKEVAEDNTDNPDLSIIWIDPEEFPLLIPYWEETFNIDLSRPHIGIVNVTDADSIWMDMDDEEDLPTVDELEDWLEDVLEGDVNTEDDDDDDDDDDDDDDDDDDDDDDDDDDDDDDDDDDDDDDDDDDDDDDDDDDDE

SEQ ID NO: 20776 - protein, 514 aa, Danio rerio
MADYLISGQTGYVPDDGLTGQQLFNSGDGLTYNDFLILPGYIDFTADQVDLTSALTKQITMKTPLISSPMDTVTESGMAIAMALTGGIGFIHHNCTPEFQANEVRKVKRYEQGFITDPVVMSPNERVRDVFQAKARHGFCGIPITDNGQMGGRLVGIISSRDIDFLKESEHDLPLSEVMTKREDLVVAPAGVTLKEANEILQRSKKGKLPIVNEEGCLVAIIARTDLKKNRDFPLASKDSRKQLLCGAAIGTHNDDKYRLDLLAQAGVDVVVLDSSQGNSIFQINMIKYIKEKYPNVQVIGGNVVTAAQAKNLIDAGADALRVGMGSGSICITQEVLACGRPQATAVYKVSEYARRFGVPVIADGGIQTVGHIAKALALGASTVMMGSLLAATSEAPGEYFFSDGIRLKKYRGMGSLDAMDKNLGSQTRYFSESDKIKVAQGVSGAVQDKGSIHKFVPYLLVGIQHSCQDIGAKSLTQLRAMMYSGELRFEKRTMSAQMEGGVHSQHSYEKRLF

SEQ ID NO: 20777 - protein, 452 aa, Xenopus laevis
MGRKKKKQLKPWCWYCNRDFDDEKILIQHQKAKHFKCHICHKKLYTGPGLAIHCMQVHKETIDAVPNAIPGRTDIELEIYGMEGIPEKDMEERRRILEQKTQVDGQKKKTNQDDSDYDDDDDTAPSTSFQQMQTQQAFMPTMGQPGIPGLPGAPGMPPGITSLMPAVPPLISGIPHVMAGMHPHGMMSMGGMMHPHRPGIPPMMAGLPPGVPPPGLRPGIPPVTQAQPALSQAVVSRLPVPSTSAPALQSVPKPLFPSAGQAQAHISGPVGTDFKPLNNIPATTAEHPKPTFPAYTQSTMSTTSTTNSTASKPSTSITSKPATLTTTSATSKLVHPDEDISLEEKRAQLPKYQRNLPRPGQAPISNMGSTAVGPLGAMMAPRPGLPPQQHGMRHPLPPHGQYGAPLQGMAGYHPGTMPPFGQGPPMVPPFQGGPPRPLMGIRPPVMSQGGRY

SEQ ID NO: 20778 - protein, 514 aa, Xenopus laevis
MADYLISGGTGYVPEDGLTAQQLFANSEGLTYNDFLILPGFIDFTADEVDLTSALTRKITLKTPMISSPMDTVTESDMAIAMALMGGIGIIHHNCTPEFQANEVRKVKKFEQGFITDPVVMSLNHTVGDVFEAKNRHGFSGIPVTETGKMGSKLVGIVTSRDIDFLTEKDYSTYLSEVMTKREDLVVAPAGVTLKEANEILQRSKKGKLPIVNDSDELVAIIARTDLKKNRDYPLASKDCRKQLLCGAAIGTREDDKYRLDLLMQAGVDVVVLDSSQGNSVYQINMIHYIKQKYPELQVVGGNVVTAAQAKNLIDAGVDALRVGMGCGSICITQEVMACGRPQGTAVYKVAEYARRFGVPVVADGGIQTVGHVVKALALGASTVMMGSLLAATTEAPGEYFFSDGVRLKKYRGMGSLDAMEKSTSSQKRYFSEGDKVKVAQGVSGSIQDKGSIHKFVPYLIAGIQHGCQDIGAKSLSILRSMMYSGELKLEKRTMSAQVEGGVHGLHSYEKRLY

SEQ ID NO: 20779 - protein, 508 aa, Homo sapiens
MSRFVQDLSKAMSQDGASQFQEVIRQELELSVKKELEKILTTASSHEFEHTKKDLDGFRKLFHRFLQEKGPSVDWGKIQRPPEDSIQPYEKIKARGLPDNISSVLNKLVVVKLNGGLGTSMGCKGPKSLIGVRNENTFLDLTVQQIEHLNKTYNTDVPLVLMNSFNTDEDTKKILQKYNHCRVKIYTFNQSRYPRINKESLLPVAKDVSYSGENTEAWYPPGHGDIYASFYNSGLLDTFIGEGKEYIFVSNIDNLGATVDLYILNHLMNPPNGKRCEFVMEVTNKTRADVKGGTLTQYEGKLRLVEIAQVPKAHVDEFKSVSKFKIFNTNNLWISLAAVKRLQEQNAIDMEIIVNAKTLDGGLNVIQLETAVGAAIKSFENSLGINVPRSRFLPVKTTSDLLLVMSNLYSLNAGSLTMSEKREFPTVPLVKLGSSFTKVQDYLRRFESIPDMLELDHLTVSGDVTFGKNVSLKGTVIIIANHGDRIDIPPGAVLENKIVSGNLRILDH

SEQ ID NO: 20780 - protein, 514 aa, Xenopus laevis
MADYLISGGTSYVPDDGLAAQQLFGAGDGLTYNDFLILPGYIDFTADQVDLTSALTKKITLKTPMVSSPMDTVTEANMAIAMALTGGIGIMHHNCTPEFQANEVRKVKKYEQGFITDPVVLSPKHRVRHVFEAKARHGFCGIPITENGKMGSKLAGIISSRDIDFLRPEEHDLALSEIMTLREDLVVALAGVTLKEANEILQRSKKGKLPIVNGNDELVAIIARTDLKKNRDYPLASKDAKKQLLCGAAIGTHEDDKYRLDLLVQAGVDAVVLDSSQGNSIFQINMIKYIKEKYPDLQVIAGNVVTAAQAKNLIDAGADALRVGMGSGSICITQEVLACGRPQATAVYKVSEYARRFGVPVIADGGIQTVGHIAKALALGASTVMMGSLLAATTEAPGEYFFSDGIRLKKYRGMGSLDAMDKNVSSQKRYFSEADKIKVAQGVSGAVQDKGSIHKFIPYLIAGIQHSCQDIGAKSLTQVRAMMYSGELKFEKRTMSAQVEGGVHGLHSYEKRLF

SEQ ID NO: 20781 - protein, 321 aa, Homo sapiens
MKQLPVLEPGDKPRKATWYTLTVPGDSPCARVGHSCSYLPPVGNAKRGKVFIVGGANPNRSFSDVHTMDLETRTWTTPEVTSPPPSPRTFHTSSAAIGNQLYVFGGGERGAQPVQDTKLHVFDANTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 20782 - protein, 520 aa, Trametes villosa
MSRFHSLLAFVVASLTAVAHAGIGPVADLTITNAAVSPDGFSRQAVVVNGGTPGPLITGNMGDRFQLNVIDNLTNHTMVKSTSIHWHGFFQKGTNWADGPAFINQCPISSGHSFLYDFQVPDQAGTFWYHSHLSTQYCDGLRGPFVVYDPNDPAADLYDVDNDDTVITLVDWYHVAAKLGPAFPLGADATLINGKGRSPSTTTADLSVISVTPGKRYRFRLVSLSCDPNYTFSIDGHNMTIIETDSINTAPLVVDSIQIFAAQRYSFVLEANQAVDNYWIRANPNFGNVGFTGGINSAILRYDGAAAVEPTTTQTTSTAPLNEVNLHPLVTTAVPGSPVAGGVDLAINMAFNFNGTNFFINGTSFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDALDPSDQ

SEQ ID NO: 20783 - protein, 519 aa, Trametes villosa
MGLQRFSFFVTLALVARSLAAIGPVASLVVANAPVSPDGFLRDAIVVNGVVPSPLITGKKGDRFQLNVVDTLTNHSMLKSTSIHWHGFFQAGTNWAEGPAFVNQCPIASGHSFLYDFHVPDQAGTFWYHSHLSTQYCDGLRGPFVVYDPKDPHASRYDVDNESTVITLTDWYHTAARLGPKFPLGADATLINGLGRSASTPTAALAVINVQHGKRYRFRLVSISCDPNYTFSIDGHNLTVIEVDGINSQPLLVDSIQIFAAQRYSFVLNANQTVGNYWVRANPNFGTVGFAGGINSAILRYQGAPVAEPTTTQTPSVIPLIETNLHPLARMPVPGSPTPGGVDKALNLAFNFNGTNFFINNATFTPPTVPVLLQILSGAQTAQDLLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLDAGFAIVFAEDVADVKAANPVPKAWSDLCPIYDGLSEANQ

SEQ ID NO: 20784 - protein, 473 aa, Trametes villosa
MSFSSLRRALVFLGACSSALASIGPVTELDIVNKVIAPDGVARDTVLAGGTFPGPLITGKKGDNFRINVVDKLVNQTMLTSTTIHWHGMFQHTTNWADGPAFVTQCPITTGDDFLYNFRVPDQTGTYWYHSHLALQYCDGLRGPLVIYDPHDPQAYLYDVDDESTVITLADWYHTPAPLLPPAATLINGLGRWPGNPTADLAVIEVQHGKRYRFRLVSTSCDPNYNFTIDGHTMTIIEADGQNTQPHQVDGLQIFAAQRYSFVLNANQAVNNYWIRANPNRANTTGFANGINSAILRYKGAPIKEPTTNQTTIRNFLWETDLHPLTDPRAPGLPFKGGVDHALNLNLTFNGSEFFINDAPFVPPTVPVLLQILNGTLDANDLLPPGSVYNLPPDSTIELSIPGGVTGGPHPFHLHGTDNPGPWFLHCHIDFHLQAGLAIVFAEDAQDTKLVNPVPEDWNKLCPTFDKAMNITV

SEQ ID NO: 20785 - protein, 520 aa, Trametes villosa
MGRFSSLCALTAVIHSFGRVSAAIGPVTDLTISNGDVSPDGFTRAAVLANGVFPGPLITGNKGDNFQINVIDNLSNETMLKSTSIHWHGFFQKGTNWADGAAFVNQCPIATGNSFLYDFTATDQAGTFWYHSHLSTQYCDGLRGPMVVYDPSDPHADLYDVDDETTIITLSDWYHTAASLGAAFPIGSDSTLINGLGRFAGGDSTDLAVITVEQGKRYRMRLLSLSCDPNYVFSIDGHNMTIIEADAVNHEPLTVDSIQIYAGQRYSFVLTADQDIDNYFIRALPSAGTTSFDGGINSAILRYSGASEVDPTTTETTSVLPLDEANLVPLDSPAAPGDPNIGGVDYALNLDFNFDGTNFFINDVSFVSPTVPVLLQILSGTTSAADLLPSGSLFAVPSNSTIEISFPITATNAPGAPHPFHLHGHTFSIVRTAGSTDTNFVNPVRRDVVNTGTVGDNVTIRFTTDNPGPWFLHCHIDFHLEAGFAIVFSEDTADVSNTTTPSTAWEDLCPTYNALDSSDL

SEQ ID NO: 20786 - protein, 1265 aa, Homo sapiens
MSPALQDLSQPEGLKKTLRDEINAILQKRIMVLDGGMGTMIQREKLNEEHFRGQEFKDHARPLKGNNDILSITQPDVIYQIHKEYLLAGADIIETNTFSSTSIAQADYGLEHLAYRMNMCSAGVARKAAEEVTLQTGIKRFVAGALGPTNKTLSVSPSVERPDYRNITFDELVEAYQEQAKGLLDGGVDILLIETIFDTANAKAALFALQNLFEEKYAPRPIFISGTIVDKSGRTLSGQTGEGFVISVSHGEPLCIGLNCALGAAEMRPFIEIIGKCTTAYVLCYPNAGLPNTFGDYDETPSMMAKHLKDFAMDGLVNIVGGCCGSTPDHIREIAEAVKNCKPRVPPATAFEGHMLLSGLEPFRIGPYTNFVNIGERCNVAGSRKFAKLIMAGNYEEALCVAKVQVEMGAQVLDVNMDDGMLDGPSAMTRFCNLIASEPDIAKVPLCIDSSNFAVIEAGLKCCQGKCIVNSISLKEGEDDFLEKARKIKKYGAAMVVMAFDEEGQATETDTKIRVCTRAYHLLVKKLGFNPNDIIFDPNILTIGTGMEEHNLYAINFIHATKVIKETLPGARISGGLSNLSFSFRGMEAIREAMHGVFLYHAIKSGMDMGIVNAGNLPVYDDIHKELLQLCEDLIWNKDPEATEKLLRYAQTQGTGGKKVIQTDEWRNGPVEERLEYALVKGIEKHIIEDTEEARLNQKKYPRPLNIIEGPLMNGMKIVGDLFGAGKMFLPQVIKSARVMKKAVGHLIPFMEKEREETRVLNGTVEEEDPYQGTIVLATVKGDVHDIGKNIVGVVLGCNNFRVIDLGVMTPCDKILKAALDHKADIIGLSGLITPSLDEMIFVAKEMERLAIRIPLLIGGATTSKTHTAVKIAPRYSAPVIHVLDASKSVVVCSQLLDENLKDEYFEEIMEEYEDIRQDHYESLKERRYLPLSQARKSGFQMDWLSEPHPVKPTFIGTQVFEDYDLQKLVDYIDWKPFFDVWQLRGKYPNRGFPKIFNDKTVGGEARKVYDDAHNMLNTLISQKKLRARGVVGFWPAQSIQDDIHLYAEAAVPQAAEPIATFYGLRQQAEKDSASTEPYYCLSDFIAPLHSGIRDYLGLFAVACFGVEELSKAYEDDGDDYSSIMVKALGDRLAEAFAEELHERVRRELWAYCGSEQLDVADLRRLRYKGIRPAPGYPSQPDHTEKLTMWRLADIEQSTGIRLTESLAMAPASAVSGLYFSNLKSKYFAVGKISKDQVEDYALRKNISVAEVEKWLGPILGYDTD

SEQ ID NO: 20787 - protein, 1051 aa, Homo sapiens
KRVETALESCGLKFNRSESIRPDEFSLEIFERFLNKLCLRPDIDKILLEIGAKGKPYLTLEQLMDFINQKQRDPRLNEVLYPPLRPSQARLLIEKYEPNQQFLERDQMSMEGFSRYLGGEENGILPLEALDLSTDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGDALLIEPLDKYPLAPGVPLPSPQDLMGRILVKNKKRHRPSAGGPDSAGRKRPLEQSNSALSESSAATEPSSPQLGSPSSDSCPGLSNGEEVGLEKPSLEPQKSLGDEGLNRGPYVLGPADREDEEEDEEEEEQTDPKKPTTDEGTASSEVNATEEMSTLVNYIEPVKFKSFEAARKRNKCFEMSSFVETKAMEQLTKSPMEFVEYNKQQLSRIYPKGTRVDSSNYMPQLFWNVGCQLVALNFQTLDVAMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEALDYIPDDHQDYAEALINPIKHVSLMDQRARQLAALIGESEAQAGQETCQDTQSQQLGSQPSSNPTPSPLDASPRRPPGPTTSPASTSLSSPGQRDDLIASILSEVAPTPLDELRGHKALVKLRSRQERDLRELRKKHQRKAVTLTRRLLDGLAQAQAEGRCRLRPGALGGAADVEDTKEGEDEAKRYQEFQNRQVQSLLELREAQVDAEAQRRLEHLRQALQRLREVVLDANTTQFKRLKEMNEREKKELQKILDRKRHNSISEAKMRDKHKKEAELTEINRRHITESVNSIRRLEEAQKQRHDRLVAGQQQVLQQLAEEEPKLLAQLAQECQEQRARLPQEIRRSLLGEMPEGLGDGPLVACASNGHAPGSSGHLSGADSESQEENTQL

SEQ ID NO: 20788 - protein, 494 aa, Suaeda japonica
MAASGMELMQERDVFKKYWVEHTVDLTIEAMMLDSQASDLDKEERPEILSMLPPLEGKCLLELGAGIGRFTGELAEKAGQVIALDFIESAIKKNEVINGHYKNVKFMCADVTSPTLSFPPHSLDVIFSNWLLMYLSDEEVENLVERMLKWLKPGGYIFFRESCFHQSGDHKRKSNPTHYREPRFYTKAFKECHLQDGSGNSYELSLLSCKCIGAYVRNKKNQNQISWLWQKVDSKDDKGFQRFLDTSQYKCNSILRYERVFGPGYVSTGGYETTKEFVSMLDLKPGQKVLDVGCGIGGGDFYMAETFDVEVVGFDLSVNMISFALERSIGLKCAVEFEVADCTKINYPDNSFDVIYSRDTILHIQDKPALFRSFYKWLKPGGKVLISDYCKKAGPPSPEFAAYIKQRGYDLHDVKEYGQMLKDAGFVDVLAEDRTEQFIRVLRKELETVEKEKDVFISDFSEEDYNDIVGGWNDKLRRTAKGEQRWGLFVAKKK

SEQ ID NO: 20789 - protein, 713 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETQKTLYLIMEYASGGKVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSEVRPSSDLNNSTGQSPHHKVQRSVSSSQKQRRYSDHAGPGIPSVVAYPKRSQTSTADSDLKEDGISSRKSTGSAVGGKGIAPASPMLGNASNPNKADIPERKKSSTVPSSNTASGGMTRRNTYVCSERTTDDRHSVIQNGKENSTIPDQRTPVASTHSISSAATPDRIRFPRGTASRSTFHGQPRERRTATYNGPPASPSLSHEATPLSQTRSRGSTTLFSKLTSKLTRSRNVSAKQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 20790 - protein, 280 aa, Homo sapiens
MEDEVVRFAKKMDKMVQKKNASTRIGMSVNAIRKQSTDEEVTSLAKSLIKSWKKLLDGPSTEKDLDEKKKEPAITSQNSPEAREESTSSGNVSNRKDETNARDTYVSSFPRAPSTSDSVRLKCREMLAAALRTGDDYIAIGADEEELGSQIEEAIYQEIRNTDMKYKNRVRSRISNLKDAKNPNLRKNVLCGNIPPDLFARMTAEEMASDELKEMRKNLTKEAIREHQMAKTGGTQTDLFTCGKCKKKNCTYTQVQTRSADEPMTTFVVCNECGNRWKFC

SEQ ID NO: 20791 - protein, 293 aa, Beta vulgaris
MPGGEVSAPSSVVLPTAESIENDEAWVWGQIKAEARRDADSEPALASYLYSTILSHSSLERSLSFHLGNKLCSSTLLSTLLYDLFLNIFSSDSSLRVAVVADLRAARVRDPACVSFSHCLLNYKGFLACQAHRVAHRLWNQERQPLALALHSRISDVFAVDIHPAARIGKAILFDHATGVVIGETAVIGDNCSILHHVTLGGTGKAVGDRHPKVGDGVLIGAGATILGNIKIGDGAKIGAGSVVLIDVPPRATAVGNPARLLGGKEKPSRNVDVPGESMDHTSFISEWSDYII

SEQ ID NO: 20792 - protein, 360 aa, Bos taurus
MAAAAAAGAGPEMVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINLKARNYLLSLPHKNKVPWNRLFPNADSKALDLLDKMLTFNPHKRIEVEQALAHPYLEQYYDPSDEPVAEAPFKFDMELDDLPKEKLKELIFEETARFQPGYRS

SEQ ID NO: 20793 - protein, 375 aa, Danio rerio
MAATEQRPPVREGMRIAVLCLCWYTVSSGGNVINKIILNSFPYPVTVSLFHIVSIIVFLPPLLRAWGVPRTELPARYYRWYILPLAFGKYFASVSAHFSIWKVPVSYAHTVKATMPIWVVLLSRIIMKEKQTTKVYVSLIPIIGGVLLATVTELSFDMSGLISALAATLCFSLQNIFSKKVLRDTRIHHLHLLNILGFNALLFMLPTWILVDLSSFLMDGDLSEVSSWTGTLMLLLISGFCNFAQNMIAFSVLNLVSPLSYAVANATKRIMVISISLLMLRNPVNTSNIIGMMTAILGVFLYNKAKYDSNQEAKKGLLPVSAQDVVSFDKPQSNGTGAFTHSSDFQHGRSTVLTDHFQYSRQAYTANYSSSQYVV

SEQ ID NO: 20794 - protein, 525 aa, Babesia rodhaini
MGNACTKGKTSSTSYQRKDTGSTDCGEVPAKPENQMIINPGMYIDKKIATLSDKYHRVSVIGSGAYGQVLLCREKSTGTERAVKVIRKTANCDQDSEKLLDEVEMLKSLDHPNIAKLYEFFEDSRKYYLVMDLYTGGELFDEIIRRQKFSERDAAMVMRQILSGVLYLHSNNIVHRDLKPENLLLESKAPDAAIKIVDFGLSTNFNGSRMRERLGTPYYIAPEVLKKCYNEKCDIWSCGVILYILLCGYPPFGGQTDEEILIKVEKGKCTFDMNDWCNISTEVRSLVKAMLTCDPDKRISARAALTHPWFSMFANDKPQCLTSDLSLALNNMKKFQASQKLAAAALYYIGTKLATVEETNKLTKIFNQLDIDGDGRLDKEELIKGYHLLKDDSEMNRDSIASEVDALLAEVDLDNNGYMDYSEFVIACMDKSMFLSRDRIQMAFDHFDTDKSGKISKGELAKLFGISNVDDSTWNEIINGVDENNDGEVDFEEFEKMIHRICEITSASTITKMQTYNHLNFISLR

SEQ ID NO: 20795 - protein, 212 aa, Ovis aries
MDDREDLVYQAKLAEQAERYDEMVESMKKVAGMDVELTVEERNLLSVAYKNVIGARRASWRIISSIEQKEENKGGEDKLKMIREYRQMVETELKLICCDILDVLDKHLIPAANTGESKVFYYKMKGDYHRYLAEFATGNDRKEAAENSLVAYPTHPIRLGLALNFSVFYYEIDSTLIMQLLRDNLTLWTSDMQGDGEEQNKEALQDVEDENQ

SEQ ID NO: 20796 - protein, 201 aa, Mucor racemosus
TILKQDEGWIHDGGFTPEEKEAYKEIIFSNSVQSIHVLLEAMEILDIPLDDASNQGYFDYIMEQYQKMDYFSMPPELVKAIKQLWQDKGVQEAHSRRNEFQLNDSASYYFDSIDRIGDPNYLPTDQDVLRSRVKTTGIAESKFTFGTLTYRMFDVGGQRSERKKWIHCFEDVTAIIFLVAISEYDQVLIEDESVNRMQEAF

SEQ ID NO: 20797 - protein, 205 aa, Mucor racemosus
TILKQMKLIHDGGYSRDEREAFKEIIFSNTVQSMRVILEAMENMGVSYASSQNRLHSTVILDLPSQIERDSLPPEVTLALKSLWKDENLLSVFDRSREYQLNDSAKYYFDSIDRIGDINYIPTDQDVLRSRVKTTGITETTFVIGDLTYRMFDVGGQRSERKKWIHCFENVTAIIFLVAISEYDQVLIEDETVVNMHMQKRDDHR

SEQ ID NO: 20798 - protein, 191 aa, Mucor racemosus
TILKQMKLIHDGGYTRNERESFKEVIFSNTMQSMRVTLEAMNNLGIAFDNPENEGHKRLVLEAPPQIDYLGHELVEAIASLWDDQGVQECVQRSNEFQLNDSARYYFDSILRIGQSNYMPSDQDVLRSRVKSTGITETTFVIDSLTYRMFDVGGQRSERKKWIHCFENVTALVFLVAISEYDQVLFEDESV

SEQ ID NO: 20799 - protein, 500 aa, Rickettsia montanensis
MSTSKSENYLSELRKVIWPIERYENKKFLPMAFMMFCILLNYSTLRSIKDGFVVTDIGAEAISFLKTYIVLPSAVIAMVIYVKLCDILKQENVFYVITSFFLGYFALFAFVLYPYPDLVHPDPETIESWSFAYPNFKWFIRIVGKWSFASFYTMAELWGTMMLSLLFWQFANQITKTDEAKRFYSMFGLLANLALPVTSVIIGYCLHEKTQIVAEHLKFVPLFVIMITSSFLVILTYRWMNKNVLTDPRLYDPALVKEKKAKAKAKMSLIDSFKMIFTSKYVGYIALLLIAYGVSVNLVEGVWKSKVKELYPTKEAYTIYMGKFQFYQGWVAIAFMLIGSNILRKVSWLTAAMITPLMMLITGAAFFAFIFFDSVIAMHLTGILASGPLALAVMIGMIQNVLSKGVKYSLFDATKNMAYIPLDKDLRAKGQAAVEVIGGRFGKSGGAIIQSTFFILFPAFGFVEATPYFASIFFVIVILWIYAVKGLNKEYKVLVNKNEK

SEQ ID NO: 20800 - protein, 498 aa, Rickettsia rickettsii
MNTPKNDNYLSELSKVIWPIERYENKKFLPMAFMMFCILLNYSTLRSIKDGFVVTDIGAEAISFLKTYIVLPSAVIAMVIYVKLCDILKQENVFYVITSFFLGYFALFAFVLYPYPDLVHPDPETIESWSVVYPNFKWFIRIVGKWSFASFYTMAELWGTMMLSLLFWQFANQITKTDEAKRFYSMFGLLANLALPVTSVIIGYCLHEKTQIVAEHLKFVPLFVIMITSSFLVILTYRWMNKNVLTDPRLYDPALVKEKKAKAKMSLIDSFKMIFTSKYVGYIALLLIAYGVSVNLVEGVWKSKVKELYPTKEAYTIYMGKFQFYQGWVAIAFMLIGSNILRKVSWLTAAMITPLMMLITGAAFFAFIFFDSVIAMHLTGILASGPLALAVMIGMIQNVLSKGVKYSLFDATKNMAYIPLDKDLRVKGQAAVEVIGGRFGKSGGAIIQSTFFILFPAFGFVEATPYFASIFFVIVILWIYAVKGLNKEYKVLVNKTEK

SEQ ID NO: 20801 - protein, 498 aa, Rickettsia typhi
MSTSKSENYLSELRKIIWPIDQHENKKFLPLAFMMFCILLNYSTLRSIKDGFVVTDIGTESISFLKTYIVLPSAVIAMVIYVKLCDILKQENIFYVITSFFLGYFALFAFVLYPYPDLVHPDHKTIESLSLAYPNFKWFIKIVGKWSFASFYTIAELWGTMMLSLLFWQFANQITKITEAKRFYSMFGLLANLALPVTSVVIGYFLHEKTQIVSEHLKFIPLFVIMITSSFLIILTYRWMNKNVLTDPRLYDPTLVKEKKAKAKLSFIESFKMIFTSKYVGYIALLIIAYGVSVNLVEGVWKSKVKELYPTKEAYTIYMGQFQFYQGWVAIAFMLIGSNILRKVSWLTAAMITPLMMFITGAAFFSFIFFDSVIAMNLTGILASSPLTLAVMFGMIQNVLSKGVKYSLFDATKNMAYIPLDKDLRVKGQAAVEVIGGRLGKSGGAIIQSTFFILFPAFGFIEATPYFASIFFIIVILWIFAVKGLNKEYQVLVNKNEK

SEQ ID NO: 20802 - protein, 507 aa, Rickettsia montanensis
MDSVDSHFAIWNKARNSKFRHIVWPIRSYELTKFIPMALLMFFILLNQNLVRSIKDSFVVTLISSEVLSFIKLWGEMPMGILFVIFYSKLCNIMTTEQVFRIITGTFLFFFAIFGFILFPYREFFHPDPELIKYYITVLPHLKWFLIIWGQWSLVLFYIMGELWPVIVFTLLYWQLANKITKVEEAPRFYSFFTLFGQTNLLISGTVIIYFAKSEHFLLPLFSHLNDTNEILLKSFITVILISGLICLALHKLIDKSVVEADKNIKFKNQRTDILKLSLIESAKVIFTSRYLGFICLLVMSYSMSISLIEGLWMSKVKQLYPTTKDFIAYHGKVFFWTGILTLVSAFLGSSLIRICGWFWGAIITPIMMFGAGVMFFSFTVFENHLGNIVNTLGYSTPLVVIVFIGGLWHVLSKSVKYSLFDATKEMVYIPLDSEMKTKGKAAVDVMGAKIGKSIGAIIQFISFSIFPNAVHNDIAGLLMFSFIIVCLLWLYGVKVLSKYYNKMIKR

SEQ ID NO: 20803 - protein, 507 aa, Rickettsia rickettsii
MKIVDSNCTIWNKARNSKFRDIVWPIRSYELTKFIPMALLMFFILLNQNLVRSIKDSFVVTLISSEVLSFIKLWGEMPMGILFVIFYSKLCNIMTTEQVFRIITSTFLFFFTIFGFILFPYRDFFHPDPELIKHYITVLPHLKWFLIIWGQWSLVLFYIMGELWPVIVFTLLYWQLANKITKVEEAPRFYSFFTLFGQTNLLISGTVIIYFAKSEHFLLPLFSHLNDTNEILLKSFITVILISGLICLALHKLIDKSVVEADKNIKFKNQRTDILKLSLVDSAKIILTSRYLGFICLLVMSYSMSISLIEGLWMSKVKQLYPATKDFIAYHGKVFFWTGILTLVSAFLGSSLIRICGWFWGAIITPIMMFGAGVMFFSFTVFENHLGNIVNTLGYSAPLVVIVFIGGLWHVLSKSVKYSLFDATKEMVYIPLDSEMKTKGKAAVDVMGAKIGKSIGAIIQFISFSIFPNAIHNDIAGLLMFSFIIVCLLWLYGVKVLSKYYNKMIKR

SEQ ID NO: 20804 - protein, 507 aa, Rickettsia typhi
MNIVDSNCTIWHKARNSKFRHIVWPIRSYELTKFIPMALLMFFILLNQNLVRSLKDSFVVTLISSEVLSFIKLWGEMPMGVLFVILYSKLCNIMTTEQVFRIITGTFLFFFTIFGFILFPYKEFFHPDPELINQYITVLPHLKWFLIIWGQWSLVLFYIMGELWPVIVFTLLYWQLANKITKVEEAPRFYSFFTLFGQTNLLFSGTVIIYFAKSEHFLLPLFAHLNDTNEILLKSFITVILLSGLICLALHKLIDKSVVEADKNIKFKNQRTDILKLSLIESAKIILTSRYLGFICLLVMSYSMSINLIEGLWMSKVKQLYPATKDFISYHGEVLFWTGVLTLVSAFLGSSLIRIYGWFWGAIITPIMMFVAGVIFFSFTIFENHLGNIVNTLGYSSPLVIIVFIGGLWHVFSKSVKYSLFDATKEMVYIPLDNEIKTKGKAAVDVIGAKIGKSIGAGIQFISFSIFPNAVHNDIAGLLMFTFIIGCILWIYGVKVLSQYNNKMIQN

SEQ ID NO: 20805 - protein, 501 aa, Rickettsia montanensis
MLPPKIFFKKIKEIMWPIERKELKLFIPMALMMLCILFNFGALRSIKDSLVVPSMGAEIISFLKLWLVLPSCVIFTVLYVKLSNKLNFEYIFYIIVGSFLLFFLLFAYIIYPNQDIYHPNDKMINNLIASYPNFKWFIKIGSQWSYALMYIFAELWSAVVINLMFWQFANHIFDTSKAKRFYPVLGMVGNIGLIIAGSVLVFFSSGQDVIDSELLPDSFNSSAGNAIMLQPIMSIIVTAGIIAMLLFRIINRFILTDSINVLDAKKVTVKMKTKLSVIESIKLVIHSKYIGRIALLIICYGLLINIVEGPWKAKIKELHPNTIDYVNFMGRFNIWMGISCVTFMIIGSNILRRLGWLISALLTPIMLSITGLMFFIFIIFIEEIGACFCDFNLLYAAIIVGAIQNILSKSSKYSLFDSTKEMAYIPLSLELRTKGKAAVEVIGTKFGKSLGAFIQSLIFIIIPKTTFDSIIIYLLVTFIVMMSLWIWNVIKLNKEYIKLCQ

SEQ ID NO: 20806 - protein, 501 aa, Rickettsia rickettsii
MLPPKIFFEKVKEIIWPIERKELKLFIPMALMMLCILFNFGALRSIKDSLVVPSMGAEIISFLKLWLVLPSCVIFTVLYVKLSNNLNFEYIFYIIVGSFLLFFLLFAYIIYPNQDIYHPNDEMINKLIASYPHFKWFIKIGSQWSYALMYIFAELWSAVVINLMFWQFANHIFDTSKAKRFYPVLGMVGNIGLIIAGSVLVFFSSGQDVIDSELLPDAFNLSVGNAIMLKPIMSIIVTAGIIAMLLFRIINRFILTDSINVLDAKKVTAKMKTKLSVIESIKLVMHSKYIGRIALLIICYGLLINIVEGPWKAKIKELHPNTIEYVNFMGRFNIWMGISCVTFMIIGSNILRRLGWFISALLTPIMLSITGLMFFIFIIFIEEIGECFGDFNLLYAAIIVGAIQNILSKSSKYSLFDSTKEMAYIPLSLELRTKGKAAVEVIGTKFGKSLGAFIQSLIFIIIPTATFDSIIIYLLVTFIVMMSLWIWNVIKLNKEYIKLCQ

SEQ ID NO: 20807 - protein, 501 aa, Rickettsia typhi
MLPPKIFFEKFKEIIWPIERKELKLFIPMALMMLCILFNFGALRSIKDSLVVPSMGAEIISFLKLWLVLPSCVIFTVLYVKLSNKLNFEYIFYSIVGTFLLFFLLFAYIIYPNQDIYHPNDAMINNLIASYPNLKWFIKIGSKWSYALMYIFSELWSAVVINLMFWQFANHIFDTAKAKRFYPVLGMIGNIGLIIAGSVLVFFSSGQYIIDSELLTDSFNSSSCNSIILQPIISIIVTAGIIAMFLFRIINRFILTNAINVLDVKKAAARTKTKLALIESIKLIIHSKYIGRIALLIICYGLLINIVEGPWKAKIKELHPNTIDYVNFMGMFNIWMGISCVTFMIIGSNILRRLGWLISALLTPIMLSITGFIFFIFIIFIEEIGTCFGDFNLLYVAIIVGAIQNILSKSSKYSLFDSTKEMAYIPLSLELRTKGKAAVEVIGTKFGKSLGAFIQSLIFIIIPTATFDSIIIYLLVIFIVMMNLWIWNIIKLNKEYIKLCQ

SEQ ID NO: 20808 - protein, 512 aa, Rickettsia montanensis
MTINASNIENSSSKINSYFSKLTDYIWPIKRHEVSKFLFITLLMFCILFIQNLIRALKDSIVTTMIGAETISFLKFWGVMPSAFLMTAIYVKLVNKMKAENIFYLIISIFLTFFALFAYVIFPNHEMLHLSPVTVQNLTASLPNLKWFILLLSKWSFSLFYIIAELWPNVVFALLFWQFGNNITTVEESKRFYPLFGLLSQTGIYLAGQFLENLSNINDYVTNKFALQSSFHTLSIQIILTIVLILGIIAIKTFWLLNHKVLGKEHMALLRFKAKKKSMTIAESFQMLLSSRHIRLIATLLICYGIAINLVEGPWKAAATKIYKTPTEYAAFIGSYLSYTGVFTILFVVLGSNIVRRLGWFTAAVITPLIVFITGILFFAVNNFERFAGLIIANFILTDPALIAITIGAIQNVLSKSSKYTLFDSTKEMAYVPLDPEIKIKGKAAARVIGTKLGKSGSAFLQSLVFIILPSTSYQSISICLMIIFIITCLTWLWATKALNKEYKNSIKFSQK

SEQ ID NO: 20809 - protein, 512 aa, Rickettsia rickettsii
MTINASNIENSSSKINSYFSKLTDYIWPIKRHEVSKFLFITLLMFCILFIQNLIRALKDSIVTTMIGAEIISFLKFWGVMPSAFLITAIYVKLVNKMKAENIFYLIISIFLTFFALFAYVIFPNHEMLHFSPATVQNLTASLPNLKWFILLLSKWSFSLFYIIAELWPNVVFALLFWQFVNNITTVEESKRFYPLFGLLSQTGIYLAGQFLENLSNINDYVTNKFALQSSFHTLSIQIILTIVLILGIIAIKTFWLLNHKVLDKEHMALLRFKAKKKSMTIAESFQMLLSSRHIRLIATLLICYGIAINLVEGPWKAAATKIYKTPTEYAAFIGSYLSYTGVFTILFVVLGSNIVRRLGWFTAAVITPLIVFITGILFFAVNNFERFAGLIIVNFILTDPALIAITIGAIQNVLSKSSKYTLFDSTKEMAYVPLDPEIKIKGKAAADVIGTKLGKSGSAFLQSLVFIILPSASYQSISICLMIIFIITCLTWLWATKALNKEYKNSIKFSQK

SEQ ID NO: 20810 - protein, 512 aa, Rickettsia typhi
MTINASNIENSFSKINSHFSKLTDYIWPIKRNEISKFLFITLLMFCILFIQNLIRALKDSIVTTMIGAETISFLKFWGVMPSAFLITVMYVKLVNRMKAENIFYLIISIFLIFFALFAYVIFPNHEILHLRPVTVHNLTTSLPNLKWFILLLSKWSFSLFYIIAELWPNVVFALLFWQFVNNITTVEESKRFYPLFGLLSQTGIYLAGHFLENLSKINYYITDKFALQSSFHTLSIQIILTIVLILGIVSIKTFWLLNHKVLDKKHMSLLRFKTKNKSITIAKSFQMILSSRHIRLIATLLICYGIAINLVEGPWKAAATKIYKTPTEYAAFIGSYLSYTGVFTIFFVLLGSNIVRRIGWFTSAVITPSIVFITGILFFAFNNFEGFAGLIIANFILTDPALVAITIGAIQNVLSKSSKYTLFDSTKEMAYVPLEPEIKISGKAAADVIGTKLGKSGSAFLQSLIFIILPSSSYQSISICLMIIFILTCLTWIWATKELNKEYKNSIKFSQK

SEQ ID NO: 20811 - protein, 500 aa, Rickettsia typhi
MKSTSPSRSFKTKFRAAFWPVHNYELGKFIPISALMFCILFNQNILRILKDSILISEISAEIAGFAKVYCVTPVAALFVIIYAKMINHLTFEKIFYYLSAFFISCFILFAFVIYPNIHIFHVHPDTLSDWMNKYPHFKWYISLVGNWGYIVYYSLAELWPNIFYVLLFWQFTNELTTTEEAKRFYTLFSLFGNSSLILVGFLMMNLSSEDTIIKKFVSISDSKITLVQVSTTIVAIVAIICCLLVRFISKYIFTNPLFYAKIKKSRSTTQRMGLIKSFKYIAKSKYLWLLLICSAAFGFAINLVEAVWKAKIKELYPTVNTYAEFNSLYILWTGVAIIVMTIIGNNVMRMHNWFVAAVISPVIIMVTGILFFVLIVFDQQILSLFDGAILMSPLALAVSIGGIQNILAKGTKYSIWDTSREMLYIPLDDELKTKGKAAVDVISAKIGKSSSGLVQSIIFTLVPNATFTSISPILMVVFTFVCFAWIYAVRKIYFEYQKIA

SEQ ID NO: 20812 - protein, 499 aa, Rickettsia rickettsii
MLRTSSRSFKNKFRAAFWPVHNYELGKFIPMSTLMFCILFNQNVLRILKDSILISEISAEIAGFAKVYCVTPAAALFVIIYAKMINYLTFEKIFYYLSAFFISFFVLFTFVIYPNIHIFHVHPDNLADWMERYPHFKWYISLVGNWGYIVYYSLAELWPNIFYVLLFWQFANELTTTEEAKRFYTLFSLFGNSSLILVGFLMMNLSSEDTIIKKFMSISDSKITLVQVSTTIVAIVAIICCLLVRFISKNVFTNPLFYAKAKSGRSTSERMGLIKSFKYIAKSKYLWLLLICSAAFGFAINLVEAVWKAKIKELYPTVNTYAEFNSLYILWTGVAIMVMTIIGNNIMRMHNWFVAAVISPVIIMVTGILFFVLIVFDQQILSLFDGAILMSPLALAVSIGGIQNILAKGTKYSIWDTSREMLYIPLDEELKTKGKAAVDVISAKVGKSSSGLVQSIIFTLVPTATFTLISPILMLVFTFVCLAWIYAVRKIYFEYQKIA

SEQ ID NO: 20813 - protein, 498 aa, Rickettsia montanensis
MLSTSPSFKNKFRAALWPVHNYELGKFIPMSTLMFCILFNQNVLRILKDSILISEISAEIAGFAKVYCVTPAAALFVVIYATMINYLTFEKIFYYLSAFFISCFVLFTFVIYPNIHIFHVHPDNLADWMKRYPHFKWYISLVGNWGYIVYYSLAELWPNIFYVLLFWQFANELTTTEEAKRFYTLFSLFGNSSLILVGFLMMNLSSEDTIIKKFMSISDSKITLVQVSTTIVAIVAIICCLLVRFISKNVFTNPLFYAKAKSGRSTSERMGLIKSFKYIAKSKYLWLLLICSAAFGFAINLVEAVWKAKIKELYPTVNTYAEFNSLYILWTGVAIMVMTIIGNNVMRMHNWFVAAVISPVIIMVTGILFFVLIVFDQQILSLFDGAILMSPLALAVSIGGIQNILAKGTKYSIWDTSREMLYIPLDEELKTKGKAAVDVISAKVGKSSSGLVQSIIFTLVPTATFTSISPILMMVFTFVCLAWIYAVRKIYFEYQKIA

SEQ ID NO: 20814 - protein, 531 aa, Emericella nidulans
MAFKKSYNVYFLCGFMTLGGGLFGFDISSMSGVLGTAAYNNYFQVGGGNYKQGGITCAMPFGSLVGALASSFLADKYSRVTAIQFSSTLWIIGSVFQCAANGIPLLVVGRVIAGLCVGIASAMVPVYIAEVSPKHIRGRMISLQQWAITWGILIQYFIQYGASNVDGGPDNETQSTAAFRIPWGIQIVPGVIYFVGLFLYPKSPRWLASKDRWDECMHVLARLHGNGDMNHPLVLAQYKEIQDALALEREQASTSYQELIKPRIAKRVFLGMSLQMWSQLSGMNVMMYYIVYIMQSTGAGSPLLTASIQYILNTALTLPAILWLDRFGRRPAILIGFTMQAIFLYIEGGLQAGYGRSTRPSDDLNAISWTVADHPGVGKAIIAMSYLFVCSFATTIGPTSWTYPAEIYPAKVRAKAVSLATASNWTWNCLLALFVPPLLWNINWKMYMIFAAFNTVAALHMFLTAPETKGYTLEEMDEVFESGIAPWKKRKISSRLEQIEREIAEGNLKVTDRTGPVDPVQENVGEPEKAV

SEQ ID NO: 20815 - protein, 268 aa, Mus musculus
MKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEE

SEQ ID NO: 20816 - protein, 397 aa, Mus musculus
  unsure (1)..(397): unsure at all Xaa locations
MSTILSPRASLTTSMAARESLIDGIKRATDVMIAGKVGGWWQAMVDVGKGCAQALRGFWGPESSSFEIDPINALQAAMEGYEVTTMDEACKEGNIFVTTTGCVDIILGRHFEQMKDDAIVCNIGHFDVEIDVKWLNENAVEKVNIKPQVGRYWLKNGRRIILLAEGRLVNLGCAMGHPSFVMSNSFTNQVMAQIELWTHPDKYPVGVHFLPKKLDEAVAEAHLGKLNVKLTKLTEKQAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIHWFLSPGPKNELHQRAGTPGV

SEQ ID NO: 20817 - protein, 260 aa, Mus musculus
MRISLRALPELTQSMKMLMNNSDKLFTALSVNLSDVSGPVPSAAIVYTDVNKHKPREYWDYESQVVEWGNQDDYQLVRKLGRGKYKFKQLYQTLTDYDIRFYMYDILKALDYCHSMGIMHRDVKPHNGTIDHEHRKLRLIDWGLAEFYHPGQESHFFHGHDNYDQLVRRAKVLGTEDLYDYIDKYNIELDPHFNDILGRHSGKRWERFVHSENQHLVSPEALDFLDKLLLYDQQSRLTAREAMEHPYFTVVKDHGSNEFH

SEQ ID NO: 20818 - protein, 681 aa, Mus musculus
MFPLHLAALSGFSDCCRKLLSSGFDIDTPDDFGRTCLHAAAAGGNLECLNLLLNTGADFNKKDKFGRSPLHYAAANCNYQCLFALVGSGASVNDLDERGCTPLHYAATSDTDGKCLEYLLRNDANPGIRDKQGYNAVHYSAAYGHRLCLQLIASETPLDVLMETSGTDMLSDSDNRATISPLHLAAYHGHHQALEVLVQSLLDLDVRNSSGRTPLDLAAFKGHVECVDVLINQGASILVKDYVLKRTPIHAAATNGHSECLRLLIGNAEPQNAVDIQDGNGQTPLMLSVLNGHTDCVYSLLNKGANVDAKDKWGRTALHRGAVTGHEECVDALLQHGAKCLLRDSRGRTPIHLSAACGHIGVLGALLQSATSVDANPAVVDNHGYTALHWACYNGHETCVELLLEQDVFQKIDGNAFSPLHCAVINDNEGAAEMLIDSLGASIVNATDSKGRTPLHAAAFTDHVECLQLLLSQNAQVNSADSTGKTPLMMAAENGQTNTVEMLVSSASADLTLQDKSKNTALHLACGKGHETSALLILEKITDRNLINATNAALQTPLHVAARNGLTMVVQELLGKGASVLAVDENGYTPALACAPNKDVADCLALILATMMPVSSSSPLTSLTFNAINRYTNTSKTVSFEALPIMRNEASSYCSFNNIGGEQEYLYTDVDELNDSDSETY

SEQ ID NO: 20819 - protein, 814 aa, Mus musculus
MGPRGTAHSVRAPLSWLLLLLLSLQVAVPAGALAETLLDAPRARGASSNPPSPASVVAPGTTPFEESRLPVFTLDYPHVQIPFEITLWILLASLAKIGFHLYHKLPTIVPESCLLIMVGLLLGGIIFGVDEKSPPAMKTDVFFLYLLPPIVLDAGYFMPTRPFFENFGTIFWYAVVGTLWNSIGIGVSLFGICQIEAFGLSDITLLQNLLFGSLISAVDPVAVLAVFENIHVNEQLYILVFGESLLNDAVTVVLYNLFKSFCQMKTIQTVDVFAGIANFFVVGIGGVLIGILLGFIAAFTTRFTHNIRVIEPLFVFLYSYLSYITAEMFHLSGIMAITACAMTMNKYVEENVSQKSYTTIKYFMKMLSSVSETLIFIFMGVSTVGKNHEWNWAFVCFTLAFCLIWRALGVFVLTQVINWFRTIPLTFKDQFIIAYGGLRGAICFALVFLLPATVFPRKKLFITAAIVVIFFTVFILGITIRPLVEFLDVKRSNKKQQAVSEEIHCRFFDHVKTGIEDVCGHWGHNFWRDKFKKFDDKYLRKLLIRENQPKSSIVSLYKKLEIKHAIEMAETGMISTVPSFASLNDCREEKIRKLTPGEMDEIREILSRNLYQIRQRTLSYNRHNLTADTSERQAKEILIRRRHSLRESLRKDNSSNRERRASTSTSRYLSLPKNTKLPEKLQKKKKVSNADGNSSDSDPDVGTTVLNLQPRTRRFLPDQFSKKASQAYKMEWKNEVDVGSVRVPPSVSPAPRSKDGGTQTPGLLRQPLLSKDQRFGRGREDSLTEDVPPKPPPRLVRRASEPGNRKGRLGNEKP

SEQ ID NO: 20820 - protein, 330 aa, Mus musculus
MDRNKMILGNAHDNSEELERAREVKEKDAALCLEFLLQNDANPSIRDKEGYNSIHYAAAYGHRQCLELLLERTNTGFEESDGGALKSPLHLAAYNGHHQALEVLLQSLVDLDIRDEKGRTALYLAAFKGHTECVEALVNQGASIFVKDNVTKRTPLHASVINGHTLCLRLLLETADNPEVVDVKDAKGQTPLMLAVAYGHIDAVSLLLEKEANVDAVDIVGCTALHRGIMTGHEECVQMLLEQEASILCKDSRGRTPLHYAAARGHATWLNELLQIALSEEDCCLKDNQGYTPLHWACYNGNENCIEVLLEQKCFRKFIGNPFTPLHCAM

SEQ ID NO: 20821 - protein, 495 aa, Mus musculus
MLCAENRKEMEVWISSLKSVQSREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDVYHPVCPLGQCKVSIIPPIALNSTDSDGFCRATFSFCVSPLLVFVNSKSGDNQGVKFLRRFKQLLNPAQVFDLMNGGPYLGLRLFQKFDNFRILVCGGDGSVGWVLSEIDKLNLHKQCQLGVLPLGTGNDLARVLGWGGSYDDDTQLPQILEKLERASTKMLDRWSIMTYELKLPAKSSLLPEPVAATEEFYMTIYEDSVANHLTKIVNSDEHAVVISSAKILCETVKDFVAKVEKAQDRTLENTVVAEAVASKCSVLNEKLEQLLQALHADSQASRVPPGIGPAIPEEDTVESASDESLGESKDQLVNDIGKPSSQKAVKPREIMLRANSLKKAVSYG

SEQ ID NO: 20822 - protein, 406 aa, Mus musculus
MTLDVGPEDELPDWAAAKEFYQKYDPKDIIGRGVSSVVRRCVHRATGDEFAVKIMEVSAERLSLEQLEEVRDATRREMHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEAGEKLRELCGTPGYLAPEILKCSMDETHPGYGKEVDLWACGVILFTLLAGSPPFWHRRQILMLRMIMEGQYQFTSPEWDDRSNTVKDLISKLLQVDPEARLTAEQALQHPFFERCEGSQPWNLTPRQRFRVAVWTILAAGRVALSSHRLRPLTKNALLRDPYALRPVRRLIDNCAFRLYGHWVKKGEQQNRAALFQHQPPRLFPIAATELEGDSGAITEDEATLVRS

SEQ ID NO: 20823 - protein, 653 aa, Mus musculus
MTSTGKDGGGAQHAQYVGPYRLEKTLGKGQTGLVKLGIHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDERNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSHEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRTRLNSIKNSFLGSPRFHRRKLQVPTPEEMSNLTPESSPELAKKSWFGNFINLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDQPSAQHLSGIIPKS

SEQ ID NO: 20824 - protein, 224 aa, Mus musculus
MYFAPSMKDFTQYIFTEKLKQDRGSDASWKNDQEPPPEVLDFSDDEKEKEAKQRKKSQIQGRKKLKSELNESGEDFGEVHENWNAYSSSEHSKGYHHREFSRGFARGRYSRRSHGRPPPQQYYNSDHMASQESLGFTPQRQDNPVMPHYPFPPPMFDMHNFPLPPPPPPPPPPPPSMGWAAPSMASHPVLNLPYSMPPPPLPPPPPPPPPSPGENNSSHFGPYF

SEQ ID NO: 20825 - protein, 153 aa, Mus musculus
MSSEEGKLFVGGLNFNTHEQALENYFSSFGPISEVVVVKDRETQRSWGFGFITFTNPEHASDAMRAMNGESLDGRQIRVDHAGKSARGSRGGAFGGRGHSYSRGGRDQGYGSGRYDSQPGEYGYGYGWSRDYSGSQGGYDCYSGGNYRDNYDN

SEQ ID NO: 20826 - protein, 679 aa, Mus musculus
MSLLNPVLLPPNVKAYLSQGERFIKWDDETSIASPVILRVDPKGYYLYWTYQNQSQKLREVFNMDFPDNHFLLKTLTVVSGPDMVDLTFYNFVSYKENVGKDWAEDVLALAKHPMTVNAPRSTFLDKILVKLKMQLNPEGKIPVKNFFQMFPADRKRVEAALGACHLAKGKNDAINPEDFPESVYKSFLMSLCPRPEIDEIFTSYHSKAKPYMTKEHLTKFINQKQRDPRLNSLLFPPARPEQVQVLIDKYEPSGINVQRGQLSPEGMVWFLCGPENSVLAHDTLLIHQDMTQPLNHYFINSSHNTYLTAGQFSGLSSAEMYRQVLLSGCRCVELDCWKGKPPDEEPIITHGFTMTTDILFKEAIEAIAESAFKTSPYPVILSFENHVDSPRQQAKMAEYCRSMFGETLLTDPLENFPLKPGIPLPSPEDLRGKILIKNKKNQFSGPASPSKKPGGVAEGSLPSSVPVEEDTGWTAEDRTEVEEEEVVEEEEEEESGNLDEEEIKKMQSDEGTAGLEVTAYEEMSSLVNYIQPTKFISFEFSAQKNRSYVVSSFTELKAYELLSKASMQFVDYNKRQMSRVYPKGTRMDSSNYMPQMFWNAGCQMVALNFQTMDLPMQQNMALFEFNGQSGYLLKHEFMRRLDKQFNPFSVDRIDVVVATTLSITARPRADKWLGGLGS

SEQ ID NO: 20827 - protein, 1175 aa, Mus musculus
MAKPYEFNWQKEVPSFLQEGAVFDRYEEESFVFEPNCLFKVDEFGFFLTWKSEGKEGQVLECSLINSIRQAAIPKDPKILAALEAVGKSENDLEGRILCVCSGTDLVNIGFTYMVAENPEVTKQWVEGLRSIIHNFRANNVSPMTCLKKHWMKLAFLTNTTGKIPVRSITRTFASGKTEKVIFQALKELGLPSGKNDEIEPAAFTYEKFYELTQKICPRTDIEDLFKKINGDKTDYLTVDQLVSFLNEHQRDPRLNEILFPFYDAKRAMQIIEMYEPDEELKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRPLPSPNDLKRKILIKNKRLKPEVEKKQLEALKSMMEAGESAAPASILEDDNEEEIESADQEEEAHPEYKFGNELSADDYSHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANPAKANVTPQSSSELRPTTTAALGSGQEAKKGIELIPQVRIEDLKQMKAYLKHLKKQQKELNSLKKKHAKEHSTMQKLHCTQVDKIVAQYDKEKSTHEKILEKAMKKKGGSNCLEIKKETEIKIQTLTTDHKSKVKEIVAQHTKEWSEMINTHSAEEQEIRDLHLSQQCELLRKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 20828 - protein, 173 aa, Mus musculus
MKISRGTIEILSDVQLIMTGDKVGASEATLQNMRNISPSSFGLIIQQVFDNGSIYNPEVLDITEQSLHSRFLEGVRNVASVCLQIGYPTVASVPHSIINGYKRVLALSMETEYTFPLAEKVKAFLADPSAFAAAAPAAAATTAAPVAAAAPAKAEAKEESEESDEDMGLGLFD

SEQ ID NO: 20829 - protein, 846 aa, Mus musculus
MPNSRPRPRRGAGGGAGAAGRDRLVARSLQSAEHCLGDQDFGTAYAHYLLVLSLAPELKDDVKETFQYTLFKWAEELHALSRIQDLLGCYEQALELFPDDEVICNSMGEHLFRMGFRDEAAGYFHKAVKLNPDFNDAKENFYRVANWLVERWHFIMLNDTRRNMVYNAAIQKAVCLGSRTVLDIGTGTGILSMFAKKAGAQSVYACELSKTMYELACDVVAANKMENGIKLLHMKSLDIEIPKHIPERVSLVVTETVDAGVFGEGIVESLIHAWEHLLLQPKTKEENGNCGKYGKVIPAGAVIFGMAVECAEIRRHHRVGAKDIAGIHLPTNVKFQSPAYTSVDTEETVEPYTTEKMSGIPGGYLPLTECFQIMKVDFNNLQELKSLATKKPHSLNVPAIKEGVLDAIMVWFVLQLDDEYSLSTSPSEETCWEQAVYPVQALEDYCIQPGDRVTMEASCHDCYLRIQGISILHLEHEMEVMKGFTKSKDLLSLGNEAELCSALANLQTSRPEALEQTCMLEPTEIALLNNIPYHEGFKTAMRKVLSSLAPELLWQPMDTHCQYMEMNSGSGQSDAAPSTADPFYVLDVSEGFSLLPILAGTLGHVKPYSSVEKDQHCIALDLIAEANHFPKETLEFWLRHIEDEAAVLQRPKSDKLWSIIILDVIEPSGLIQQELMEKAAISRCLLQSGGKIFPQYVLMFGMLVESQTLVEESAVQGTEHTLGLNIAPFINQFQVPIRVCLDLSSLPCVPLSQPVELLRLDLMTPYLNTSNKEVKVRVCRSGRVTAVPFWFHLCLDDEVRLDTSGEASHWKQAAVVLDNPIQVQAGEELVLSVEHHKSNVSIAVKP

SEQ ID NO: 20830 - protein, 437 aa, Mus musculus
MTMSLIQACRSLALSTWLLSFCFVHLLCLDFTVAEKEEWYTAFVNITYLEPEPGAAVAGSGGGAELHTEKSECGRYGEHSPKQDARGEVVMASSAQDRLACDPNTKFAAPAHGKHWIALIPKGNCTYRDKIRNAFLQNASAVVIFNVGSNTNETITMPHAGVEDIVAIMIPEPKGKEIVSLLERNITVTMYITIGTRNLQKYVSRTSVVFVSISFIVLMIISLAWLVFYYIQRFRYANARDRNQRRLGDAAKKAISKLQVRTIRKGDKETESDFDNCAVCIEGYKPNDVVRILPCRHLFHKSCVDPWLLDHRTCPMCKMNILKALGIPPNADCMDDLPIDFEGSLGGPPTNQITGASDTTVNESSVTLDPAVRTVGALQVVQDPDPAPQEGEAIFTTNSGQEPALSSDSDISLIMALEVGLSDVELSTDQDCEEVKS

SEQ ID NO: 20831 - protein, 317 aa, Mus musculus
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISSGTIEILSDVQLIKTGDKVRASEATLLNMLNISPFSFGLIIQQVFDNGSIYNPEVLDITEQALHSRFLEGVRNVASVCLQIGYPTVASVPHSIINGYKRVLALSVETEYTFPLAEKVKAFLADPSAFAAAAPAAAATTAAPAAAAAPAKAEAKEESEESDEDMGFGLFD

SEQ ID NO: 20832 - protein, 931 aa, Mus musculus
MVMADGPRHLQRGPVRVGFYDIEGTLGKGNFAVVKLGRHRITKTEVAIKIIDKSQLDAVNLEKIYREVQIMKMLDHPHIIKLYQVMETKSMLYLVTEYAKNGEIFDYLANHGRLNESEARRKFWQILSAVDYCHGRKVVHRDLKAENLLLDNNMNIKIADFGFGNFFKTGELLATWCGSPPYAAPEVFEGQQYEGPQLDIWSMGVVLYVLVCGALPFDGPTLPILRQRVLEGRFRIPYFMSEDCEHLIRRMLVLDPSKRLSIAQIKEHKWMLIEVPVQRPILYPQEQENEPSIGEFNEQVLRLMHSLGIDQQKTVESLQNKSYNHFAAIYFLLVERLKSHRSSFPVEQRLDGRQRRPSTIAEQTVAKAQTVGLPVTLHPPNVRLMRSTLLPQASNVEAFSFPTSSCQAEAAFMEEECVDTPKVNGCLLDPVPPVLVRKGCQSLPSSMMETSIDEGLETEGEAEEDPSQAFEAFQATRSGQRRHTLSEVTNQLVVMPGAGKMFSMSDNPSLESVDSEYDMGSAQRDLNFLEDSPSLKDIMLANQPSPRMTSPFISLRPANPAMQALSSQKREAHNRSPVSFREGRRASDTSLTQGIVAFRQHLQNLARTKGILELNKVQLLYEQMGSNADPTLTSTAPQLQDLSSSCPQEEISQQQESVSSLSASMHPQLSPQQSLETQYLQHRLQKPNLLPKAQSPCPVYCKEPPRSLEQQLQEHRLQQKRLFLQKQSQLQAYFNQMQIAESSYPGPSQQLALPHQETPLTSQQPPSFSLTQALSPVLEPSSEQMQFSSFLSQYPEMQLQPLPSTPGPQAPPPLPSQLQQHQQPPPPPPPPPPQQPGAAPTSLQFSYQTCELPSTTSSVPNYPASCHYPVDGAQQSNLTGADCPRSSGLQDTASSYDPLALSELPGLFDCEMVEAVDPQHNGVVSCLARET

SEQ ID NO: 20833 - protein, 644 aa, Mus musculus
MAGQLRFTSGKDEDHFQHQGAVELLAFNFLLILTILTIWLFKNHRFRFLHETGGAMVYGLIMGLILRYATAPTDIDSGTVYNCGNLFFSPSTLLVNITDQVYEYKYQREINQHNISPHQGNAILEKMTFDPEIFFNVLLPPIIFHAGYSLKKRHFFQNLGSILTYAFLGTAISCVVIGLIMYGFVKAMVHAGQLKSGDFHFTDCLFFGSLMSATDPVTVLAIFHELHVDPDLYTLLFGESVLNDAVAIVLTYSISIYSPKENPNAFDTAAFFQSVGNFLGIFAGSFAMGSAYAVVTALLTKFTKLREFPMLETGLFFLLSWSAFLSAEAAGLTGIVAVLFCGVTQAHYTYNNLSSDSKLRTKQLFEFMNFLAENVIFCYMGLALFTFQNHIFNALFILGAFLAIFVARACNIYPLSFLLNLGRKQKIPWNFQHMMMFSGLRGAIAFALAIRNTESQPKQMMFTTTLLLVFFTVWVFGGGTTPMLTWLQIRVGVDLDESLKEEPSSQQEANKLDKNMTKTESAQLFRMWYGFDHKYLKPILTHSGPPLTTTLPAWCGPVSRLLTSPQAYGEQLKEDDVECIVNQDELAMNYQEQSPSPSSPTTKLALDQKSSGQTPGKENIYEGDLGLGGYDLKLEQTRGQPQMD

SEQ ID NO: 20834 - protein, 434 aa, Mus musculus
MALEENNGVPRLTLVEPLPSGSGMQEADYESQQAPGTLSLRTAPRNECWGSAAGAKMSLSKKRKLESGDSGGAGAGGEGAEEENGGEQEAAPPRPRRTKSERDQLYYECYSDVSVHEEMIADQVRTEAYRLGILKNWAALRGKTVLDVGAGTGILSIFCAQAGARRVYAVEASAIWQQAREVVRLNGLEDRVHVLPGPVETVELPERVDAIVSEWMGYGLLHESMLSSVLHARTKWLKEGGLLLPASAELFVAPISDQMLEWRLGFWSQVKQHYGVDMSCMESFATRCLMGHSEIVVQDLSGEDVLARPQRFAQLELARAGLEQELEAGVGGRFRCSCYGSAPLHGFAVWFQVTFPGGDSEKPLVLSTSPFHPATHWKQALLYLNEPVPVEQDTDISGEITLLPSPDNPRRLRILLRYKVGDHEEKTKDFAMED

SEQ ID NO: 20835 - protein, 283 aa, Tropheryma whipplei str. Twist
MVVFVLTYVPSVLLGDGVSIPQFGLGTYELPPNEASSVVQSAIELGYRHIDTASLYANEREVGRAIASSGIKREEFFVTTKLWNSDQPKPREAFERSLDLLSLDYVDLYLIHWPCPPSELYINVWEVLLELKESGRAKSVGVSNFLSEHIDKIKEAGFPLPSVNQIELHPWLQQRELVLSCRNDGIQIESWGPFARFSKDLDAFPELTRPAKQYGKTPAQVILRWHIQKGYVVFPKTVHAERLRQNIDIFDFDLTPDEISGIDSLDAGFRTGPDPSSFRAGLD

SEQ ID NO: 20836 - protein, 491 aa, Tropheryma whipplei str. Twist
MHLHKLSGVGLTYDDVMLVPGRSDVLPSQVNFGSFLTRRIRLSAPLVSAAMDTVTESGMAVAMARLGGVGVIHRNMSIADQAEHVTRVKLSESGMITRPVSVSPDLTLEEVEQRCSRYKISGFPVVDEDNTLLGIVTSRDMWPYRHEHRASVRVSEVMTRSPLITASPNISSEEARDLLYKHRLEKLPLVDEHGRLFGLITVKDFVNRQRYPFATKDKNGCLIVGAAIGFFGDAYDRALALAAAGVDFIVVDTANGYSDGALKMINRLKNDSTFADIDIIGGNVATGDGAKALIDSGADAVKVGIGPGSICTTRVIAGVGVPQITAIYECAQTSSVPIIADGGLHYSGDIAKALVAGAKSVMLGGLLAGCDESPGELISRGGKQYKIYRGMGSAGAMQARASYSRDRYFQHDLDSHPIAEGVEGQVPHTGSVSTVFYQLLGGLRQSMFYVGCRDINELQDKGRFVRITSAGLKESHPHDIEMIVETPNYRT

SEQ ID NO: 20837 - protein, 384 aa, Tropheryma whipplei str. Twist
MSKPQTTERRLMEVGFSRNARRAFSLDEVAVVPSRRTRHSSEVSIEWKMDAFSFDTPIISSPADSVVSPSTIVELSEFGCLGILDLEGVWTRYENPEPVLREISALPEEKACLGLQKIYSEPIKRHLLERRLQELRDAGVIVAGCLSPQTTNALYKSVISAGVDIFVIRGGTVSAEHVSKSDNVLNLKRFIYELDVPVMVGGVATYTAALHMMRTGAAGVLVGFGGCAGSTNHASLGIKVPMATAIADVAAARKDYLDESGGRYVQVIADGSMNTSGMAVNALALGADAVMMGTPLVRSTTSPGFGYHWGREAHHMTLPRGRRAYIGQTASLQEIIQGPGHSPDGTVNFAGAIRRAVALAGFQDLKNFQRVEMVVIQDQRRCCA

SEQ ID NO: 20838 - protein, 368 aa, Tropheryma whipplei str. Twist
MQRVIIVGSTGSIGTQAIDFILKNRDSFLVVGLAASTQTSLLREQAQVLGTKNTAQGASEAAELIEATEADVVLNAITGAAGLLSTYATLKTGKRLALANKESLIMGGKYFLDMTTFKGQITPVDSEHSAIAQAMKSGKFSEVNKLILTASGGPFYDRESLEGITLKDALDHPTWNMGPMISINSATMFNKGLEIIEAHLLFGIPYSQIDVVIHPQSIVHSMVEYKDGSVIAQASVADMTLPIGYALSWPNRALNAVRPLEWGARQRWDFLPPTENSMRSINLARRAGEAGGVYPAVLNASNECAVEAFMAGKISFARIIHVTETVFNLYTKQHTNRESAKNPIEVILEEDARTRELAKTVIENMSAD

SEQ ID NO: 20839 - protein, 238 aa, Tropheryma whipplei str. Twist
MSSKRTVFITGGNRGIGRAIAEKFKSFNYNVAIGVRQPEAFKDAGCLAVECDVTVSSSLTKAFKEVEERFGFVDVAIANAGIIRDTLVLRMKEDDFQHILDTNLTGAWRLAKLASRSMMRNKFGRIVFISSVSAGMGGIGQTNYSASKAGMIGLARALTRELASFGITVNVVAPGIVQTDMVSSIPDNLREELIQRVPIRRIGLPEEVANAVFWLSSDEASYVSGVVLPVDGGLSMGF

SEQ ID NO: 20840 - protein, 417 aa, Tropheryma whipplei str. Twist
MMQNAIGRIFLGVCGSISAYKSVYLARLFVKEGYDVRVGFTNGASQFVAGEPFRVFTGHHVLNFPCDDQSHIDISQSHIDISRWADAIVVAPATANILAAARAGLASDIVTQTILSSHAPVLFVPSMHTAMWENPATRDNVNCLLERGYHVLGPVTGDLSSGDWGIGRMVDPCEIVQYVSRSLLNHQTGKLSGKKFLITAGGTRQPIDPVRYIGNRSSGKQAIAIAKEAQKRSAEVILIAANVEAVTLPTGMRVITVVTAEEMRKALSDNIDTSDVVIMAAAVSDFQPREVASQKIKSNDGWTLQLISTDDLLRELASNKSRPRVLVGFSAETEESANFRIDIARQKLLSKGCDYMVVNQVGFDVGFDVSDNEVSLIDDKQVFFTARGSKDYIAKRILDFLSERVIVTYIDPLDRSL

SEQ ID NO: 20841 - protein, 629 aa, Tropheryma whipplei str. Twist
MCTKRQYGLLESIRSPRDLDSFTPHQLDELECQVRDFLIQSVAKTGGHLGSNLGVVELSIALHRSFRSPEDCIIFDVGHQCYVHKLITGRHDFKALRCKNGLSGYPSRHESNHDIVENSHASAALSWADGVSRARTLLGNDNYVIAVVGDGSLTGGMCWEALNNISDDNNRRLVIVVNDNGRSYARTIGGIARFLNAVRASKSYLWLRESSEAVFSHMGSPGRRLYQGIRGAIHGFLSRFSSSNKLFSNLDIRYLGPINGHNRKALEKAFKQAKQYARPIIVHVITEKGHGYPPALEDALDCLHTVGVIDPSTGKSASVQGQVRQDTWTGVFGEELLRLAESNTNIVAVTAAMLHPTGLSMFAEKFPHRVFDVGIAEQHAVASAAGLAYEGLHPVVAIYSTFMNRAFDQVMMDVALHGAPVTFVLDRAGITGPDGASHHGIWDLSLLRIVPGIKLYAPRDASTLRNTLALVCSEDCPTAIRFPRGSVCDDLPALRSLDDGIDVLYGSCDREDIVIVAIGVMAHACVRAAQLLAESGIESTVINPVCFWPLHRQVLARVSKAKLVVLAEEGAKSPGLGDYIAGRRLLEFVIPGDFQPQGSRDELLDAIGLNGEHIARKIKARFNQIINCV

SEQ ID NO: 20842 - protein, 387 aa, Tropheryma whipplei str. Twist
MPVKIKTQSRGSDKEAFAGAPSTSGASGAVLDEDLSTDPASHISAQATASDTDVASKGSEGDFEAIVLADTKDDESTPASPVISGATADPVKDYLKQIGKVSLLTADEEVSLAKRIEAGLFAEEKLSESGDLAPKLKRELRWVVRDGQRAKDHLLAANLRLVVSLAKRYTGRGMQFLDLIQEGNLGLIRAVEKFDYVKGFKFSTYATWWIRQAITRAMADQARTIRIPVHMVEVINKLSRVQRQLLQDLGREPTPDELGRELDMPPERVVEVQKYGREPISLHTPLGDEGDSEFGDLIEDVDAVAPDDAVGFSMLQQQLRLLLDSLSEREAGVIRMRFGLDDDMPKTLDYVGEYFDVTRERIRQIEAKTMAKLRHPSRSQCLRDYLG

SEQ ID NO: 20843 - protein, 389 aa, Tropheryma whipplei str. Twist
MRRQKKPYRTSGTIPEKFVIEKKLYSAMEKVYDPELHIPITRLGMVKTITADSKTVSILIHITSPTCPAVDKIKQRVTDAASAVCPEHDIKIEIGVMSHQERQNLKEVLNLQKRSNPFKESKTRIIAVTSGKGGVGKSTIVSNLGVGLARMGFSVSVIDADVYGFSIPRMFGIDEDFIPQRENGMIMPANKFGVKLISIGMFMRRRGAVAWRGPLLHRTINQFLCDVNFADPDILLIDMPPGTGDAAITIAQLLPNSEVLVITTPQIVAADVAIRSGQFALSVKQNIIGVVENMSSCPESKLDIFGHGGGKFVAEFLDKQCKKESTAKDNRITNPHEAIDLITCIPLDVNIRKSGDEGVPLLVENKYEGSPGHTALKELYEKIALKLYG

SEQ ID NO: 20844 - protein, 170 aa, Tropheryma whipplei str. Twist
MEHTVKITGEHKDLYRGSFRDTPDEKIMRKALCLAHAAGEKGEIPVGAVIADVNGKTIAEGFNKREESKDPTDHAEIIAIRKASQMLKDWRLSGLTLFVTMEPCTMCAGAIVTSRISRVVFGAFNNKTGSVGSRIDILRDEILNTNIEVVSGVLISECEGVLAKFFADLR

SEQ ID NO: 20845 - protein, 446 aa, Tropheryma whipplei str. Twist
MYSCTGFSRRVCTWWKSVMCLIDSVHARQILDSRGTPTVEVEVTLEDGSMGRSAVPSGASTGAFEAHELRDQDNNEYLGKGVTRAVRSVNSEIAPVLIGFDAFDQVGLDHRMIELDGTNNKSRLGANAILGVSLASASAAARAADLSLFRYLGGPSSRILPVPMMNIINGGAHADTGVDIQEFMILPVGARSFSESLRWGCEVYHSLKVQLRESGLSSGLGDEGGFAPALRSNRTALDLILSAIEKAGFSPGIDIVLALDIAASEFCKAPGHYRFEGKDITSDELISYYEGLLSSYPLVSIEDPLDQDDWEGYRTLTTHIGDRVQIVGDDLFVTNTSRLSRGIQSGVANSILVKVNQIGTLTETFDAVDMAAKGGYTAVLSHRSGETEDTTIADMAVATNCGQIKTGAPARGERIAKYNQLLRIEEKLGRSARYAGWLSYPRWQGK

SEQ ID NO: 20846 - protein, 405 aa, Tropheryma whipplei str. Twist
MTLRIAMVSMHSHPLAQPGTSNAGGMNVYITEVAKRLAELECMVDLFTLSNEDYSQDIFRGVRLIGIKPSGRIGPQMVDMLNHVPGFAQKILEHEPYDIFHSHYWLSGMASDIVSSQLDTPHILNMHTIGAVKNTLLAEGDDPEPPIRLESEKRLARKVSKVITSTLTEASAVSRYYGIRFENIAVVSPGVDTTVFYPKGNCTQENEGGNHLWAPVATNPAGFLAVLSRIQPLKGQDLAIRTLASLRKIMFDKCPSLIIAGDQSEKYNNYAASLRRMALDLQVEDLVHFTGVISRKQVAMVMRNAQLLLVPSHSETFGLVTLEAAASGTPVVASLTDGLIDAIVPNITGILIAERNPDIWAKNIANLLMNKNRHKSLSRSSVRHAQDHDWTKTAAQILSLYHQFV

SEQ ID NO: 20847 - protein, 434 aa, Mus musculus
MPHISKNCCLTSGNVGIVYTKEDRTEIRDMLLANKVPAAARAGVIAPCEVTVPAQNTGLGPEKTSFFKALGITTKISRVTTEILSDVQVIKTGDKVRQESYVMLIILTETYLDCSSDPTSTTYITGFKLSILKGGVLRFLFYTGARIIPIYTRGNYQVQECNYKVWKGVRKEIGTAAMNARPHKEDGKVVEAKSCVKRRLSKTRQNVVIEIMTDKNNGQGGFVLVTFDDYDSMNNTVIPYYKGQSRKTAHRSRGWLVLPPSERNIRGFGGFGCSHGDGGYGDREKGYNELDSERSRFGGGTRYSDFANYNNQSSNYVPLKGAHFGDRSSIPCNGKGQCFFKPRNSLHQGFLSYILLSAPELTRMPDQELYLLILLIDLAEQCDPHSAFYRLLIQFPSPMHESSGHNANIQPQWKRMLRYLDVLDRLQTQPFRTG

SEQ ID NO: 20848 - protein, 512 aa, Mus musculus
MFFHLKETWFSMMIILSAIEIIIIIVLIFLRTRIQVAIILLQEGSNFLATSGVPIFKVMVPAGQCIYEDETCDPEIFPYTNIPKDCPGASCNFAFYGGRSMYHNYILTFQVYNLFAFLWLINFVIALGQCALAGAFASYYWAMKKPDDIPPYPLFTAFGRAVRYHTGSLAFGSLILASVQMFKVIVEYLDRRLKKAQNSAAQFLHCCLQCCFWCLEKMVKFLNRNAYIMIALYGKNFCESTRDAFYLLMRNILNALVCGISSRDLMAGCHVDVLYFTTVRQNFTKDIAKVTVTDEVTYFVLLLGKVLVSGIVGVLAFLLFTERLQIIVDGPTTLNYYWVPFLTLVFGSYMIAHGFFSVYSMCVETIFICFLSLTNLEEVGHRGREQSPVAMLGLRDCFSSTWVFKETAVTCCLCHVLRKSPVGEEQLRGSGRPRKKRRLSFKTLFRDSGSNEHFAGAGQDQEASKIFAATKAHTQASDVLGIGELGGADSGDQVVQLEKSWWKKQRAEDEDV

SEQ ID NO: 20849 - protein, 408 aa, Mus musculus
MIPPEPPQPQLQPPPPPAPPNHVVTTIENLPAEGSGGVSLSASSRASMRQRIRKVLNREMLISVALGQVLSLLVCGIGLTSKYLAEDFHANTPVFQSFLNYILLFLVYTTTLAVRQGEENLLAILRRRWWKYMILGLIDLEANYLVVKAYQYTTLTSVQLLDCFVIPVVILLSWFFLLIRYKAVHFIGIVVCILGMGCMVGADVLVGRHQGAGENKLVGDLLVLGGATLYGISNVWEESIIRTLSRVEFLGMIGLFGAFFSGIQLAIMEHKELLKVPWDWQIGLLYVGFSACMFGLYSFMPVVIKKTSATSVNLSLLTADLYSLFCGLFLFHYKFSGLYLLSFFTILIGLVLYSSTSTYIAQDPRVYKQFRNPSGPVVDLPSTAQVEPSVTYTSLGQETEEEPHVRVA

SEQ ID NO: 20850 - protein, 464 aa, Mus musculus
MRESEDSPSPKRQRLSHSVFDYTSASPAPSPPMRPWEMTSNRQPPSVRPNQHHFSGERCNTPARNRRSPPVRRQRGRRERLSRHNSISQDENYHHLPYAQQQAIEEPRAFHPPNVSPRLLHPAAHPPQQNAVMVDIHDQLHQGTVPVSYTVTTVAPHGLPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLQVGSFTYPPSAHPPTLPPSAPLQFLTHDPLHQEVSFGVPYPPFMPRRLTGRSRYRSQQPMPPPPYHPSLLPYVLSMLPVPPAVGPTFSFELDVEDGEVENYEALLNLAERLGEAKPRGLTKADIEQLPSYRFNPSNHQSEQTLCVVCMCDFESRQLLRVLPCNHEFHAKCVDKWLKGNRTCPICRADASEVHRDSE

SEQ ID NO: 20851 - protein, 117 aa, Mus musculus
MKYRNRVRSRISNLKDPRNPGLRRNVLSGAISPELIAKMTAEEMASDELRELRNAMTQEAIREHQMAKTGGTTTDLLRCSKCKKKNCTYNQVQTRSADEPMTTFVLCNECGNRWKFC

SEQ ID NO: 20852 - protein, 273 aa, Mus musculus
MHRLPTQKEERASSPPVEVGEPREFVLQPAPQGRAVRCRLTRDKKGMDRGMYPSYFLHLDTEKKVFLLAGRKRKRSKTANYLISSDPTNLSRGGENFIGKLRSNLLGNRFTVFDNGQNPQRGGGGDVGSLRQELAAVVYETNVLGFRGPRRMTVIIPGMNSDNERVPIRPRNASDGLLVRWQNKTLESLIELHNKPPIWNEDSGSYTLNFQGRVTQASVKNFQIVHADDPDYIVLQFGRVAEDAFTLDYRYPLCALQAFAIALSSFDGKLACE

SEQ ID NO: 20853 - protein, 534 aa, Mus musculus
MMDVCGPVDQDRGLNIHALMAGLGGGFGYVVGGIHWDKTSFGRALGGQLRVIYVFTAITLSVTTVLTLISIPERPLRPLGEKRTAMKSPSLPLPPSPPVLLEEGAGDALPSTTATSLYASFSSPISPPSPLTPKYGSFISRDSSLTGINEFASSFGTSNIDSVLIDCFTAGHDNYLALPSSVPRQAISVSFPRAPDGFYCQERGLERREGPLTLGSDGDVLRVGSLDTSKPRASGILKRPQTLALPDVAGGNGPETSRRRNVTFSQQVANILLNGVKYESELTGSSEQSEQPLSLRHLCSTIYNMPKALRNLCVNHFLGWLSFEGMLLFYTDFMGEVVFQGDPKAPHTSEAYQKYNSGVTMGCWGMCIYAFSAAFYSAILEKLEECLSVRTLYFIAYLAFGLGTGLATLSRNLYVVLSLCTTYGILFSTLCTLPYSLLCDYYQSKKFAGSSADGTRRGMGVDISLLSCQYFLAQILVSLVLGPLTSAVGSANGVMYFSSLVSFLGCLYSSLCVTYEIPSVDAADEERQPLLLNV

SEQ ID NO: 20854 - protein, 722 aa, Danio rerio
MSTTRAPLPTVNERKAENHTTNGHGRSEVTSRSVRSSGRNRNSGSGLDDVHPVIGNYRLLKTIGKGNFAKVKLARHILTGSEVAIKMIDKTQLNPTSLQKLSREVTIMKNLNHPNIVKLFEVIETEKTLFLVMEYASGGEVFDYLVAHGRMKEKEARAKFRQIVSAVQYCHQKRIVHRDLKAENLLLDGDMNIKIADFGFSNEFMVGSKLDTFCGSPPYAAPELFQGKKYDGPEVDVWSLGVILYTLVSGSLPFDGQNLKELRERVLRGKYRIPFYMSTDCENLLKRFLVLNPAKRGTLEQIMKERWIDSGFEDDELKPFTEPDADISDQKRIDVIVGMGFSKEKIHESLFKMNYDEVTAIYLLLGRKTHEEVSDSSSNSNLSVAKTRPSSEMNSQSPSHLKVQRSISSSESRKSRRHSEQVGVVANNALSNSKRVVPVTADSEVKQEGGVIARKLPNHSPPSPLLGNANNPNKTEIPDRKKGNSITSNNISGSGSMSRRNTYVCTERNNTDRLSVIPNGKENSVSLSPSSRDPGASTHSISTSVTPDKARFPRGSASRSTFHGQVRDRRTATYNGPPASPAQPRSRANANNLLTKLTSKLTRSRHVSGDQQKDEGKDGKDGKPRSLRFTWSMNTTSTMEPADIINEIRTVLDANSCSYQQRECFLLLCAHGDSHTDSLVQWEMEVCKLPRLSLNGVRFKRISGNSIAFKNIASKIAGELKL

SEQ ID NO: 20855 - protein, 237 aa, Xenopus laevis
MDFMDRNINFNALLKFSHISSSTQQHLKRVYSCFAICLLVAAAGAYVNVVLKFLQGSFISFAGSLGMMIWLMSTPHTFENEKKRLGILAGFAFFSGVGLGPALNMCIAINPSIIPTAFLGTAMIFMCFSLSALYAQRRSFLFLGGILMSVLSLLLISSLVNLLVGSVLLFKMHMYIGLLVMCGFVLFDTQLIIEKAEQGDKDYVWHCVDLFLDFITIFRKLMVIMAMNEKEKKKERK

SEQ ID NO: 20856 - protein, 390 aa, Danio rerio
MTRDIVLGDELPDWVGAKEFYQKYDPKEVIGRGVSSVVRRCVHKHTGQEFAVKIIEITAEKMTEQQLEEVKSSTLKEIHVLNLVKGHPSIITLIDSYESTAFIFLVFDLMRRGELFDYLTEKVTLSEKETRSMMRALLEAVQYLHALNIVHRDLKPENILLDDQGHLKLSDFGFSVQLGPDEKLRELCGTPGYLAPEILKCSMDETHEGYGKEVDLWACGVILFTLLAGSPPFWHRKQLLMLRMIMEGRYQFSSPEWDDRSDTVKDLISRLLVVEPTIRLTAEQALAHPFFCQYQKEDVRLFSPRKTFKALILTVLACIRMQCRYYRARPLTKELLSRDPYSIRGVRKLIDGCAFRIYGHWVKKGEQQNRAALFQNTAKIILLGLEDLEN

SEQ ID NO: 20857 - protein, 435 aa, Mus musculus
MTLVKVKIQCTPSRRLCATEKVRDASGVHCPEACEETLLADVRIELLQGSSVGKQEKLYMNMDRVSQIYSHNNFAIMPLYALNRIRETYINSGIERNTALEETKGGKKLGSWNEEEDELTRMAFSESQLVLGQNNQVEKVLRKDLNSFGRGYLKETKTQLRDDSLLTPSNSAADATVSFTKDFLVGGVAVAISRMVVAPTDEVKLVLQVQHASKQIMADNQYKGNIDCMARIPKEQGVLSFWHGNLTNIIRYFPTQTLTFAFKDKYKQIFLGGNLASGGATGAKSLCFLFPLDFAHTCLAADVGKAGAEREFIDLYDFLVKTYESAACFGMYDTAKGMLPDPKNTHIFISCMTAQSVTAVAGLTSYTFDTVRHLMMMQSGCKGTDIMYRDTLDCWRKMAQDEESKAFVKNAWSNILGGMGGAFVLVFYDEIKKYT

SEQ ID NO: 20858 - protein, 1906 aa, Gallus gallus
MGDVKLVTSTRVSKTSLTLSPSVPAEAPAFTLPPRNIRVQLGATARFEGKVRGYPEPQITWYRNGHPLPEGDHYVVDHSIRGIFSLVIKGVQEGDSGKYTCEAANDGGVRQVTVELTVEGNSLKKYSLPSSAKTPGGRLSVPPVEHRPSIWGESPPKFATKPNRVVVREGQTGRFSCKITGRPQPQVTWTKGDIHLQQNERFNMFEKTGIQYLEIQNVQLADAGIYTCTVVNSAGKASVSAELTVQGPDKTDTHAQPLCMPPKPTTLATKAIENSDFKQATSNGIAKELKSTSTELMVETKDRLSAKKETFYTSREAKDGKQGQNQEANAVPLQESRGTKGPQVLQKTSSTITLQAVKAQPEPKAEPQTTFIRQAEDRKRTVQPLMTTTTQENPSLTGQVSPRSRETENRAGVRKSVKEEKREPLGIPPQFESRPQSLEASEGQEIKFKSKVSGKPKPDVEWFKEGVPIKTGEGIQIYEEDGTHCLWLKKACLGDSGSYSCAAFNPRGQTSTSWLLTVKRPKVEEVAPCFSSVLKGCTVSEGQDFVLQCYVGGVPVPEITWLLNEQPIQYAHSTFEAGVAKLTVQDALPEDDGIYTCLAENNAGRASCSAQVTVKEKKSSKKAEGTQAAKLNKTFAPIFLKGLTDLKVMDGSQVIMTVEVSANPCPEIIWLHNGKEIQETEDFHFEKKGNEYSLYIQEVFPEDTGKYTCEAWNELGETQTQATLTVQEPQDGIQPWFISKPRSVTAAAGQNVLISCAIAGDPFPTVHWFKDGQEITPGTGCEILQNEDIFTLILRNVQSRHAGQYEIQLRNQVGECSCQVSLMLRESSASRAEMLRDGRESASSGERRDGGNYGALTFGRTSGFKKSSSETRAAEEEQEDVRGVLKRRVETREHTEESLRQQEAEQLDFRDILGKKVSTKSFSEEDLKEIPAEQMDFRANLQRQVKPKTLSEEERKVHAPQQVDFRSVLAKKGTPKTPLPEKVPPPKPAVTDFRSVLGAKKKPPAENGSASTPAPNARAGSEAQNATPNSEAPAPKPVVKKEEKNDRKCEHGCAVVDGGIIGKKAENKPAASKPTPPPSKGTAPSFTEKLQDAKVADGEKLVLQCRISSDPPASVSWTLDSKAIKSSKSIVISQEGTLCSLTIEKVMPEDGGEYKCIAENAAGKAECACKVLVEDTSSTKAAKPAEKKTKKPKTTLPPVLSTESSEATVKKKPAPKTPPKAATPPQITQFPEDRKVRAGESVELFAKVVGTAPITCTWMKFRKQIQENEYIKIENAENSSKLTISSTKQEHCGCYTLVVENKLGSRQAQVNLTVVDKPDPPAGTPCASDIRSSSLTLSWYGSSYDGGSAVQSYTVEIWNSVDNKWTDLTTCRSTSFNVQDLQADREYKFRVRAANVYGISEPSQESEVVKVGEKQEEELKEEEAELSDDEGKETEVNYRTVTINTEQKVSDVYNIEERLGSGKFGQVFRLVEKKTGKVWAGKFFKAYSAKEKENIRDEISIMNCLHHPKLVQCVDAFEEKANIVMVLEMVSGGELFERIIDEDFELTERECIKYMRQISEGVEYIHKQGIVHLDLKPENIMCVNKTGTSIKLIDFGLARRLESAGSLKVLFGTPEFVAPEVINYEPIGYETDMWSIGVICYILVSGLSPFMGDNDNETLANVTSATWDFDDEAFDEISDDAKDFISNLLKKDMKSRLNCTQCLQHPWLQKDTKNMEAKKLSKDRMKKYMARRKWQKTGHAVRAIGRLSSMAMISGMSGRKASGSSPTSPINADKVENEDAFLEEVAEEKPHVKPYFTKTILDMEVVEGSAARFDCKIEGYPDPEVMWYKDDQPVKESRHFQIDYDEEGNCSLTISEVCGDDDAKYTCKAVNSLGEATCTAELLVETMGKEGEGEGEGEEDEEEEEE

SEQ ID NO: 20859 - protein, 1147 aa, Oryctolagus cuniculus
MDFRANLQRQVKPKTVSEEERKVHSPQQVDFRSVLAKKGTPKTPVPEKAPPPKPATPDFRSVLGSKKKLPAENGSSNAEALNVKATESPKLVGNAPLSGSLKPVANAKPAETLKPVANTKPAETLKPVANAETLKPMGNAKPAESSKPVGNTKPAETLKPVGNTKPAETLKPVGNIKPAETLKPVGNIKPAETLKPVGNTKPTETLKPVANAKSAETLKPIANTKPAETLKPVGNAKPAETLKPVGNAKPAETLKPVGNAKPAETLKPVGNAKPAETLKAVANAKPAETPKPAGKEELKKEVQNDVNCKREKAGAADNEKPPASPGTAPTFKEKLQDVRVAEGEKLLLQCQVSSEPPATITWTLNGKTLKTTKFVILSQEGSLCSVSIEKALPEDRGLYKCVAKNAAPEAECSCHVTVHDAPASENAKAPEMKSRRPKSSLPPVLGTESDATVKKKPAPKTPPKAATPPQIPQFPEDQKVRAGERVELFGKVAGTQPITCTWMKFRKQIQDSEHIKVENSEAGSKLTILAARQEHCGCYTLLVENKLGSRQAQVNLTVVDKPDPPAGTPCASDIRSSSLTLSWYGSSYDGGSAVQSYSVEIWDSVDKMWTELATCRSTSFNVRDLLPDREYKFRVRAINVYGTSEPSQESELTTVGEKPEEPKDEVEEVSDDDEKEPEVDYRTVTVNTEQKVSDFYDIEERLGSGKFGQVFRLVEKKTGKIWAGKFFKAYSAKEKENIPAEIGIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPISYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLTAERLETEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEEE

SEQ ID NO: 20860 - protein, 381 aa, Rattus norvegicus
MGCLGNSSKTAEDQGVDEKERREANKKIEKQLQKERLAYKATHRLLLLGAGESGKSTIVKQMRILHVNGSNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 20861 - protein, 534 aa, Chlorella kessleri
MAGGGVVVVSGRGLSTGDYRGGLTVYVVMVAFMAACGGLLLGYDNGVTGGVVSLEAFEKKFFPDVWAKKQEVHEDSPYCTYDNAKLQLFVSSLFLAGLVSCLFASWITRNWGRKVTMGIGGAFFVAGGLVNAFAQDMAMLIVGRVLLGFGVGLGSQVVPQYLSEVAPFSHRGMLNIGYQLFVTIGILIAGLVNYAVRDWENGWRLSLGPAAAPGAILFLGSLVLPESPNFLVEKGKTEKGREVLQKLCGTSEVDAEFADIVAAVEIARPITMRQSWASLFTRRYMPQLLTSFVIQFFQQFTGINAIIFYVPVLFSSLGSANSAALLNTVVVGAVNVGSTLIAVMFSDKFGRRFLLIEGGIQCCLAMLTTGVVLAIEFAKYGTDPLPKAVASGILAVICIFISGFAWSWGPMGWLIPSEIFTLETRPAGTAVAVVGNFLFSFVIGQAFVSMLCAMEYGVFLFFAGWLVIMVLCAIFLLPETKGVPIERVQALYARHWFWNRVMGPAAAEVIAEDEKRVAAASAIIKEEELSKAMK

SEQ ID NO: 20862 - protein, 367 aa, Homo sapiens
MSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRYIHAAGIIHRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 20863 - protein, 97 aa, Blepharisma japonicum
GGKGGKGGKGLGKVGAKKRHRRVIRENIQGITKPAIRRLARRGGVKRTLSGLVYDETRNVLKVFLENVVRDAVTYTEHARRKTVTALDVVYALKRQG

SEQ ID NO: 20864 - protein, 746 aa, Mus musculus
MAAAAEPGARTWPGSGSPRLGSPAGSPVLGISGRTRPGSGPERTSRAIGSAAPGHSFRKVTLTKPTFCHLCSDFIWGLAGFLCDVCNFMSHEKCLKQVKTPCTSIAPSLVRVPVAHCFGSLGLYKRKFCVVCRKSLEVPAFRCEVCELHVHPDCVPFACSDCRQCHQDGQQDYDTYHHHWREGNLPSGARCEVCRKTCGSSDVLAGVRCEWCGVQAHSVCSTALAPECTFGRLRSMVLPPSCVRLLSRNFSKMHCFRIPETMVLELGDGDDGVDGSAAIGTGREVLTATESTKQTLKIFDGNDSMRKNQFRLVTVSRLARNEEVMEAALRAYYISEDPKDFQLQALPLSGNAQALGKAGTTEEEASKGSCPRDSVPEAWVIRSLPRTQEILKIYPGWLKVGVAYVSIRVNSQSTARSVVQEVLPLFGQQVEDKERFQLIEVLMSSRQVQRTVLADEEPLLDRLWDIRQTSVRQVSQTRFYVAETRATAPRVSLFVGGLPPGLSPQDYSNLLHEAMATKAAVVSVSHVYSLQGAVILDVTCFAEAERLYMLARDTAVHGRPLTALVLPDVLHTKLPPDCCPLLVFVNPKSGGLKGRELLCSFRKLLNPHQVFELTNGGPLPGFHLFSQVPSFRVLVCGGDGTVGWVLAALEETRRHLACPEPSVAILPLGTGNDLGRVLRWGAGYSGEDPFSVLVSVDEADAVLMDRWTILLDAHEIDSTENNVVETEPPKVPVWHQLESYIWLPLC

SEQ ID NO: 20865 - protein, 795 aa, Mus musculus
MTNQEKWAHLSPSEFSQLQKYAEYSTKKLKDVLEEFHGNGVLAKYNPEGTIDFEGFKLFMKTFLEAELPDDFTAHLFMSFSNKFPHSSPNVKSKPALLSGGLRMNKGAITPPRSSPANTCSPEVIHLKDIVCYLSLLERGRPEDKLEFMFRLYDTDGNGFLDSSELENIIGQMMHVAEYLEWDVTELNPILHEMMEEIDYDRDGTVSLEEWIQGGMTTIPLLVLLGLENNVKDDGQHVWRLKHFNKPAYCNLCLNMLIGVGKQGLCCSFCKYTVHERCVARAPPSCIKTYVKSKKNTDVMHHYWVEGNCPTKCDKCHKTVKCYQGLTGLHCVWCQTTLHNKCASHLKPECDCGPLKDHILPPTTICPVVLTMPSAGASVPEERQSTAKKEKSSSQQPNKATDKNKMQRANSVTMDGQGLQITPVPGTHPLLVFVNPKSGGKQGERIYRKFQYLLNPRQVYSLSGNGPMPGLHFFRDVPDFRVLACGGDGTVGWILDCIEKANVVKHPPVAILPLGTGNDLARCLRWGGGYEGENLMKILKDIESSTEIMLDRWKFEVTPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKKRSHRRIEKKGSDKRPTLTDAKELKFASQDLSDQLLEVVGLEGAMEMGQIYTGLKSAGRRLAQCSSVVIRTSKSLPMQIDGEPWMQTPCTIKITHKNQAPMLMGPPPKTGLFCSLIKRTRNRSKE

SEQ ID NO: 20866 - protein, 328 aa, Mus musculus
MAGAKRVPVTVTAASKPGLRPRTALGDIGNKVSEELQARVPLKREAKNVRYWKSPMETSGCAPAGEYLCQAFSDVILAVSDIEAEDGADPNLCSEYANDIYAYFRQLEEEQSVRPKYLQGGEVTGNMRAILFDWLIQVQMKFRLLQETMYMTVSMIDRFMQNSCVPKKVLQLVGVTAMFIASKYEEMYPPETGDFAFVINNMYTKHQIRQMEMKILRVLNFSLGRPLPLHFLRRASKIGEVDAEQHTLAKYLMDYDMVHFAPSQIAAGAFCLALESLDNGEWTPTLQHYLSYTEDFLLPVMQHLAKNVVMVNRGLTKHMTVKNQVCSI

SEQ ID NO: 20867 - protein, 351 aa, Pneumocystis carinii
MTASSRNVRFNVSDDYEILDVIGEGAYGIVCSAIHKPSGQKVAIKKISPFDHSMFCLRTLREMKLLRYFNHENIISILDIQQPQDFESFSEVYLIQELMETDMHRVIRTQDLSDDHCQYFIYQILRALKAMHSADILHRDLKPSNLLLNANCDLKVCDFGLARSAVSTEDSSSFMTEYVATRWYRAPEIMLTFKEYTKAIDIWSVGCILAEMLSGRPLFPGKDYHHQLMLILDVLGTPTMEDYYGIKSRRAREYIRSLPFKKRVSFASIFPRANPLALDLLEKLLAFNPAKRVTAEEALQHNYLEPYHDPDDEPTAPPISPSFFDFDRIKDSLTKNDLKILIYKEIMSMNN

SEQ ID NO: 20868 - protein, 381 aa, Mus musculus
MGCLGNSSKTAEDQGVDEKERREANKKIEKQLQKERLAYKATHRLLLLGAGESGKSTIVKQMRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 20869 - protein, 412 aa, Arabidopsis thaliana
MDPEGFTSGLFRWNPTRALVQAPPPVPPPLQQQPVTPQTAAFGMRLGGLEGLFGPYGIRFYTAAKIAELGFTASTLVGMKDEELEEMMNSLSHIFRWELLVGERYGIKAAVRAERRRLQEEEEEESSRRRHLLLSAAGDSDDWTGLSEEPVQQQDQTDAAGNNGGGGSGYWDAGQGKMKKQQQQRRRKKPMLTSVETDEDVNEGEDDDGMDNGNGGSGLGTERQREHPFIVTEPGEVARGKKNGLDYLFHLYEQCREFLLQVQTIAKDRGEKCPTKVTNQVFRYAKKSGASYINKPKMRHYVHCYALHCLDEEASNALRRAFKERGENVGSWRQACYKPLVNIACRHGWDIDAVFNAHPRLSIWYVPTKLRQLCHLERNNAVAAAAALVGGISCTGSSTSGRGGCGGDDLRF

SEQ ID NO: 20870 - protein, 726 aa, Mus musculus
MEPSDAARPGPGRAFRGLSPRLLLLPLLPVLLGRGLRAGAAASSGAAAEDSSAMEELATEKEAEESHRQDSVSLLTFILLLTLTILTIWLFKHRRVRFLHETGLAMIYGLIVGVILRYGTPATSGHDKSLSCTQEDRAFSTLLVNVSGKFFEYTLKGEISPGKINNVEQNDMLRKVTFDPEVFFNILLPPIIFHAGYSLKKRHFFRNLGSILAYAFLGTAVSCFIIGNLMYGVVKLMKIVGQLSDKFYYTDCLFFGAIISATDPVTVLAIFNELHADVDLYALLFGESVLNDAVAIVLSSSIVAYQPAGLNTHAFDAAAFFKSVGIFLGIFSGSFTMGAVTGVVTALVTKFTKLHCFPLLETALFFLMSWSTFLLAEACGFTGVVAVLFCGITQAHYTYNNLSVESRSRSKQLFEVLHFLAENFIFSYMGLALFTFQKHVFSPIFIIGAFVAIFLGRAAHIYPLSFFLNLGRRHKIGWNFQHMMMFSGLRGAMAFALAIRDTASYARQMMFTTTLLIVFFTVWVIGGGTTPMLSWLNIRVGVEELSEEDQNENRWQYFRVGVDPDQDPPPNNDSFQVLQGDGMDSVGGSRTKQESAWIFRLWYIFDHNYLKPILTHSGPPLTTTLPAWCGLLARCLTSPQVYDNQEPLREDDSDFILTEGDLTLTYGDSTVTANGSSSSYTASTSLECGRRTKSSSEEVLERDLGMGDQKVSSRGTPLVFPLQENA

SEQ ID NO: 20871 - protein, 478 aa, Mus musculus
MEQAIEQQAMYQFPMDNEMLMPVSHMPVSSGNSEFHQPPATQYLPEMMRPYMASAKEFRCNESHSSLGCYLSMFFCSDELEQHKRIHTRYRPYKCDECNPEVVRSDHLRQHKRTNLPKCKSHLKMVKANGPVVPVNQDGTTQKDILIANISHPQPSLVFPPLPPYCLCEDRGARPLPLPLPRQCEENGSETKSYQCLHLNTVTADLQTSSSGLSVNLSDMSRPVPSRARVYTDVNTHRSRENWDYESHEVEWGNQDDYQLVRKLGRGKYCEVFEAINITNNEKVVVKILKSVKKKKIKHEIKILENLRGQEYNVQVASRYFKGPELLVDYQMYDYTLDMWSLGCMLASMIFRKEPFFHGHDNYDQLRWERFVHSENQHLVSPEALDFLDKLLLYDPQSQLTAREATEHPYFYTVVKDQARMSSTSMAGGSTPVTSANMMSVISSAPTPSTLGPLAGSPVIAASNSFGIPVPAAAGAQQ

SEQ ID NO: 20872 - protein, 225 aa, Mus musculus
MQKCSFPVRENKLTRGIGGTQSPSSQLERNAIKGEWHSVYGISGSSVAKILESGNSKVNNALGYPTDVSVPHSVISGHKQVLAWSVETEYTCPLAKMVKAFVDDPSTFVAAAPVAAAPAKAEAKEYILDSVAEQALSVPTSGLVRKQVLRQQLLSRNSTPENRKDAGSSRGRSLAGLANRLWSKDGSSELSWVVLSLSLALGLLEDAQSLPRVMFLEGGSQDLTE

SEQ ID NO: 20873 - protein, 316 aa, Mus musculus
MSDKLPYKVADIGLAAWGRKALDIAENEMPGLMSMQELLQATEACSHCWLCLHMTMETAVLIETLMALGAEVRWSSCNIFCTQDHAVDAIAKAGIPVFPWKGETDEEYLWCIEQMLYCKDGPLNMILDDGGDLTNLILTKYLQLLSGIRGISRETMTGVHHLYKMMSNGILKVPAINVNDFVTKSKFDDLCGCRESFIDGIKRATDMMIAGQHFEQMKDDATVCNIGHFDVEIDVKWLNENAMEKVNIKPQVMAQIELWTHPDKYPVHFLPKKLDEAVAEAHMGKLNVKLTKLTEKQVQYLGMPINGPFKPDHYHY

SEQ ID NO: 20874 - protein, 520 aa, Schistosoma mansoni
GFTSGPPVQSIPAFLTKLKLLVDDEETNELIYWDPHGTSFHIRDGNRLAKELLPLYFKHNNLSSFIRQLNMYGFRKINRVDPSLPLKSDTEDMEFSHPYFIRNKDILLSKIQRRTSNMFSPIMGSRNQSFGVKVPYVQANSGLNGSISVSPQRPITATDFLRLAETVRHLRCNQETLSQQISVLKSENQLLYRELSDLREHHDKQSQLIQTLFTFLSAFAKEGRSASVCIGQTKRKALPSITPSGSRFQNKELKLDLRKGFQIERNSVQPLQLVQTSDLLGSHKRPKFDIRNLSAKIGNTSSGANITDQISDIGSVVHILPSNLQLTPVSLECDVNTQSLVDKNPVNVQDGPRYYLSKVDDNFTHPTNDEEFPVGLNVEEDGVTDVNNSILELNWPCSRSDTPYCLTDSPGLSDVIPSKLDGVTDESICDLLLNGDSQTEQEVGNNQPFSESTLSKYKKEPIRKQHKIQNRPRCIAPFAESDPQFVSTTLQDIDSLPWEKYQDSGFDFNLDVEQNQTENS

SEQ ID NO: 20875 - protein, 631 aa, Schistosoma mansoni
FLTKLKLLVDDEETNELIYWDPHGTSFHIRDGNRLAKELLPLYFKHNNLSSFIRQLNMYGFRKINRVDPSLPLKSDTEDMEFSHPYFIRNKDILLSKIQRRTSNMFSPIMGSRNQSFGVKVPYVQANSGLNGSISVSPQRPITATDFLRLAETVRHLRCNQETLSQQISVLKSENQLLYRELSDLREHHDKQSQLIQTLFTFLSAFAKEGRSASVCIGQTKRKALPSITPSGSRLQNKELKLDLRKGFQIERNSVQPLQLVQTSDLLGSHKRPKFDIRNLSAKIGNTSSGANITDQISDIGSVVHILPSNLQLTPVSLGNDECDVNTQSLVDKNPVNVQDGPRYYLSKVDDNFTHPTNDEEFPVGLNVEEDGVTDVNNSILELNWPCSRSDTPYCLTDSPGLSDVIPSKLDGVTDESICDLLLNGDSQTEQEVGNNQPFSESTLSKYKKEPIRKQHKIQNRPRCIAPFAESDPQFVSTTLQDIDSLPWEKYQDSGFDFNLDVEQNQTENSRSSSNGLIVGNEIIPVEPANLNACDDVIQFLRSEIPGKKLKSDEPLKTVATTEAHASTQNGAIDLTSSSSAPTTWKARLSANNRLTISSSPKVKRKQVPVLIRRQSITPLSTPDFCEEELE

SEQ ID NO: 20876 - protein, 658 aa, Schistosoma mansoni
MYGFTSGPPVQSIPAFLTKLKLLVDDEETNELIYWDPHGTSFHIRDGNRLAKELLPLYFKHNNLSSFIRQLNMYGFRKINRVDPSLPLKSDTEDMEFSHPYFIRNKDILLSKIQRRTSNMFSPIMGSRNQSFGVKVPYVQANSGLNGSISVSPQRPITATDFLRLAETVRHLRCNQETLSQQISVLKSENQLLYRELSDLREHHDKQSQLIQTLFTFLSAFAKEGRSASVCIGQTKRKALPSITPSGSRLQNKELKLDLRKGFQIERNSVQPLQLVQTSDLLGSHKRPKFDIRNLSAKIGNTSSGANITDQISDIGSVVHILPSNLQLTPVSLGNDGKYIYSLTGSSPECDVNTQSLVDKNPVNVQDGPRYYLSKVDDNFTHPTNDEEFPVGLNVEEDGVTDVNNSILELNWPCSRSDTPYCLTDSPGLSDVIPSKLDGVTDESICDLLLNGDSQTEQEVGNNQPFSESTLSKYKKEPIRKQHKIQNRPRCIAPFAESDPQFVSTTLQDIDSLPWEKYQDSGFDFNLDVEQNQTENSRSSSNGLIVGNEIIPVEPANLNACDDVIQFLRSEIPGKKLKSDEPLKTVATTEAHASTQNGAIDLTSSSSAPTTWKARLSANNRLTISSSPKVKRKQVPVLIRRQSITPLSTPDFCEEELE

SEQ ID NO: 20877 - protein, 772 aa, Bacteroides sp.
MERSGNFYKAIQLGYILISILIGCMAYNSLYEWQEIEALELGNKKIDELRKEINNINIQMIKFSLLGETILEWNDKDIEHYHARRMAMDSMLCRFKATYPAERIDSVRSLLEDKERQMFQIVRLMDEQQSINKKIANQIPVIVQKSVQEQSKKPKRKGFLSIFGKKEGTKPTTTTTTLRSSNRNMVNEQNAQSRRLSEQADSLAARNAELNRQLQGLICQIEKKVQSDLQNRESEITAMRKKSFMQIGGLMGFVLLLLVISYIIIHRDAKNIKRYKRKTTDLIEQLEQSVQQNEILITSRKKAVYTITHELRTPLTAITGYTELLRKECNSGNNGQYIQNILQSSDRMRDMLNTLLDFFRLDNGKEQPRLSPCRISAITHTLETEFMPVAVNKGLSLSVKTGHDAIVLTDKERIIQIGNNLLSNAVKFTEEGGVSLITEYDNGVLTLVIEDTGTGMTEEEQKQAFGAFERLSNAAAKEGFGLGLAIMRNIVSMLGGTIRLDSKKGKGSRFTVEISMQEAEEQLGYTSNTPVYHNNKFHDVVAIDNDEVLLLMLKEMYSQEGIHCDTCTDAAALMEMIRQKEYSLLLTDLNMPGINGFELLELLRSSNVGNSPTIPVVVATASGSCNKGELLAKGFAGCLFKPFSISELMEVSDRCAIKATPDGKPDFSALLSYGNEAVMLEKLITETEKEMQAVRDAAKEKDLQKLDSLIHHLRSSWEVLRADQPLNVLYGLLRGDALPDGEALSHAVTAVLDKGVEIIRLAEEERRKYEDG

SEQ ID NO: 20878 - protein, 501 aa, Toxoplasma gondii
MGQQESTLGGAAGEPRSRGHAAGTSGGPGDHLHATPGMFVQHSTAIFSHRYKGQRVLGKGSFGEVILCKHKITGQECAVKVISKRQVKQKTDKESLLREVQLLKQLDHPNIMKLYEFFEDKGYFYLVGEVYTGGELFDEIISRKRFSEVDAARIIRQVLSGITYMHKNKIVHRDLKPENLLLESKSKDANIRIIDFGLSTHFEASKKMKDKIGTAYYIAPEVLHGTYDEKCDVWSTGVILYILLSGCPPFNGANEYDILKKVEKGKYTFELPQWKKVSESAKDLIRKMLTYVPSMRISARDALDHEWIQTYTKEQISVDVPSLDNAILNIRQFQGTQKLAQAALLYMGSKLTSQDETKELTAIFHKMDKNGDGQLDRAELIEGYKELMRMKGQDASMLDASAVEHEVDQVLDAVDFDKNGYIEYSEFVTVAMDRKTLLSRERLERAFRMFDSDNSGKISSTELATIFGVSDVDSETWKSVLSEVDKNNDGEIDFDNFNRCS

SEQ ID NO: 20879 - protein, 90 aa, Brassica rapa subsp. pekinensis
  unsure (1)..(90): unsure at all Xaa locations
MKGDYHRYLAEFKAGDERKETAESTLVAYKSAQDIATAELAPTHPIRLGLALNFSVFYYXILNSPDRACTLAXQAFDEAIAELDTLGEES

SEQ ID NO: 20880 - protein, 113 aa, Mus musculus
MRRTPDPARRSPSLAMEKTELIQKAKLAEQAERYDDMATCMKAVTEQGAELSNEERNLLSVAYKNVVGGRRSAWRVISSIEQKTDTSDKKLQLIKDYREKVESELRSICTTVL

SEQ ID NO: 20881 - protein, 355 aa, Mus musculus
MAEVHRRQHAPVKGEAPAKSSTHRDEEELGMAPAETLTVFLKLLAAGFYGVSSFLIVVVNKSVLTNYRFPSSLCVGLGQMVATVAVLWVGKTLRVVKFPDFDRNVPRKTFPLPLLYFGNQITGLFSTKKLNLPMFTVLRRFSILFTMFAEGALLKKTFSWGIKMTVFAMIIGAFVAASSDLAFDLEGYVFILINDVLTAANGAYVKQKLDSKELGKYGLLYYNALFMILPTLAIAYFTGDAQKAMEFEGWADTLFLLQFTLSCVMGFILMYATVLCTQYNSALTTTIVGCIKNILITYIGMVFGGDYIFTWTNFIGLNISIAGSLVYSYITFTEEQLSKQSEASNKLDTKGKGAV

SEQ ID NO: 20882 - protein, 552 aa, Mus musculus
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEVEARRLFQQILSAVDYCHRHMVVHRDLKPENVLLDAQMNAKIADFGLSNMMSDGEFLRTSCGSPNYAAPEVISGRLYAGPEVDIWSCGVILYALLCGTLPFDDEHVPTLFKKIRGGVFYIPDYLNRSVATLLMHMLQVDPLKRATIKDIREHEWFKQDLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWHLGIRSQSKACDIMAEVYRAMKQLGFEWKVVNAYHLRVRRKNPVTGNYVKMSLQLYLVDSRSYLLDFKSIDDEVVEQRSGSSTPQRSCSAAGLHRARSSFDSSTAENHSLSGSLTGSLTGSTLSSASPRLGSHTMDFFEMCASLITALAR

SEQ ID NO: 20883 - protein, 142 aa, Mus musculus
MVLELLDKYLIANATNPESKVFYLNMKGDYFRYLAEVACGDDRKQTIENSQGAYQEAFDISKKEMQPTHLIRLGLALNFSVFYYEILNNPELACTLAKTAFDEAITELDTLNEDSYKDSTLIMQLLRDNLTLWTSDSAGRRM

SEQ ID NO: 20884 - protein, 621 aa, Ciona intestinalis
MDSDPDDCIFEGDENEEVIGQQRMDSPQHMEIANGSNNDDSSNDEVMDDNLPAAMMMQGVPVSIGIDNHPTASSNVSNSNPMQHQSVTLSILPASHNIQSLQDRIDVRNTNLDSGPILTNDTNYNPAQTVLSPRLRKLSQQLSLSENYKNERDSCTKHFDTWSEQEQVDFVEHLILRMCHYQHGQINCFLKPMLQRDFISALPARGLSHVAENILTYLDAKSLGAAELVCREWYRVVQDGHLWKRLIERMVSTHSLWKGLSERMGWGQHLFKGKPENSVPDSFFRSLYPSIISDIEKIESNWRCGRHDLKRIMCRSDNSKGVYCLQYDDDKIVSGLRDNTIKLWDRRTLENTKVLTGHTGSVLCLQYDERVIITGSSDSTVRVWDVNSGDLVNTLVHHCEAVLHLRFDNGLMVTCSKDRSIAVWDMVSAKEINMRRVLVGHRAAVNVVDFDDKYIVSASGDRTIKVWNTLTCEFVRTLNGHRRGIACLQYRDRLVVSGSSDNTIRLWDIEFGACLRILEGHEELVRCIRFDNKRIVSGAYDGKIKVWDLQAALDPRSPSSTLCLRTLVEHTGRVFRLQFDEFQIVSSSHDDSILIWDFLDVPQAPTEATKSPNRTYTYVQR

SEQ ID NO: 20885 - protein, 324 aa, Ciona intestinalis
MASDANKVDIRTKFDLKEVLGTGAFSKVFLAENRKSGNRVAIKCIPRKLIKGKEDSINNEISVLRSLKHCNIVELLEIYDNPSHLYLVMQLVSGGELFDRIVEKGSYTEKDASHLISQILDAIDYLHSKDIVHRDLKPENLLYHSTAEDSKIMISDFGLSKVEVEGQMLKTACGTPGYVAPEVLKQKPYGKEVDVWSIGVIAYILLCGYPPFYDENDQKLFEQIMKAEYEFDSPYWDDISQSAKTFISRLMHKNPHQRYTCKQALNDPWIAGDAAGSKDIHGHVSQNIKKNFARNKWRQAINVATATARMKKLNLATQTLKNST

SEQ ID NO: 20886 - protein, 530 aa, Drosophila melanogaster
MSSLRPEEARKLATAASVSPLSNCQFCGVVISSIADEQKLEFTNKYKGSCTLLCSYDSQGVVLRVVSDDDRSHVLKEYMIAADTDAAQMGRRSYAVSLDADNLVLRFASEQDQQLFRKVVGNVKHLRPKSVFSQRTEESSASQYFQFYGYLSQQQNMMQDYVRTSTYQRAILGNAVDFQDKIVLDVGAGSGILSFFAVQAGAAKVYAIEASNMAQYAQQLVESNNVQHKISVIPGKIEEIELPEKVDVIISEPMGYMLYNERMLETYLHARKWLKPQGKMYPTHGDLHIAPFSDESLYSEQYNKANFWYQSAFHGVDLTTLHKEGMKEYFRQPIVDTFDIRICMAKSVRHVCDFLNDKEDDLHLISIPLEFHILQTGICHGLAFWFDVEFSGSSQNVWLSTSPTAPLTHWYQVRCLLPMPIFIKQGQTLTGRVLLEANRRQSYDVTIDLHIEGTLISSSNTLDLKNPYFRYTGAPVQAPPGTSTQSPSEQYWTQVDTQGSRNSSSMLNGGISVNGIGEGMDITHGLMHPH

SEQ ID NO: 20887 - protein, 504 aa, Proteus sp. LE138
MSKDNKKAGIEPKVFFPPLIIVGILCWLTVRDLDASNEVINAVFSYVTNVWGWAFEWYMVIMFGGWFWLVFGRYAKKRLGDEKPEFSTASWIFMMFASCTSAAVLFWGSIEIYYYISSPPFGMEGYSAPAKEIGLAYSLFHWGPLPWATYSFLSVAFAYFFFVRKMEVIRPSSTLTPLVGEKHVNGLFGTVVDNFYLVALILAMGTSLGLATPLVTECIQYLFGIPHTLQLDAIIISCWILLNAICVAFGLQKGVKIASDVRTYLSFLMLGWVFIVGGASFIVNYFTDSVGTLLMYMPRMLFYTDPIGKGGFPQAWTVFYWAWWVIYAIQMSIFLARISKGRTVRELCLGMVSGLTAGTWLIWTYSGGNTLQLIDQNILNIPQLIDQYGVPRAIIETWAALPLSTATMWGFFILCFIATVTLINACSYTLAMSTCRSMKEGAEPPLLVRIGWSVLVGIIGIILLALGGLKPIQTAIIAGGCPLFFVNIMVTLSFIKDAKVHWKD

SEQ ID NO: 20888 - protein, 8943 aa, Drosophila melanogaster
MGVAEDFAPSFVKKPQLHQEDDGNRLIFECQLLSSPKPDIEWFRSDNKVVEDVRTKFKIQPVGENKYTVVLELDDVVETDAGLYKVKAKNKSGEVSASINLNFTPADEPKEKQIDGFAPTFAKKPAIRQEEDGKRLLFECRVNADPIPAIIWFHNGAAVKESERHKITVDKDVHSYFATLEILNVTVEDAGKYKVNAKNELGESNATISLNFDNLVIGAYSHFQIALYGYFNSIGDEAPVPESAEGIKPTFTERPVIRQSEDGGNVTFECRCVGDPTPTVTWSHGETELNESNRYKMSLTMDQKLYHIACLEISSVVSSDQGEYRAQAKNKHGSGVATINLNFESGSKKIPDGKSPRFPKKPTIRQEEDLLIMECVLEAHPVPDIVWYCSEKEICNNQRTKMTRKAITKDSYILTLEIQNPTKEDGGNYRCNAINMYGESNANIALNFQGASDANGFAPSFIEKPRIIPNESGTLITMKCKCKAKPEPTVTWYRGQDLVEKSKKIKINTTVIAEDTYELTLEIKDPGATDGGTYRCNVKNEYGESNANLNLNIEAEPEPEGEGPTFIEKPRIVSENNGKLVIMECKVKADPKPDVIWFRNGEVIKESNKIKTFIEQRGDQYYIKLELLDPQLEDSGLYKCNIKNTLGELNANLTLNIEIVPVIKDKPKIIKIIKKRTVVIECTVASKFEPKCTWYKETSTVKESKRHVYQVEQTKEGEFAVKLEINDVEESDKGAYKLVASNEKGEAVSQIVNLVDIPEEERKPCKPEISRKLADQKVAESKTFELLVSLSQTDRKCKVEWYKGSTVIRETKDITTTFDGTTARLTFSSARTEHTSNYKVIVTNEVGKDESSCKITVEKVAKKKEEKPKEKEKTKNEKEVEQKEMEEDKNESGQSVAQTEGRINIEQISEGDPKEELTVKEEILDKRDTQEVKESSVELQDSAGHEVPEPKKATSDSKLDQSNQKNLDKKHKTDQSESKTNKNVSLAEPIKSNKQESEEQQATEQIGLKKVDRKASIVSVKEEISSDVRRKSTIKAKEEITVDDKKASSRRSSLAVEESNTESRRSSIIDKKPLEQVDNKPIDANKNPQPLKEEIPRLKPAEKRRTSKVIEEPKPDEGLPKLRKASIAQVKEEAKPAAPKLKAKAKAKPKYEELPEIPDYERPQLEKYEKSDFTPSDFARDLEIPNKMEKPIIDSGKKEPAVLAQKNGIPKKTDIIEQYADEPKGLKVGKGKLPDEGDGRDGAVLKPVIIEPEKEILDLGNKKNNQHADKPTVLDIIKQRRRSSIRNLMTKEPIQNESFLGVVLKPVIKDTREQAAPQQAIQLTKANATEQFSPTKAVKAQVADLKKPETLATLEDNYERPVLEKYDPFSIDKTKSEKSTPSIITPDIRGPEVKLPVQETKEEKQKVPKMQPPAPGDPPKIEVIREKRPSLAPEPPSRRGSLIPPADTGRRPSLIINDEKKLRPGEVMDTRRRRPSIDVRRPSVQDLEDLINKPSTPLRDVGDGGPPSIVDVQESYSVVEDSTAYLTVGVEGSPAPTFKFYKGVSEILEGGRFKFLTDGQTNTITLCMRKCKPNDESKYKIVVSNIHGEDSAEMQLYVSDSSGMDFRAMLKKRRYQKWDKDEQDPNWGDLKETEKPLPALKKVERKVESFLSPLIDQFAKEGKDKKVVFEARFSKPNCKPKWLFRKDEVFTGSKFKFKQENDTYQLIITTPKVEDTGKYTIEIGGVSSTAFLNVEEADPTYTFTKPLKKKLEGFTQHETTLECSVSSSMANVHWFKNNTKLESDDPRYLISKDINGNLKLIIKDSVLDDAGLYRCQLDKQPDKTECNLKVTEYPYKFVKVLKSQQCIEKDTVTLACEIDDAMGEVQWLRNGEEIKPDKRIQIVKDGRKRKLVIKDCKVTDAGQFKCTTNADTTESEIIINYQNRFNKKLKDTEAVEREKLILDIELQDQTAPCDWKFNGEPIVPSESIEIKNMGGGKHQLIFSSLDMSNEGEITCESGQLSSKCKLSIRKGESRPNIDCPDKFSGPISAPVLLEVPFKVSGTKQTPVEAKLFKDGKPLPVKDVEVAVTDDKVTFKIKKPSRDLSGPYQIKISNGQGEDTKDVQIICQDVPQPPQDVDITDVYQTSCVVSFNPPSDDGGTPITKYVIERQDLSKKHGWESVAEVLPSEPCLKKIDDLIPKKQYRFRIRAVNAIGQSDPATFKNTILAKDPWDEPGKPKAVDLTDWDKDHADLKWEAPETDGGDPITAYIVEYKEKFSNDWVSGKEVDGDARTATVDGLKEGQQYEFRVRAVNRAGPGEPSDKTKSIIAKCRFVKPFIVGEGLKNVTVKKGQTIRFDIKYDGEPEPAATWVKGTDNLKFDNQRICLDQLERNSSITIKKSVRKDTGKYKLVLSNSSGTIESEAQVVVLDRPLPPGGPFEPEEIRASHIKMKWKRPDDDGGCEISGYALERMDEETGRWIPAGEVGPNETSFDFKGLTPNKKYKFRVKAINKEGESEPLETFDAIVARNPYDPPSPPSQPVIDDYDNKSVLLKWKRPPSDGGRPITHYIVEIKDKFAPSWSEVAKTDDPNPECNVEGLKEKMVYQFRVRAVNKAGPSEPSQPTDNHLCKHKNLKPQIDRSTFKRVTIKSGRTHKWSVDVLGEPIPELHWSWRDDIPLTNGDRIKIENVDYHTDFSITNVLRKDSGFYTLKAENRNGIDRETVELVVLGKPSSPKGPLAVSDVTASGCKLQWKKPEDDGGVPIKEYVVEKMDTATGKWVRVGRSPGEKEPPSFDVTGLSLGSEYMFRVSAVNEEGESEPLTTLVGVVAKDPFDEPNKPGTPEVTDYDNQSISLKWAAPNNDGGAPIQKYIIEKKNKNKTEWEKALEIPGDQLEATVAGLQEYGEYQFRVIAVNKAGLSPPSDASVPQIVKYKKLKPRIDRSNLKPLLIRAGKPIRYDVNVRGEPAPVITWYQNDKELKPEELPSSSEIKNIPYNTKISIIETVRKHTGIYKIIAVNEHGQDEATVEVNILAPPSKPRGPLDVKDVTKDSCKLKWKKPEDDGGKPISAYQVEKFDKKQGRWVPLGRTSANDTEFDVKGLQEGHEYQFRVKAINEEGESDPLDSDDSIIAKNPYDAASKPGTPNIVDYNEHMVKLKWEAPRSDGGAPISGYIIEKKDKFSPIWDEILSTNTSVPEATVEGLVEGNIYQFRVRAVNKAGFSDPSDATEPHLAKPRNLKPYINRDKMKPIKVRAGQPVKFDVDVKGEPAPSLTWFLKETELTSTGQVRLENIDYNTKLTLLDTDRKQSGQYKLRAENINGVDEAVVEVIILDKPSKPEGPIEVSDIHKEGCKLKWRKPKDDGGIPITGYVIEKMDTATGKWVPAGSVDPEKYDIEIKGLDPNHRYQFRVKAVNEEGESEPLETESAITAKNPFDVSAPPGLPELEDWDEHHVKLKWEPPIRDGGSPITNYIIEVMDKDSGEFVKAVETDSPVCKGVVKKLEEGQQYKFRVRAVNKAGPSDPSEQTNWHVAKPRFLKPHIDRVNLKPVIVKTGLSISLDINIRGEPAPKVEWFFNNSSVTSDEHSVKIDNVDYNTKFFVMRAQRSQSGKYIIKATNEVGEDEAELEVTVLGKPGKPKGPLQVNDITKHSCKLKWEKPDDDGGSPIDYYEIEKLDPHTGQWLPCGKSTEPEAKVIGLHEGKAYKFRVRAVNKEGESEDLETEKPIIAKNPYDEPDRPGKPEPTNWDKDFVDLAWDPPKNDGGAPIQKYVIQMRDKSGRAWVDSATVPGDKCNGTVTGVEEGHEYEFRIVAVNKAGPSDPSDVSKSVIAKPRFLKPHIDRKNLQKKIMRSGQMLHIDALIKAEPPAKVTWTYNKTEIKTSDHIKIENEDYKTTFIMPKVKRADRGIYIVTAKNDSGSDTVEVELEVLCKPSKPKGPLAVSNVTAETLHLKWEKPEDDGGDPIEQYLVERMDTETGRWVPVLTTKTPEADVTGLTEGKEYLFRVKAVNSEGESEPLVTDIPTKAKNPFDAADTPGKPQIVDWSGNHCDLKWRAPEDDGGASITGYIVERKDPNTGKWQKALETSTPDCKARVNDLIAGNKYQFRIMAVNKAGKSKPSEPSDQMTAKDRFAPPKIDRTNIKDITIKAGQHIRFDIKVSGEPPATKVWLHNKARLENDDSNYNIDMESYRTKLTVPISKRFHSGKYTLKAENESGRDEASFEVIVLDKPGPPEGPLRVTDVHKEGCKLKWNAPLDDGGLPIDHYIIEKMDVESGRWLPSGRFKESFAELNNLEPSHEYKFRVLAVNTEGESEPLTGEQSVIAKNPFDEPGKPGTPEAVDWDKDHVDLVWRPPINDGGSPITGYVVEKREKGTDKWIKGTEITIPCLGEECKATVPTLNENCEYEFRVKAINAAGPGEPSDASKPIITKPRKLAPKIDRKNIRTYNFKSGEPIFLDINISGEPAPDVTWNQNNKSVQTTSFSHIENLPYNTKYINNNPERKDTGLYKISAHNFYGQDQVEFQINIITKPGKPEGPLEVSEVHKDGCKLKWKKPKDDGGEPVESYLVEKFDPDTGIWLPVGRSDGPEYNVDGLVPGHDYKFRVKAVNKEGESEPLETLGSIIAKDPFSVPTKPGVPEPTDWTANKVELAWPEPASDGGSPIQGYIVEVKDKYSPLWEKALETNSPTPTATVQGLIEGNEYQFRVVALNKGGLSEPSDPSKIFTAKPRYLAPKIDRRNLRNITLSSGTALKLDANITGEPAPKVEWKLSNYHLQSGKNVTIETPDYYTKLVIRPTQRSDSGEYLVTATNTSGKDSVLVNVVITDKPSPPNGPLQISDVHKEGCHLKWKRPSDDGGTPIEYFQIDKLEPETGCWIPSCRSTEPQVDVTGLSPGNEYKFRVSAVNAEGESQPLVGDESIVARNPFDEPGKPENLKATDWDKDHVDLAWTPPLIDGGSPISCYIIEKQDKYGKWERALDVPADQCKATIPDLVEGQTYKFRVSAVNAAGTGEPSDSTPPIIAKARNKPPIIDRSSLVEVRIKAGQSFTFDCKVSGEPAPQTKWLLKKKEVYSKDNVKVTNVDYNTKLKVNSATRSDSGIYTVFAENANGEDSADVKVTVIDKPAPPNGPLKVDEINSESCTLHWNPPDDDGGQPIDNYVVEKLDETTGRWIPAGETDGPVTALKVGGLTPGHKYKFRVRAKNRQGTSEPLTTAQAIIAKNPFDVPTKPGTPTIKDFDKEFVDLEWTRPEADGGSPITGYVVEKRDKFSPDWEKCAEISDDITNAHVPDLIEGLKYEFRVRAVNKAGPGSPSDATETHVARPKNTPPKIDRNFMSDIKIKAGNVFEFDVPVTGEPLPSKDWTHEGNMIINTDRVKISNFDDRTKIRILDAKRSDTGVYTLTARNINGTDRHNVKVTILDAPSVPEGPLRNGDVSKNSIVLRWRPPKDDGGSEITHYVVEKMDNEAMRWVPVGDCTDTEIRADNLIENHDYSFRVRAVNKQGQSQPLTTSQPITAKDPYSHPDKPGQPQATDWGKHFVDLEWSTPKRDGGAPISSYIIEKRPKFGQWERAAVVLGDNCKAHVPELTNGGEYEFRVIAVNRGGPSDPSDPSSTIICKPRFLAPFFDKSLLNDITVHAGKRLGWTLPIEASPRPLITWLYNGKEIGSNSRGESGLFQNELTFEIVSSLRSDEGRYTLILKNEHGSFDASAHATVLDRPSPPKGPLDITKITRDGCHLTWNVPDDDGGSPILHYIIEKMDLSRSTWSDAGMSTHIVHDVTRLVHRKEYLFRVKAVNAIGESDPLEAVNTIIAKNEFDEPDAPGKPIITDWDRDHIDLQWAVPKSDGGAPISEYIIQKKEKGSPYWTNVRHVPSNKNTTTIPELTEGQEYEFRVIAVNQAGQSEPSEPSDMIMAKPRYLPPKIITPLNEVRIKCGLIFHTDIHFIGEPAPEATWTLNSNPLLSNDRSTITSIGHHSVVHTVNCQRSDSGIYHLLLRNSSGIDEGSFELVVLDRPGPPEGPMEYEEITANSVTISWKPPKDNGGSEISSYVIEKRDLTHGGGWVPAVNYVSAKYNHAVVPRLLEGTMYELRVMAENLQGRSDPLTSDQPVVAKSQYTVPGAPGKPELTDSDKNHITIKWKQPISNGGSPIIGYDIERRDVNTGRWIKINGQPVPTAEYQDDRVTSNHQYQYRISAVNAAGNGKTSEPSAIFNARPLREKPRFYFDGLIGKRIKVRAGEPVNLNIPISGAPTPTIEWKRGDLKLEEGKRISYETNSERTLFRIDDSNRRDSGKYTVTAANEFGKDTADIEVIVVDKPSPPEGPLSYTETAPDHISLHWYSPKDDGGSDITGYIIEFTEFGVDDWKPVPGTCPNTNFTVKNLVEGKKYVFRIRAENIYGASEALEGKPVLAKSPFDPPGAPSQPTISAYTPNSANLEWHPPDDCGGKPITGYIVERRERGGEWIKCNNYPTPNTSYTVSNLRDGARYEFRVLAVNEAGPGHPSKPSDPMTAEHQRYRPDPPEPPKPDRITRNGVTLSWRPPRTDGKSRIKGYYVEMRPKNGKDWKTVNDIPINSTVYTVPSLKEGEEYSFRVVAENEVGRSDPSKPSQPITIEEQPNKPCMELGKVRDIVCRAGDDFSIHVPYLAFPKPNAFWYSNDNMLDDNNRVHKHLTDDAASVVVKNSKRADSGQYRLQLKNTSGFDTATINVRVLDRPSPPTRLRADEFSGDSLTLYWNPPNDDGGSAIQNYIIEKKEARSSTWSKVSSFCTVPFVRIRNLVLNKEYDFRVIAENKYGQSDPANTSEPILARHPFDIPNTPGIPHGIDSTEDSITIAWTKPKHDGGSPITGYIIEKRLLSDDKWTKAVHALCPDLSCKIPNLIENAEYEFRVAAVNAAGQSAYSGSSDLIFCRRPPHAPKITSDLSIRDMTVIAGDEFRITVPYHASPRPTASWSLNGLEVIPGERIKFDSNDYASMYYNKSAKRDETGSYTITLTNNKGSDTASCHVTVVDRPLPPQGPLNAYDITPDTCTLAWKTPLDDGGSPITNYVVEKLDNSGSWVKISSFVRNTHYDVMGLEPHYKYNFRVRAENQYGLSDPLDIIEPIVAKHQFTVPDEPGQPKVIDWDSGNVTLIWTRPLSDGGSRIQGYQIEYRDILNDSSWNAYDYIIKDTKYQLYNLINGSEYEFRIKAKNAAGLSKPSSPSLRFKLKGKFTVPSPPGAPQVTRVGKNYVDLKWEKPLRDGGSRITGYIIERRDIGGAVWVKCNDYNVLDTEYTVMNLIEMGDYEFRVFAVNSAGRSEPSLCTMPIKVCEVLGGKKPDWITRLQDKVAPFGKDYTLQCAASGKPSPTARWLRNGKEIQMNGGRMTCDSKDGVFRLHISNVQTGDDGDYTCEAMNSLGFVNTSGYLKIGSPPIINRCPSELKLPEGDNSKIKIFYSGDQPLTVILKKNNEVICDSNDDTHVKVNIFDDYVAIYIRNIVKSDGGPYQIEFTNESGSATGEFYVHITGMPSAPTGPMGISYINKNSCMLNWRPPSYDGGLKVSHYVIERKDVSSPHWITVSSTCKDTAFNVQGLIENQEYIFRVMAVNENGMGPPLEGLNPIRAKDPIDPPSPPGSPQITEIGGDFVHLEWEKPESDGGAHIQGYWIDKREVGSNTWQRVNATICAANQINCINLIEGRQYEFRIFAQNVAGLSTESSASQAVKIIDPQAASPPLIVKPLRDANCIQNHNAQFTCTINGVPKPTISWYKGAREISNGARYHMYSEGDNHFLNINDVFGEDADEYVCRAVNKAGAKSTRATLAIMTAPKLNVPPRFRDTAYFDKGENVVIKIPFTGFPKPRIHWVRDGENIESGGHYTVEVKERHAVLIIRDGSHLDSGPYRITAENELGSDTAIIQVQISDRPDPPRFPLIESIGTESLSLSWKAPVWDGCSDITNYYVERREHPLSSWIRVGNTRFTSMAVSGLTPGKEYDFRIFADNVYGRSDASDTSTLIKTKESVKKKPIERKWEIDANGRKLRGKADGPVKDYDSYVFDIYSKFVPQPVEISQQSVYDRYDILEEIGTGAFGVVHRCRERSTGNIFAAKFIPVSHSVEKDLIRREIDIMNQLHHQKLINLHDAFEDDDEMILILEFLSGGELFERITAEGYVMTEAEVINYMRQICEGIRHMHEQNIIHLDIKPENIMCQTRSSTNVKLIDFGLATRLDPNEVVKITTGTAEFAAPEIVNREPVGFYTDMWATGVLSYVLLSGLSPFAGDNDVQTLKNVKACDWDFDVESFKYISEEAKDFIRKLLVRNKEKRMTAHECLLHPWLTGDHSAMKQEINRDRYLAYREKLRRKYEDFERFLLPIGRLSEYSSLRKLLMEKYKIHDAVFDRRQAAPRFVIRPSSQFCYEGQSVKFYCRCIAIATPTLTWSHNNIELRQSVKFMKRYVGDDYYFIINRVKLDDRGEYIIRAENHYGSREEVVFLNVQPLPKEQPRYRTESTPVRRREPLPYTFWQEESETAPSFTFLLRPRVMQARDTCKLLCCLSGKPVPNVRWYKDGRELSKYEYAMTHSDGVVTMEIIDCKPSDSGKYSCKATNCHGTDETDCVVIVEGEWVTPEQAQLAHNFLYSGDRKYIEQPIKPAPLPIVTSRQYTSSSVQNTSEPQGDKVNVSNSNSSGISNKKKYASNSLQAPGSPSRSRSATKELILPPDDSLMCKPEFTKPLHDLTIHDGEQLILTCYVKGDPEPQISWSKNGKSLSSSDILDLRYKNGIATLTINEVFPEDEGVITCTATNSVGAVETKCKLTIQPLDKNINKRKVNAGDNAPKIVSHLESRFVRDGDAVNLACRIIGAQHFDVVWLHNNKEIKPSKDFQYTNEANIYRLQIAEIFPEDGGTYTCEAFNDIGESFSTCTINVTVPGDETKQPSFVKFPTSVSVLEGEGTTFECEIDSELLNLVWLKDGKPIDETLPRYSFTKDGHRYSFAVAKCNMDDVGQYQAKAVSGKAESICAFSMNVHTAES

SEQ ID NO: 20889 - protein, 320 aa, Ruegeria sp. PR1b
MSWNPTHTPECPTFGCDALETLIIPRARDLGGFDVRRALPSPNRQMVGPFIFFDQMGPAEFITEGGIDVRPHPHIGLGTVTYLYNGEFEHRDSIGTHQMIYPGEVNWMVAGKGVTHSERTSAETRATRHKLFGIQTWIALPEDREEMEPDFEHHKEAALPVLRDNGAHARLILGSAYGETSPVTMQSETFYLDVQLEPGAAFPLPDNHEDRGIYITQGSIEVAGDQFDEGRMMVFRPGDKISVKAGPAGARLMALGGATMNEERYIWWNFVSSSKDRIEQAKEDWKAGDWTKGPFRLPPGDDAEFIPITAELDQTSPNRM

SEQ ID NO: 20890 - protein, 499 aa, Ruegeria sp. PR1b
MNAASFTKSFWHDEAKKLEFRTKHLINGEWVDSEDGTTFDTINPATGETIAKVASGKAADIDKAVKNARETFKSGVWSMLAPRERLAVIERFSALIEENAVEFALLDCLDMGKPVMDMINIDIPESVKNLKFFAETADKVHGSLTATDPSVVHYILRQPLGVVGLITPWNYPLMMAAWKLGPALITGNSVVLKPAEQAPLSCALLGDLFLKAGGPAGVLNVVQGLGEEAGKAIGLHPDVDKIGFTGSTEVGKLLMTYAGQSNMKRVTTECGGKTPQIVFADYDNLDKAVTSAVYGIYGNMGEMCNAGSRILVQRPIYDEFIKRFSELTASNMVVGDPLDPDTTIGPLVTVEQQERVLEYIEIGKKEGATLALGGGRGLNSGCYVEPTLFTDVTNSMRVAQEEIFGPVGTVIPFDTAEEALEIANDSLYGLAAAVWTNDLKTAHRFGRDLESGFVWVNTFDIGDMTSIWGGYKQSGNGRDTCIEALSQYTQTKSVWMDMA

SEQ ID NO: 20891 - protein, 1186 aa, Human herpesvirus 4 type 2
MKKAWLSRAQQADAGGASGSEDPPDYGDQGNVQQVGSDPISPAIGPFELSAASEDDPQSGPVEENLDAAAREEEEPDEQEHNGGDDPLEVHTRQPRFVDVNPTQAPVIQLVHAVYDSMLQSDLRSLGSLFLEQNLNIEEFIWMCMTVRHRCQAIRQKPLPIDKQRRWKLLSPYRTWRMGYRTQTLNVNSFETGGDKVHPLLVTATLGCEEGLRHAITYSAGIVQLPRMSDQNQKIETAFLMARRARSLSAERYTLFFDLVSSGNTLYAIWIGLGTRNRVAFVEFVGWLCKKDHTHIREWFRQCTGRPSPSKPWMRAHPVAVPYDDPLTSEETDLAYARGLAMSIEAARLPDDPIIVEDDDESEEIEDKCDKDEEESGTEDVTSIPQTLPHSPTVYGRPSVFYRKPDTKSTKKCRAIVTDLSIIKVIEDEHRKKKTARTEQPRAKPDSPAPTVVLRRPPTQKVTGPAGSLSVQAQLEPWQPLSWPHETRVILHGPPTQGDQAHGSMLDLLEKDDQHMEQQVMATLLPPEPHQPRSGRRAPCVYTADLDIESDEPATSEPVLDQLLPAPGLGPLAIQPLTSPTTSQLRSSAPSHAQTPWPVTHPSQTPGGPTTQSLAPETEAPRQWPMPLRPIPLHPLRMQPISFNPAVRPTPHQPPQVEPTFYQSTWVKPPQQYQPQMGHIPYQPRPTGHSTMLRPQWAPTTMQPPPRAPTPMPPPQGTPTAMQRPQGAPTPMPPPQGTPTAMQRPQGAPTPMPPPQGTPTAMQRPQGAPTPMPPPQGTPTAMQRPQGAPTPMPPPQGTPTAMQRPQGAPTPMPPPQGTPTAMQRPQGAPTPMPPPQGTPTAMQRPQGAPTPMPPPQGPLTAMQRPQGAPTPMPPPQGPPTAMQRPRGAPTPMPPPQGPLTAMQRPQGAPTPMPPPQGTPTAMQRPQGAPTPMPPPQGPLTAMQRPQGAPTPMPPPQGPPTAMQRPRGAPTPMPPPQGPLTAMQRPQGAPTPMPPPQGPPTAMQLSPRALTGQKGPAKHILRQLLTGGVKSGRPSLKFKAALERQAAAGLRPSPGSGTGAKIVQAPVFYPPVLQPIQVMWQVGSSKAVAASTVTQAPTEYTGERRLGGPMSPTDIPPSKRVKKKAYPERKTPHGGPSHSSTVMWENVSQGQQQTLECGGTDKQERNMLGMGDIAVSSPSSSETSNDE

SEQ ID NO: 20892 - protein, 447 aa, Oceanobacillus iheyensis HTE831
MYQTTTLKDKIKLFIIILLPILITQVSINLMSFFDTMMSGQFSARDLAGVAIGSSLWVPILTGINGIVLSITPIIAHLIGAKNKKDIPQVIQQGIYLSFVLSIIIIVIGGIALDPILQAMSLEKEVQRIAKYYLITLGTGIVPLFLFHTIRSFMDGLGQTRSSMIIILISLPINAVLNYILIFGKFGIPAFGGIGAGIATSLTYWIISGISIFMIHRVYPFHSYKVFQKILPPTLSYWADQLKIGLPIGLAIFFETSIFSAVTLLMSEYNTNTIAAHQAAMNFASLLYMLPLSVGMALTIAVGFEVGAKRLHDAKRYTYLGIMGGLFIAIFAGIILYTFDDVVARLYNSNPEVIELTKQFIIFAIFYQLADAIGAPIQGALRGYKDVNMTLVIALISYWIIGLPTGYLLANYTALEPFGYWVGIIVGLSTGAIALLARLLFIQKKSV

SEQ ID NO: 20893 - protein, 573 aa, Saccharomyces bayanus
MLSKSEKHIDLLAGNMSNLSFDGPGTPSSTGLFNVNQNNTNRRMRPTGFNDSPSPIKSSLFPHEDSSNMDIDEVSQSDMDITNSPKKLPPKFYERATSNKTQRVVSVCKMYFLEYYCDMFDYVISRRQRTKQVLEYLQQQSQLPTADQAKLNEEWSSYLQKEHQVLRKRRLKPKNRDFEVITQVGQGGYGQVYLARKKDTKEVCALKILNKKLLFKLNETKHVLTERDILTTTRSEWLVKLLYAFQDLQSLYLAMEFVPGGDFRTLLINTRCLKSGHARFYISEMFCAVNALHDLGYTHRDLKPENFLIDAKGHIKLTDFGLAAGTISNERIESMKIRLEKIKDLEFPAFTEKSIEDRRKMYNQLREKEVNYANSMVGSPDYMALEVLEGKKYDFTVDYWSLGCMLFESLVGYTPFSGSSTNETYDNLRRWKQTLRRPRQSDGRAAFSDRTWDLITRLIADPINRLRSFEHVKRMSYFADINFSTLRSMIPPFTPQLDSETDAGYFDDFTSEADMAKYADVFKRQDKLTAMVDDSAVSSKLVGFTFRHRNGKQGSSGILFNGSEHSDPFATFY

SEQ ID NO: 20894 - protein, 304 aa, Saccharomyces bayanus
MSSNAQINTPLPPAPAPKKESNFMIDFLMGGVSAAVAKTAASPIERVKLLIQNQDEMLKQGTLDRKYGGILECFKRTAQQEGIISFWRGNTANVIRYFPTQALNFAFKDKIKAMFGFKKEEGYGKWFAGNLASGGAAGALSLMFVYSLDYARTRLAADSKSSKKGGARQFNGLVDVYRKTLKSDGIAGLYRGFLPSVVGIVVYRGLYFGLYDSLKPVLLTGSLEGSFLASFLLGWVVTTGASTCSYPLDTVRRRMMMTSGQAIKYDGAFDCMRKIIAAEGVSSLFKGCGANILRGVRRAGVISM

SEQ ID NO: 20895 - protein, 579 aa, Saccharomyces servazzii
MFSRTDKNVDTLAGDISQLSFDSPSSKLAYNANNNMTPLRQRDNNRFGVGAGMNMGTPTPSPTKSTVYDQENDSSAMMVDDEDNDDITNSPKKLPMDFYKKSSSNKTQRLVSVCKMYFLDYYCDMFDYVISRRQRTKKVMEYIEQQKVLNNVPVERLNTEWFGYLQQEHDVLRKRRLKPKHKDFEMITQVGQGGYGQVYLARKKDTKEVCALKILNKKLLFKLNETNHVLTERDILTTTRSEWLVKLLYAFQDPESLFLAMEFVPGGDFRTLLINTKYLKSAHARFYISEMFCAVNALHELGYTHRDLKPENFLIDAKGHIKLTDFGLAAGTVSNERIESMKIRLEEVKNLEFPGFKEKSIEDRRKIYHHMRETDVNYANSMVGSPDYMALEVLEGKKYDFTVDYWSLGCMLFESLVSYTPFSGSSSNETYENLRHWKQTLRRPRLDNGRPAFSDRTWDLITRLIADPISRLRSFEHVKRMPYFSDIDFDNLRNMSPPFIPQLDSETDAGYFDDFTNEADMAKYADVFKRQNKLSAMVDNSAVSSKLVGFTFRHRSGKQGSSGILYNGSEHSDPFATFY

SEQ ID NO: 20896 - protein, 144 aa, Saccharomyces servazzii
DVYTKTLKSDGIVGLYRGFGPSVVGIMVYRGLYFGLYDSLKPVLLTGTLENSFLASFLLGWCVTIGASTCSYPLDTVRRRMMMTSGQTVKYKNARDCMKQIVAKEGASSLFKGCGANIFRGVAAAGVISLYDQLQLILFGKKFK

SEQ ID NO: 20897 - protein, 553 aa, Saccharomyces castellii
MFPRSDKDVDQLVGNLNQLGLNKPNARFVSVTPTRANKENRSSLSPSPSPNKTKRFTADETELKNSPKKLPHDFYKKALSNDTKRIVNVCQMYFLDYYCDMFDYVISRRQRTKSVLNYLERNQNSLSTEELNNEWTAYLQQEHDVLRKRRLKPKNKDFEMITQVGQGGYGQVYLARKRDTKEVCALKILNKKLLFKLNETNHVLTERDILTTTRSDWLVKLLYAFQDTESLYLAMEFVPGGDFRTLLINTRFLRNTHARFYISEMFCAVNALHELGYTHRDLKPENFLIDSEGHIKLTDFGLAAGTISTERIQSMKIRLEEVKNLEFPAFTEKSIEDRRKMYTHLRQTEVNYANSMVGSPDYMALEVLEGKKYDFTVDYWSLGCMLFESLVGYTPFSGSSTNETYENLRHWKKTLRRPVLDNGRPAFSDRTWDIITRLIADPINRLRSFEHIKRMPYFAEVNFNTLRQSAPPFTPQLDSETDAGYFDDFTNEADMAKYADVFKRQNKLSSMVDDSAVDSKLVGFTFRHRNGQKGLSGILYNGSEHSDPFATFY

SEQ ID NO: 20898 - protein, 573 aa, Saccharomyces castellii
MSERKMENLTGTMHQLNFNLPNQPNRGSTSQFASLDNFSTPTKYKNDKLNGSPIPPGARRYEIDDSDSKMDIDGSSYNDIDITNSPKKLPQGFQTMASNNKTQRLVSVCKMYFLDYYCDMFDYVISRRQRTKKVLEYLEQKKNENVDLNSLNNEWNGYIQREHQVLRKRRLKPKHKDFEMITQVGQGGYGQVYLPGKKDTNEVCALKILNKKLLFKLNETNHVLTERDILTTTRSQWLVKLLYAFQDTQNLYLAMEFVPGGDFRTLLINTRFLKSTHARFYISEMFLAVNALHDLGYTHRDLKPENFLIDAKGHIKLTDFGLAAGTISNDRIQSMKVRLEEVKNLEFPEFSDKSIEDRRQMYQKYRETEVNYANSMVGSPDYMALEVLEGKKYDFTVDYWSLSCMLFESLVGYTPFSGSSTNETYENLRHWKKTLRRPMLDNGRPAFSDRTWDFITRLIADPINRLRSFEHVKRMTYFESVDFNTLRDLSPPFIPQLDNETDAGYFDDFTNEADMAKYADVFKRQNKLSTMVNDADIDSKLVGFTFRHRYGKNGSSGVLYNGLEQSDPFSTFY

SEQ ID NO: 20899 - protein, 1077 aa, Danio rerio
MTGAPWYHRDISRVRAEELLAHAGIDGSFLVRDSESVPGAYALCLLFQRHVHTYRILPDADGLLAVQATQGVQVNCFRTLGDLVLGYQNPNKGLVAPLLYPVMRESEANDESSVYETTSVSLCSVGCEIVSLLDEYLHGNVCKDLENLKGGASGLQHFQGILSHICDSLHSEIDQTLSSLETLAKVFDHPSGHLTFSTMQNTGKSPEENMDNLLQKLTTLCNLLSSLEKRKREAFCRLLQLMKTTHSQKSELDVISVFVGTWNMGGTPPPGSLQSWVTCSGLGLTPDESISSLPHDIYAVGTQDNPQGEREWAEHIRATLRTSTNIDYKQVAVQSLWNIRLAVFVKPEHEARISQVNTASVKTGLGNTLGNKGAVGVSLLFNGTSMGFVNCHLTSGSDKALRRNHNFQDILRLLSLGEKQLSTFDISLRFNHLFWCGDLNYRLDLDALDILKHVSKREFEELMCADQLTRERHKRKAFFNFKEEKIMFPPTYRYERGSRDCYLWQKYKSSGVQVNGPSWCDRVLWKSYPESHVICTSYGCTDDIFTSEHSPVFATFEVGVISQFPRTESCSERASIELEAIEAIVKTSSKAKFFIEFHSRCLEEPRRSAENDSQYCEVPGFLKLGWSSKQLPKLHPVFLDLEHLRDQHLLLSVKSCDGFESYGECCVALRPTAGKLLDTFETCLTHRGEEMGSIRGRFRVYVPPDRRRIRERVYEWLSIEKDEREMMKDQLSPPSSSAFSIKAPSASYVASPNSYTNPAYFIFEEMPVFRKAEEIPSTIKESQVVCANNTVIQLPRVTGSHGHGKRSARRSDFTEIEIPGSLAPYKPSCETQSELSSTASSYQLFPGPHVPSTSPNQRHTTHSSNSSLQLQSHKNNMAPDSELSGKKLTNSYMNHSVFSRDMHKEKVRQDYQGVHQGRPVPIRNGPKLYPYVSTRVPAQSSASWIVEQPTPASGDNSLTALQIAKSLSEVDFQPADKKYPFHQMPSQQRQHGYDYGLASERNYSWEKEVSVLHGAPETVRELLSTLGLQRYTLDLSRSGWDDLDYFSGITEEELCAAGVSNPSHRRRILENLPKIWD

SEQ ID NO: 20900 - protein, 455 aa, Oryza sativa (japonica cultivar-group)
MAAESSAAAAAGGGERRGPMDLNLYLGLPPLPPPPGRLDVAADYPSLLLNSAATVANEQRGSVVVAAPPPAAAAYSPSNALSAPEQVLVDPVAAWLVDPGEQQPVPPLETPSYMARASSTLPQIFACAALEMLVQTGGAIPPTGLIRGAEIAAASRPMTPENRLRRLIQVSDQHGVGNGRAGTGPVSRSRRANSPEADNLARAIQRSHNSLEASRRQMLDGDGSDATKKDDGCGCNGSFECNICFESAKDPVVTPCGHLFCWPCIYQWLHGHSEHSDCPVCKGEVLEVNVTPIYGRGGGEENSSRNDIQIPPRPSAQRTESLRQQLQRPDTRGGIANMVRRLMQNQDIVVGQAASSAPRPRGRGRRQARQDAPSAPATQQQVVNADAGSGNQAPLPPPDANGAAPAAAVAPQQSSSVEQASTSSTVGVIAGGPAQGRRSRVSESTPARRTRRRHQ

SEQ ID NO: 20901 - protein, 305 aa, Saccharomyces castellii
MSTEKPQSNFAIDFLMGGVSAAVAKTAASPIERVKLLIQNQNEMLKQGTLDTKYKGIVDCFRRTAQQEGIISFWRGNTANVIRYFPTQALNFAFKDKIKLMFGFKKEDGYGKWFAGNLASGGAAGGLSLLFVYSLDFARTRLAADSKSSKKGGSRQFNGLIDVYKKTLKSDGVAGLYRGFLPSVVGIIVYRGLYFGLYDSIKPVLLTGSLEGSFLASFLLGWVVTTGASTCSYPLDTVRRKMMMTSGQAVKYKGAFDCFKKIVAAEGVASLFKGCGANILRGVAGAGVISMYDQLQMILFGKKFK

SEQ ID NO: 20902 - protein, 308 aa, Saccharomyces castellii
MSSKEEVKKESNFAIDFLMGGVSAAVAKTAASPIERVKLLIQNQDEMIKQGSLDSKYKGIIECFQRTAKTEGIIAFWRGNTANVIRYFPTQALNFAFKDKIKAMFGFKKEEGYGKWFAGNLASGGAAGGLSLLFVYSLDYARTRLAADAKSSKKGGSRQYKGLIDVYKQTLATDGMAGLYRGFLPSVVGIIVYRGLYFGLYDSLKPAVLTGSLEGSFLASFLLGWIVTTGASTASYPLDTVRRRMMMTSGQAVKYDGAFDCFRKVVAAEGVSSLFKGCGANILRGVAGAGVISMYDQLQMIMFGKKFK

SEQ ID NO: 20903 - protein, 227 aa, Saccharomyces castellii
HVIRYFPTQALNFAFKDKIKAMFGFNKERDGYTKWFMGNVASGGCAGALSLLFVYSLDYARTRLAADAKSIKSGAPRKFNGILDVYKKTLFTDGVLGLYRGFLPSVVGIMVYRGLYFGLYDSLKPVLLTGSFENAFLPSFLLGWAVTISASTTSYPLDTVRRRMMMTSGQAVKYKGAIDCFQQIVSQEGVYSLFKGCGANIFRGVAAAGVISLYDQLQLLLFGRKFK

SEQ ID NO: 20904 - protein, 577 aa, Saccharomyces kluyveri
MFTRGVNGANRDIDALADNIGQLSFDASDPNKFIFEPTTPSKYKENGSTTGTPSPTKSTLYDDNAGDVSKLSMMDIDERTQDEIDVTKSPKKLPLNFYAKASSSKTKRLVNVCQMYFLDYYCDMFDYVISRRERTRQVMKYLEQQRGQGIQPQQISNEWQGYLNKETNTLRKRRLKPKNKDFEMITQVGQGGYGQVYLARKKDTKEICALKILNKKLLVKLNETNHVLTERDILTTTRSDWLVKLLYAFQDPQSLYLAMEFVPGGDYRTLLINTRFLQAPHARFYISEMFCAVDALHQLGYTHRDLKPENFLIDSKGHIKLTDFGLAAGTVSMERIESMKLRLEEVKNLEFPEFKERSMDDRRRMYKKLRESDVNYASSTVGSPDYMALEVLEAKSYDFTVDYWSLGCIMFESLVGYTPFSGSSTNETYENLRRWKQVLRRPRCENGRYAFSDRTWDLITRLIADPVNRVRSFEHVKRMKYFAEIHFDSLRSMSPPFIPQLDSETDAGYFDDFSNEADMAKYADVFKRQDRLTAMMDDSSADSKLVGFTYRHRKGKNGSSGVLYGGAEHADPFATFY

SEQ ID NO: 20905 - protein, 304 aa, Saccharomyces kluyveri
MAEKKQSNFAIDFLMGGVSAAVSKTAAAPIERVKLLIQNQDEMIKQGSLDRRYNGIVDCFKRTSEAEGVVSFWRGNTANVIRYFPTQALNFAFKDKIKAMFGFKKEEGYAKWFAGNLASGGLAGGLSLMFVYSLDYARTRLAADSKSAKKGGERQFNGLVDVYKKTLASDGVAGLYRGFLPSVVGIVVYRGLYFGLYDSLKPLLLTGTLEGSFFASFLLGWAVTTGASTASYPLDTVRRRMMMTSGQAVKYDGAFDAFRKIVAAEGIKSLFKGCGANILRGVAGAGVISMYDQLQMILFGKKFK

SEQ ID NO: 20906 - protein, 520 aa, Kluyveromyces lactis
MFTRDANGRHKEVDALVDDMVNFSFDTDAKVMLDPPSTPTRIRGSPSPTRSIVKNPENSLMDIDDDTQGDLTADITKSPKKLPKDFYKKSSKTKSKRLVSVCQMYFLDYYCDMFDYVISRRERTRQVINYLEEQRRSNLMGTEQITNEWQGYLTKETNILRKRRLKPKHKDFEMITQVGQGGYGQVYLARKKDTKEICALKILNKKLLMKLEGTDHVLTERDILTTTRSEWLVKLLYAFQDPQSLYLAMEFVPGGDFRTLLLNTKFLQAPHARFYISEMFCAVNALHQLGYTHRDLKPENFLIDSKGHIKLTDFGLASGTVSMERIESMKIRLQEVKNLEFPEFRERSMDDRRRMYNKLREEEVRYAHSTVGSPDYMALEVLEAKNYDFTVDYWSLGCILFESLVGYTPFSGNSTNETYENLRNWKHVLQRPKCDNGRYAFSDRTWELITRLIADPINRLKSFEHVKRMRYFSEIDFNTLRTIHPPFIPQLDNEEDVGYFDDFTNEEHMARYVDVFKRQD

SEQ ID NO: 20907 - protein, 190 aa, Chionodraco hamatus
DSWLGRFKTIVYLSIVYMLGQVVMAISAIHDLTDANMDGTPDNMTLHVALSMVGLILIALGTGGIKPCVAAFGGDQFLDHQEKQRSTFFSIFYLSINAGSLLSTVITPILRAQECGINTKQSCYPLAFGVPAALMVVALVVFILGSRMYIKTPPQGNIMVKVCTCIGFAVKNRFRHRSSQYPKRAHWLDW

SEQ ID NO: 20908 - protein, 385 aa, Phaeodactylum tricornutum
MKVATTLTLAFICCASAFGLNGQTTSVMKKVGFGAGSKPMVQAIDVQGNRLGSNMQPLKSAVANEDAPRGGATKSPVDIGLLLYFGLWYLGNYYYNITNKLALNAAGGKVGFPMTISSLQLGVGSIYALFLWLAPDARSRPKISMDDIVKMLPVALCFMGAHSASVFAMGMGAVQFAQIVKASEPAFAAVLSQFVYGKKSRRHKWLCLPIVIGGVILASVKELDFAWSALIAACIANMFAAVRGNENKKLMETPGLKDRIGTVGNQFAITTVLGFILSLPVLFLREGSRFGEFVQLAKTTPAIWMNLVASGLWFYGYNECATMTLKKTGAVTQSVANTAKRVIVIVGVALVLGESLSPIKLIGCSIGIGGVFLYSIIDNLVKPKK

SEQ ID NO: 20909 - protein, 570 aa, Bacillus sphaericus
MTHLACIAASDGIAIAKAYRFVQPNLTFSQTTVQDVQAEQQRLAAALAKTEQELRPSKQQTLKKFSAEEAAIFEAHLLVVKDSELIGPINQKTADEGVNAEFALHEVSSMFVALFESMDDEYMSARASDIKDVTNRILAHLLGAHIPNPSSISEQVIIVANDLTPSETAQLDRNFVLGFITDIGGRTSHSAIMGRSLEIPAVVGTGVATTTIQDGDILIVDGLSGQVFVNPTADVIVSYQEKAQSYHTQQAEWSTLVNEQTVSKDGVHVELAANIGSPGDLEGVLRHGAEGIGLYRTEFLYMGRENLPSEDEQFTAYQTVLEGMQGKPVVIRTLDLGGDKHLPYLPLQEEMNPFLGHRAIRLCLEQQELFRTPLRALLRASVYGNLKIMFPIIATIQEFRDAKAILLEEQEKLKAAGEEVSADIEIGMMVEIPATAVMADVFAKEVDFFSIGTNDLIQYTMAADRMNEKVSYLYQPYNPAFLRLIQMVIHAAHQEQKWVGMCGEMAGDELAVPLLLGLGLDEFSMSATSILKTRSLLKRLSVKDMQALATEALQVATAEEVMEKVKQAVK

SEQ ID NO: 20910 - protein, 2380 aa, Dictyostelium discoideum
MSQHEQPSIWADALTKLLNDLKSKKEEDRVKASKNLKSYVISQSREMTNENFTKFMNELNNNLIFELVNSSVIPEKIGGIMAIDELIDVDYDENATKITRLANYLRIGLGFNDFTVMLMASKALGRLARSSGTLTAEFVEFEVTRALEWLSGDRIEARRHAAVLVLKELAQNAPTLFYVHASSFVDLIWVALKDPKVAIREGAVEALRACLELISERESRLRLQWYQKIYDEAQKSFKQNGSPESIHGSLITVSELLRNTGDFMLSKFKDICETVLKYKDHRDKLVKKTVLALFPRLAVFCSRDFVLNYFNACMNHLLAALRNQNERPTAFIALGEIAMAVGGSIKPYLDSIVVMIKQGLMTKGKQFCPEVLTCISMLASAVGQSMYPHMQVILPQMIVSSGLTVVLTDALRDLTINLPTLIPNIQYKLLNLISQVLANKPFSEPGAPSPYRKSATPFQGGSIPQLGQNSDVDPQMIALALKTLGSFDFSKHNLLEFVRECVVNYLDDDNIEIRREAAITCAQLMVGTEEPTPTRGHSAVIVGEVLEKLLVVGIADPDPSIRKTVLSSLEARFDHYLAQAENLRSLFIALNDELFEIRELAITVIGRLTIRNPAYVMPSLRKTLIQLLTELEFSGDGRNKEESARLLGHLISASEKLIKPYVEPILKALLPKLRDSNPRVASCVLAALGELSVVGGEEMVQHIDSLLPLIIDTLQDQSSTSKREVALKTLAQLASSTGYVIKPFSKYPMLLDTLLNAIKTERIGSIRREVIKVLGILGSLDPYKHKMNELGKRREDPKANDDKNNNMTNEVITISPSNEDYYPTVALTALMKILRDPSLSSHHTSVIQAVMYIFKSLSLKSIPFLPQIMPPFLHAMNTGEPLFREFLFQQLGSLVSIVKQHIRDYLVNVFALIEKYWNSNLLIPIIKLVEEISSALNDEFKVYLPNLIPQMLNVLHTDRSPKRSPTTKVLRALEVFGTNLDDYLHLVIPAIVKLFEQVDVTTQVRTLAIQTIGRLCKKLNFSDYASRIIHPLARVLDSTESELREETLNTLCALVYQLGSDYAIFIPMVGKVLARREIQSTNYELLISKLLKNQQLMLTPGSGDDGGMGANRFGGDHNGHHLGEDHNNTSTPLDIGVKKLKANEQHLKNAWETSQRSTKEDWGEWIRRFSVELLRESPSPALRSCLSLAQDYHPLVKELFNAGFVSCWTELHEQFQEELVRSLETALLSPNIPPEILQTLLNLAEFMELHEKPLPIDIRTLGALAEKCHAYAKALHYKESEFSQSPSSTIEALISINNQLQQPEAAIGILIYAQKNHSVELKEGWYEKLRRWEDALAAYEKKQKDDPNGGTIENTMGILRCLHALGEWERLSALSSETWKSDINDHTRATIAPLAAAAAWNLVNWDKMDEYVCAMNKDTVEGSFYRAILEVHHDNFTLAHGFIDHARTLVDTELTALLGESYNRAYKVVVRLQQLSELEEIIEYKKCVDSPERRNMIKNTWKTRLRGCQHNVDIWQSILAVHSLVISPHEELDMWLKFVGLCRKGSRLGLAQKTLTMLMGKDPSTTSQFGSVLPNTHPRITFAYIKQLWSAGAKQPAFEKLRTFVQALRDTDDLPLQGRAYLKLGEWQLALGDTLSEASIPHIISSFKAATECDPNWYKAWHSWALINFEVVSHYEQNGGTPEQIGAHLLPAVHSFFKSISLGPDRSLQDTLRLLTLWFKHGAQKEVEAALMQGFNTISIDTWLHVIPQIIARIHAPVLPVRRLLHELIDTIGKEHPQALVYPLTVATKSHSPARLAAAKSLMDKMRKHSATLVDQALPVSQELVRTAILWLEMWYEGLEEASRQYFGDHNPEAMLATLAPLHQILEKGPETTSETSFLQAFGRDLQEALEWSKKYEKTRKEGDLNQAWDLYYQVFRRIYKQLPQMSSLELQYVSPKLLNSNNMELAVPGTYKASENVIRIQSFSQALSVIPSKQRPRKLTIIGSDGLEYTFLLKGHEDLRQDERVMQLFSLVNNLLSANHETAKSHLSIRRFSVIPLSPNSGLIGWVPHSDTLHTLIKDFRDSNKILLSIEHRLMLQMCSDYDNLTLLQKVEVFQYALENSNGLDLHKVLWLKSRNSEVWLDRRTNYTRSLAVMSMVGYILGLGDRHPSNLMLDRHTGHILHIDFGDCFEVAMHRDKYPEKIPFRLTRMLINAMEVSGIEGNFRLTCEAVMNVLRNNKESLMAVLEAFVHDPLINWRLLTPNENNTKHKATNIASNNSTSNSTTKIEGDLNTIDNPINKESPDHEAVAGSLKSSPVHGRQIARNQRVGVDAEQVEAEIVPEALNERALSVINRVNKKLTGRDFSSNETLDVPEQVQKLIDQATSHENLCLSYVGWCPFW

SEQ ID NO: 20911 - protein, 640 aa, Chrysanthemum x morifolium
MMDSCDCFETQWPADELLVKYQYISDFFIAFAYFSIPLELIYFVQKSAFFPYRWVLMQFGAFIVLCGATHFINLWTFSSHSKTVAIVMTVAKLSTAFVSCVTALMLVHIIPDLLSVKTRELFLKQRAEDLDREMGLIIKQEGTGRHVRMLTHEIRSTLDRHTILKTTLIELGRTLDLEECVLWMPSTKGMILEVSHSLHNLIPFRSTVPINLPIITEVFNRAEAIRIPHNCPLARIRTPVGSYIPPEVVAVRVPLLHLSNFEIDNWPDNSAKSYAVMVLILPMNGVRKWRDHEMELVTVVADQVAVALSHAAILEESMRARDQLMEQNFALNLARQEAEMAIHARNDFLAVMNHEMRTPMHAIIALSSLLLETELTPDQRAMIETILKSSNLLAALVNDVLDLSRLEDGSLELESDVFNLHGLFKEVVALINPIASVKNTSMALNCDLDLPAFGIGDEKRLMQIILNVVGNAVKFTKGGHVSIQASILSPEYLQEWRTPEFCPTLTEGLFYLLVQVKDSGSGIKQQDIPHIFTKFSEPRSASNRSGGAGLGLAICKRFVNLMGGHIWIESGGLGKGTTVAFLVKLGLCNYPNDPTMQQLVPRTVPKARPHQGSGELIQHRQLDREGYQGAASFPLYNRSM

SEQ ID NO: 20912 - protein, 803 aa, Drosophila melanogaster
MTDKKNEIQPAAEPVAEPEPSPAAEIAPASPDGSGPSAAAAEEVTPSVATVEDTTPIAAPAESQPSGESNGTAEAKKLPEIAKKNGKEPDQNDKEPDQNGKELAETNDFKNVSETEGQQKKLPYPKSVFFIISNEFCERFNYYGMRTVLVLYLSRVLGYSDDTATVVFHIFTMFVYFLCVFGAIISDSWLGKFKTILYLSLVYICGSVLLTLGAIGPLNLPMETFTMLGLALIALGSGGIKPCVSAFGGDQFKVPEQVKQITSFFSLFYFSINAGSLISTTVTPILREDVSCFDDINCYPLAFGVPAVLMIVSVIIFVLGRSLYKMKPPAGNMVVLVSSTIWTALTTKCKEKKTNPREHWLDYADKKYDRQLIDDVKVLMRVLFLYLPLPVFWALFDQQGSRWTFQATRMDGDMGSWDIKPDQLQVLNPLLILIFIPLYDVALYPALKLVGIRRPLQKLTMGGILAGIAFIISGVVELSLEHTYPLIPSSGNTQLRVFSGIPDCDYRFSTNLGARESFTLRGLDFYYSGSVATNTDGIFQLTYTVESLTEGCAILEGGTQQLYEATAHSLFLRPSHAITKFWYEDEVQKSNRSWAFVRNLANLLATTRVVWREDSGDTVALDLPARNHDLYELSTGGYNVQVADHNLTSIELRAGGVYALLIGQSHGTFVSRIIEVTSPNSMHMLWLVPQYVVMTLGEVMFSVTGLEFSYSQSPPSMKSVLQACWLLTVAFGNVIVVVVAELKFFDSQASEFFLFAGLMFVDMLVFMFVAYYYKPYDEVAALAERVRARRERKWQDLDRFKRD

SEQ ID NO: 20913 - protein, 810 aa, Drosophila melanogaster
MTDKKNEIQPAAEPVAEPEPSPAAEIAPASPDGSGPSAAAAEEVTPSVATVEDTTPIAAPAESQPSGESNGTAEAKKLPEIAKKNGKEPDQNDKEPDQNGKELAETNDFKNVSETEGQQKKLPYPKSVFFIISNEFCERFNYYGMRTVLVLYLSRVLGYSDDTATVVFHIFTMFVYFLCVFGAIISDSWLGKFKTILYLSLVYICGSVLLTLGAIGPLNLPMETFTMLGLALIALGSGGIKPCVSAFGGDQFKVPEQVKQITSFFSLFYFSINAGSLISTTVTPILREDVSCFDDINCYPLAFGVPAVLMIVSVIIFVLGRSLYKMKPPAGNMVVLVSSTIWTALTTKCKEKKTNPREHWLDYADKKYDRQLIDDVKVLMRVLFLYLPLPVFWALFDQQGSRWTFQATRMDGDMGSWDIKPDQLQVLNPLLILIFIPLYDVALYPALKLVGIRRPLQKLTMGGILAGIAFIISGVVELSLEKTYPDLPYSQNIQLRIFNADNCDYFFTSNIPGAENVTVTSLNAYTNKDIYAPGSLDVEFSLSSASEACTISADKIPKVLTDNTAWSLFLNPLNGSGYYWEEDFVDKPSQSHPLIRNVANVPQELSIRWEKASTGEVVYDDLASKTLLTRVNSAEYVVMVGERNVGTFDVHTGGVYTLLIKDNNNIYEANLEEVTSPNSVKILWLVPQYVVMTLGEVMFSVTGLEFSYAQAPPSMKSVLQACWLLTVAFGNVIVVVIAEAALFESQASEFFLFAGLMFADMLIFMVMAYYYVPNDPNKVEEAQPLTAGDAKTEIPALEGGVENKGKDINE

SEQ ID NO: 20914 - protein, 446 aa, Drosophila melanogaster
MDTVTESEMAIAMALCGGIGIIHHNCTPEYQALEVHKVKKYKHGFMRDPSVMSPTNTVGDVLEARRKNGFTGYPVTENGKLGGKLLGMVTSRDIDFRENQPEVLLADIMTTELVTAPNGINLPTANAILEKSKKGKLPIVNQAGELVAMIARTDLKKARSYPNASKDSNKQLLVGAAIGTRSEDKARLALLVANGVDVIILDSSQGNSVYQVEMIKYIKETYPELQVIGGNVVTRAQAKNLIDAGVDGLRVGMGSGSICITQEVMACGCPQATAVYQVSTYARQFGVPVIADGGIQSIGHIVKAIALGASAVMMGSLLAGTSEAPGEYFFSDGVRLKKYRGMGSLEAMERGDAKGAAMSRYYHNEMDKMKVAQGVSGSIVDKGSVLRYLPYLECGLQHSCQDIGANSINKLRDMIYNGQLRFMKRTHSAQLEGNVHGLFSYEKRLF

SEQ ID NO: 20915 - protein, 257 aa, Drosophila melanogaster
MSSFKDKVIIVTGASSGIGASAAVHLAKLGGLLVIVGRNEEKLKETADNIVAAGGATPLELQADMTKEAEVQQIVGATLAKHGRIDVLVNNAGILETGSIEATSLEQFDRLMNTNVRSLYQLTMLATPELVKTKGNIVNVSSVCGLRAFPGVLAYNVSKAAVDQFTACIALELAPKGVRVNAVNPGVIVTDIHKRGGMDEETYAKFLEHCKITHALGRPGDVKEVAAAIAFLASDQASFTTGISLPVDGGRHAMCPR

SEQ ID NO: 20916 - protein, 1859 aa, Drosophila melanogaster
MTRGSCISSPIPAYCAFTAEQNGQRRLSLLFYTDVSRFYGFIFLQVETRRAGTAKIAMQHRERIITPTRSLVLCAESRREMEDWLGSLKTATAPQRPRGDSFLIEQHDILSNHHHWYATSHARPTYCNVCRDALSGVTSHGLSCEVCKCKVHKRCAAKSIANCKWTTLASVGKDIIEQADGIIMPHQWMEGNLPVSSMCAVCKKTCGSVLRLQDWRCLWCRATVHVACRPQMAVACPIGPAKLSVVPPTSVHSISTDDAWDVASPKGNFSPLLVFVNSKSGDNQGVKFLRRFKQLLNPAQVFDLISTGPSLGLRLFRHFEMFRILVCSGDGSVGWVLSEIDRFNMHKQCQVAVMPLGTGNDLARVLGWGSSCDDDTHLPQILERYESASTKMLDRWSIMVFEKAIPVPKTPKMSISTEQEAMLTGMVTSANHHLRFIVETNDTQTLIRSTRNLCDTVDDLVCRISEHHKDDEQLAVKCDILRQKLNMLLDALQEEEIGAHSGDDLIATIRSLIARSIPVTPGSNAYLLNPNISIEKTEKDQINTKERRNSRSLRSSEKEALQCRANSVKRAIYNVVEHSEPGRPKRYQRKLSITPFEALKLPTASGESTPCTSPLPIIPPINIISPTMETSRLTCISPLPDTRRDSVDENFFNSINLPAPRQFADSRRSSGVEVIQEIEEGANGETVYRKSRMSLTGGANIDDAGNRLSPCSDAGENTPTERKVDFLRVPIHTGEPIVDPLCDYRPHEVFERTYYMTREMDKGKEKDKEKDKPVEIDKEKDTCVEKEGSMPAEKLVHTCNLQVPGVVVTPNPQNVYSSASITIIDTDAQTTTEQSSSDDLGGEASDVLSAISNEECSVASEIFDKQDAGQTVGDIIQNMDASNFTHIDSPETSDETEAMPGESIMDDISSVLGHDITYALQDNTLTDDTTTLCSEHAGPPKPPRKKSLSALSRTQAHPRRRNSSPPRMARLARMDSDDNPQQFGFENIVFEIDNRCDDQKMREPPRYCSLAQFVEGNDIARQSFKQLMLEQHRGGDNDSDYPEHEQTPTNKGANLLATTSEDELSTQTAIKIEIQDIDATVRNLNSSMKPNTILTTSTSPTKKSGHGQDISVVVRPPTPLRGDCIKPTVSLLPVSSGGAMTVSMTCSGMLGVRAMNASEIRRHSSHAPGLAVREFDKDKDRRHSGFNPNQLTLDPEHARFLSSSPAASRRISCGSLFKKNKKIGTKRSYGLFSVRFFVVAEPDFRLATLALIRPLIPLLVLTFRLLFDTYSTFPDFWFSQLIKASLLQPNEALPNLQTLKGSKSSLFMGSTLFGFDHLASAEKDKEEKSGKDKEKTPTDETNRKLPIINPLVRLPNWPNLANGGGFISKCLLANADTLCAAVSPLMDPDETLLAGYHEKCVMNNYFGIGIDAKISLDFHNKREEHPEKCRSRARNYMWYGVLGSKQLLQKTCKNLEQRVQLECDGQRIPLPELQGIVILNIPSFMGGTNFWGSSKKDDIFLPPSFDDRVLEVVAVFGSVQMAASRLINLQHHRIAQCQSVQINILGDEEIPIQVDGEAWLQPPGMIRILHKNRVQMLCRNRSLELSLKSWQEKQRQHSISIQRDASSTASEHANSTDEVISERECYVLLNFIEAVSSLVKWVKFLIISHPALQHDLYEVACRASEALESIHPQGKLLEGPSLRTKLVEVIDSSRQLYDDACTLLRDRGHSLILREDLETKLSAALANMEMELKKCSVQKCIDGKLRAYFNVLAPNEESDGRRKSRPFWVRLRSGSTAGQQAFKPPLTNTREAANNWSVNEVVTWLETMQLSEYVDSFLKNDIRGKELLTLGRRDLKDLGVVKVGHVKRILQAIKDLSEN

SEQ ID NO: 20917 - protein, 396 aa, Drosophila melanogaster
MSRRVFGLSIKSFRLFRRTPIHPPAFQHFSGGVFRTSFRSFCDCQEHRRMDLPEGILMGFGNPLLDITCTVEDNVILEKYGLEANAAIIADEKHDALFDELMNMENVIYSAGGACQNSMRIFQWIVQTPFRAVFIGSVGKDKLGDRIEKRAKSDGLLTLYQLKEELPTGSCAVIINGPNRSLVANLGAASLFSDDWIDEDDNICALDRAEYFYFTGFFLAVCPPAVERVARMCCETNRIMILNFSAVFVLQMQKEALGNILQYVDIIICNKEEAIAFSDTNDWKTKNIFEIGSRLQQMPKENTRPRLVMITDAVCPVLVFQDNDRVLEYPVPPVKQGEIFDTNGCGDAFVGGFLAMYVQRMPLDYCIRTGIFASQQVLHVVGVQIDKLPKFSEKCI

SEQ ID NO: 20918 - protein, 206 aa, Drosophila melanogaster
MARAAFIVCLLMACAWSSHAVMFKLSPNTQKCLKEDIQANQLVMGEFEVSDVPGQIIDYIARDTKGHILSQKEHITKGKFSFMSEVYDTYEICFISKVPAHQRGVIQEVSLLTKKGVETKSYEGIGEASKLKPLEVDLKRLEDLSDSIVRDFVLMRKREEEMRDTNEKTNSRVLFFSIFSMCCLLGLATWQVLYLRRYFKAKKLIE

SEQ ID NO: 20919 - protein, 1497 aa, Drosophila melanogaster
MQSESGAYLPSQPAACRWWKMCEWARDDGSLACGNPFWKPVNGHLTRNWRLLRRTAKQLSAAVDIVFKWLSFSSPFFQDEGWKLNRTNYYQEGWLATGNVRGIVGVTFTTSHCRKNMDYPLRTNYNLRGHRSDVSCVVTIQSFKAPIIFGQQVILVKWNEPYQKLASCDSSGIIFVWIKYEGRWSIELINDRNTPVTHFSWSHDGRMALICYQDGFVLVGSVAGQRYWSSMLNLESTITCGIWTPDDQQVYFGTTQGQVIVMDVHGAMVSQVQLSNDVPITSMAWSCEKFKMEEGEEAEPGVTNAAKRSFVLAVSFQNGYIYLLKSFDDVSPAHINTCLNGALGMVMEWSNSRELLAVAGTLRTGVDGTKTEDMGTPSCYTNLVKFYTETGTCLYQAHIPCSSATVSAITWGHNDKRLFIATGTQVHIAWVSRRVASLQLLCRLEIQASVGSESLLPLLPLPSRIKSLIGNLFAQTIRCCVPDLKSLRDFVSRPPLCSTRLHCTMIRHDDDSNLSSGTCYTLYLEYLGGLVPLLKGKRTSKIRPEFVIFDPQVNDSPLYFQYSAEAKSSSGSSQSTTTGNSGRTDSSDSDFEERSRFGSPRTPRKKRVRPKRRHQAGDRLSASGGGVSNDPDSLDELAYVDTLPEEVKLVEVTSNIWGTKFKIHGLAKTVPANLGQVTYKTSLLHLQPRQMTLVITELRDDFPPGPDPSFNPNIFSEDEDEHHQHQGIHHDAVPQVNVITAQDGASLKPPIIPQRRLTDGASAPLIAPMSPRPNRILARHKNSLTVNGERGSGSSAGLSPLARAESYDDDSSNESQEAGAAGSQSTTVLLHQAPSNGSGPGPSCSKSITRPKTISSFKNSYSRSSSNSSCQSRHAISPLYCDGAVPTLQSPKNAVAPSDIIFERPAVPAAGQTTLMSYSSNADYANNVVQVKNALMSEPVRSANSHVNPVPLNLNLNLERMDARVKCTAPTTSSTAKRREMLYIDEETQSPTPTPSSSSMKRTPTVVSIAPALPDSITRSCSVGYLDSVAITPSDEALSALRKDAPNKRLILVDKKRNRRKRQQQEDARRHKLQQTGKSKSLDSCDLLSLQTKLSSKEHEQVVRKLQEISDSSACSSAANTLCFKCRNNMSPSSACKRCQPSASSVLDEITAVVPAVEPAKESPAVQAKPAPKKRFDVITSFTDSPLFTRKHRFGIGRSKETAGTENSTPLLGRKQDNGFSFVKQLSEVRWRRKEQPAQAQVNGSSNASTLERQPQPEITGAACGTVEATPVEAKASVSLHTQALTTLENIISRLRDLDEGRLTPPSTPQRLPRSSPASPAASKKNKRQQSNSPIRHILNSPLLNRRQRKKQSIIESSDDEGNQTNGSGEESNNAGNGKQYRDLETFQKAQLRQKLKRGKIEPNGSASCANPAPVRREFVMHNKAPMWNEMSQVYQLDFGGRVTQESAKNFQIEFRGKQVMQFGRIDGNAYTLDFQYPFSALQAFAVALANVTQRLK

SEQ ID NO: 20920 - protein, 282 aa, Tropheryma whipplei TW08/27
MVFVLTYVPSVLLGDGVSIPQFGLGTYELPPNETSSVVQSAIELGYRHIDTASLYANEREVGRAIASSGIKREEFFVTTKLWNSDQPKPREAFERSLDLLSLDYVDLYLIHWPCPPSELYINVWEVLLELKESGRAKSVGVSNFLSEHINKIKEAGFPLPSVNQIELHPWLQQRELVLSCRNYGIQIESWGPFARFSKDLDAFPELTRPAKEYGKTPAQVILRWHIQKGYVVFPKTVHAERLRQNIDIFDFDLTPDEISGIDSLDAGFRTGPDPSSFRAGLD

SEQ ID NO: 20921 - protein, 491 aa, Tropheryma whipplei TW08/27
MHPHKLSGVGLTYDDVMLVPGRSDVLPSQVNFGSFLTRRIRLSAPLVSAAMDTVTESGMAVAMARLGGVGVIHRNMSIADQAEHVTRVKLSESGMITRPVSVSPDLTLEEVEQRCSRYKISGFPVVDEDNTLLGIVTSRDMWPYRHEHRASVRVSEVMTRSPLITASPNISSEEARDLLYKHRLEKLPLVDEHGRLFGLITVKDFVNRQRYPFATKDKNGCLIVGAAIGFFGDAYDRALALAAAGVDFIVVDTANGYSDGALKMINRLKNDSTFADIDIIGGNVATGDGAKALIDSGADAVKVGIGPGSICTTRVIAGVGVPQITAIYECAQTSSVPIIADGGLHYSGDIAKALVAGAKSVMLGGLLAGCDESPGELISRGGKQYKIYRGMGSAGAMQARASYSRDRYFQHDLDSHPIAEGVEGQVPHTGSVSTVFYQLLGGLRQSMFYVGCRDINELQDKGRFVRITSAGLKESHPHDIEMIVETPNYRT

SEQ ID NO: 20922 - protein, 373 aa, Tropheryma whipplei TW08/27
MEVGFSRNARRAFSLDEVAVVPSRRTRHSSEVSIEWKMDAFSFDTPIISSPADSVVSPSTIVELSEFGCLGILDLEGVWTRYENPEPVLREISALPEEKACLGLQKIYSEPIKRHLLERRLQELRDAGVIVAGCLSPQTTNALYKSVISAGVDIFVIRGGTVSAEHVSKSDNVLNLKRFIYELDVPVMVGGVATYTAALHMMRTGAAGVLVGFGGCAGSTNHASLGIKVPMATAIADVAAARKDYLDESGGRYVQVIADGSMNTSGMAVNALALGADAVMMGTPLVRSTTSPGFGYHWGREAHHMTLPRGRRAYIGQTASLQEIIQGPGHSPDGTVNFAGAIRRAVALAGFQDLKNFQRVEMVVIQDQRRCCA

SEQ ID NO: 20923 - protein, 368 aa, Tropheryma whipplei TW08/27
MQRVIIVGSTGSIGTQAIDFILKNRDSFLVVGLAASTQTSLLREQAQVFGTKNTAQGASEAAELIEATEADVVLNAITGAAGLLSTYATLKTGKRLALANKESLIMGGKYFLDMTSFKGQITPVDSEHSAIAQAMKSGKFSEVNKLILTASGGPFYDRESLEGITLKDALDHPTWNMGPMISINSATMFNKGLEIIEAHLLFGIPYSQIDVVIHPQSIVHSMVEYKDGSVIAQASVADMTLPIGYALSWPNRALNAVRPLEWGARQRWDFLPPTENSMRSINLARRAGEAGGVYPAVLNASNECAVEAFMAGKISFARIIHVTETVFNLYTKQHTNRESAKNPIEVILEEDARTRELAKTVIENMSAD

SEQ ID NO: 20924 - protein, 371 aa, Tropheryma whipplei TW08/27
MIEKKLYSAMEKVYDPELHIPITRLGMVKTITTDSKTVSILIHITSPTCPAVDKIKQRVTDAASAVCPEHDIKIEIGVMSHQERQNLKEVLNLQKRSNPFKESKTRIIAVTSGKGGVGKSTIVSNLGVGLARMGFSVSVIDADVYGFSIPRMFGIDEDFIPQRENGMIMPANKFGVKLISIGMFMRRRGAVAWRGPLLHRTINQFLCDVNFADPDILLIDMPPGTGDAAITIAQLLPNSEVLVITTPQIVAADVAIRSGQFALSVKQNIIGVVENMSSCPESKLDIFGHGGGKFVAEFLDKQCKKESTAKDNRITNPHEAIDLITCIPLDVNIRKSGDEGVPLLVENKYEGSPGHTALKELYEKIALKLYG

SEQ ID NO: 20925 - protein, 387 aa, Tropheryma whipplei TW08/27
MPVKIKTQSRGSDKEAFAGAPSTSGASGAVLDEDLSTDPASHISAQATASDTDVASQGSEGDFEAIVLADTKDDESTPASPVISGATADPVKDYLKQIGKVSLLTADEEVSLAKRIEAGLFAEEKLSESGDLAPKLKRELRWVVRDGQRAKDHLLAANLRLVVSLAKRYTGRGMQFLDLIQEGNLGLIRAVEKFDYVKGFKFSTYATWWIRQAITRAMADQARTIRIPVHMVEVINKLSRVQRQLLQDLGREPTPDELGRELDMPPERVVEVQKYGREPISLHTPLGDEGDSEFGDLIEDVDAVAPDDAVGFSMLQQQLRLLLDSLSEREAGVIRMRFGLDYDMPKTLDYVGEYFDVTRERIRQIEAKTMAKLRHPSRSQCLRDYLG

SEQ ID NO: 20926 - protein, 410 aa, Tropheryma whipplei TW08/27
MMQNAIGRIFLGVCGSISAYKSVYLARLFVKEGYDVRVGFTNGASQFVTGEPFRVFTGHHVLNFPCDDQSHIDISRWADAIVVAPATANILAAARAGLASDIVTQTILSSRSPVLFVPSMHTAMWENPATRDNVNCLLERGYHVLGPVTGDLSSGDWGIGRMVDPCEIVQYVSRSLLNHQTGKLSGKKFLITAGGTRQPIDPVRYIGNRSSGKQAIAIAKEAQKRSAEVILIAANVEAVTLPTGMRVITVATAEEMRKALSDNIDTSDVVIMAAAVSDFQPREVASQKIKSNDGWTLQLISTDDLLRELASNKSRPRVLVGFSAETEESANCRIDIARQKLLSKGCDYMVVNQVGFDVGFDVSDTEVSLIDDKQVFFTARGSKDYIAKRILDFLSERVIVTYIDPLDRSL

SEQ ID NO: 20927 - protein, 428 aa, Tropheryma whipplei TW08/27
MCLIDSVHARQILDSRGTPTVEVEVTLEDGSMGRSAVPSGASTGAFEAHELRDQDNNEYLGKGVTRAVRSVNSEIAPVLIGFDAFDQVGLDHRMIELDGTNNKSRLGANAILGVSLASASAAARAADLSLFRYLGGPSSRILPVPMMNIINGGAHADTGVDIQEFMILPVGARSFSESLRWGCEVYHSLKVQLRESGLSSGLGDEGGFAPALRSNRTALDLILSAIEKAGFSPGIDIVLALDIAASEFCKAPGHYRFEGKDITSDELISYYEGLLSSYPLVSIEDPLDQDDWEGYRTLTTHIGDRVQIVGDDLFVTNTSRLSRGIQSGVANSILVKVNQIGTLTETFDAVDMAAKGGYTAVLSHRSGETEDTTIADMAVATNCGQIKTGAPARGERIAKYNQLLRIEEKLGRSARYAGWLSYPRWQGK

SEQ ID NO: 20928 - protein, 244 aa, Drosophila melanogaster
MRDQFISLALILCVLHSACGLYFHISQTERKCFIEEVPDETTVIVNYKVELYDPRSNGFMPSSPGIGMHVEVRDSDDKIVLSRVYSSQGRISFTSHTPGEHVICMFSNSTAWFSGAQLRVHLDIQVGEHAIDYAHVAQKEKLTELQLRIRQLLDQVEQITKEQNYQRYREERFRHTSESTNSRVLWWSLAQTVVLVCMGFWHLFNLFHTCVYINEQCLCVCCLYIKKISALGLINDKINGLPDP

SEQ ID NO: 20929 - protein, 216 aa, Drosophila melanogaster
MRDQFISLALILCVLHSACGLYFHISETERKCFIEEVPDETTVIVNYKVELYDPRSNGFMPSSPGIGMHVEVRDSDDKIVLSRVYSSQGRISFTSHTPGEHVICMFSNSTAWFSGAQLRVHLDIQVGEHAIDYAHVAQKEKLTELQLRIRQLLDQVEQITKEQNYQRYREERFRHTSESTNSRVLWWSLAQTVVLVCMGFWQMRHLKSFFEAKKLV

SEQ ID NO: 20930 - protein, 365 aa, Drosophila melanogaster
MLLARLNHVLSGRPMRLLGQSGCPRLWSSAHAQMNSNSLRTPSLAQGKSVIPKRNMQELGMRKYSRESRDRDRSQLESRTRGPSLKERMMGPPSENAYSMGKGAAAGAALMGLVGLCYYGLGLANQPSIYDHSMVWPQYVRDRIHATYAYFGASCGVTAASAVAFFQSDAMMALMTRSGWVASLVTLGLVMLSGSIAQGLEYQPGFGAKQLAWLVHCAVLGAVLAPMCLLGGPILTKALLYTSGIVGALSTVAACAPSEKFLHMGGPLAIGLGVVFASSLASMWLPPTTAVGAGLASMSLYGGLILFSGFLLYDTQRIVKSAELYPQYSKFPYDPINHALAIYMDALNIFIRIAIILAGDQKRKN

SEQ ID NO: 20931 - protein, 959 aa, Drosophila melanogaster
MSVSHNYDQMSQPTNTTTTQTKASKRPSRFNSKMPVVNSRLAELARITVLLTALLVSYASGLQTVGESADDNTICLYREYNTTYRKEIGAVWFASKDPCLVYSCAAGVAKDPQAHIVATQVDCNEFYCEVGSELRSVEGSCCGECVRTHCQHNHTLYAVGESWHNDADCTLIECGRLDNGQIVMNTYKRNCPALTEDCPASRLEERNCCPYCRPLQTARIEELQDNVAESTDDIWTAEWYRNHPCNRDCQVGAEPMTCRYKFVVEWYQTFSKACYDCPRNLTDCSRPHCVMGDGLERSITVVNRMMPGPAIEVCEGDEIVVDVKNHLLGESTSIHWHGLHQKKTPYMDGVPHITQCPITPHATFRYSFPADLSGTHFWHSHTGMQRGDGVFGALIIRKPKTAEPHGGLYDFDLSEHVMIVQDWIHDTGASIFSYHHHSRGDNKPHNLLVNGKGRYYNRIWAEAKQAHRRAEERTTQPVEPLPKSQVDFVQTLPRQARLAKTNTTKLFPVNSRQKRGNLNEIPLELVPHQIYTVRRGFRYRFRIINAEYLNCPIVVSIDGHNLTAINSDGFDIEAMDVGSIVTYSGERFDFVLNANLEVGNYWIRLKGLMDCSEVFTSAFQVAILRYEGAPDEEPTAELSYGHKAEGIELNVMNRGPGYPDTKTVAEMRALPIYDHVSGIDHDTLKPEADYKFFIYYDFYTKNNPDFHDKDLYAMDMEMTQQNRLYTPQLNHITLNFPSLALLPSRSQLKDSDFCNETSLMDQGIDCRQEFCKCHHVLQVPLGAVVEMIIVDEGFQYYANHPFHLHGNAFRVMGLERLGENVTVEMIKQLDQFNLLKRNLDNPPVKDTVTIPDGGYTIIRFEASNPGYWLFHCHIEFHAEIGMALVFKVGNDDQMVPVPENFPTCGDYNPDLRSDGGTTEDSGSSKPITATPPNTGGGGSGLEPTWITLMISSMLVKLYR

SEQ ID NO: 20932 - protein, 392 aa, Drosophila melanogaster
MFSRHFAAFFRFNRYVAQKYSSFIAAGFSNRFSLKVATLLPLVVLRSADCRQKEDQETSLEGRAQLYLNAMKVRWDQLHKVPGLFSYQLEKSPQSRKIPGYWGFYAELNSDRNRKRRRPQTIESLNPTFKHMMFNFNKVDAQEVIMTIDDAHGSPEVQMIINKSPITKYHTLICPEVGKNHTQRITRDALQFCITFMRNIDDKDMRMGYNSPGALASVNHLHFHLLHMPQDLYIDHVPLDELAGGYVYRLSRRAPTEGICIVFNENDSDEQVAEKVDQLYMLAMWMCKNNMPHNLFLTQDRRPGKSGNIKVFVFARSEYCVNKDLAEFNVGFCELAGYIPLPDADKMENLTELQVLFRIRTITGNAPKAVYEQITSMVEGQEYYLWDQPLTI

SEQ ID NO: 20933 - protein, 538 aa, Triticum aestivum; identical to SEQ ID NO: 4589

SEQ ID NO: 20934 - protein, 1176 aa, Bos taurus
MDFRANLQRQVKPKTLSEEERKVHGPQQVDFRSVLAKKGTPKTPVPEKVPPPKPATPDFRSVLGSKKKLPTENGSNNTEALNAKAAEGLKPVGNAQPSGFLKPVGNAKLADTPKPLSSTKPAETPKPLGNVKPAETPKPLGSTKPAETPKPLGSTKPAETPKPLGNVKPAETPKPLGNIKPTETPKPLGSTKPAETPKPLGSTKPAETPKPLGNVKPAETPKPLGNVKPAETPKPLGNVKPAETPKPVSNAKPAETLKPVGNAKPAETPKPLSNVKPAETPKLVGNAKPAETSKPLDNAKPAEAPKPLGNAKPAEIPKPTGKEELKKEIKNDVNCKKGHAGATDSEKRPESRGTAPTFEEKLQDLHVAEGQKLLLQCRVSSDPPATITWTLNGKTLKTTKFIVLSQEGSLCSVSIEKALPEDRGLYKCVAKNSAGQAESSCQVTVDVPDAPTSENAKAPEMKARRPKSSLPPVLGTESDATVKKKPAPKTPPKAAMPPQIIQFPEDQKVRAGESVELFGKVAGTQPITCTWMKFRKQIQDSEHIKVENSEQGSKLTIRAARQEHCGCYTLLVENKLGSRQAQVNLTVVDKPDPPAGTPCASDIRSSSLTLSWYGSSYDGGSAVQSYSVEIWDSVDKTWKELATCRSTSFNVQDLLPDREYKFRVRAINVYGTSEPSQESELTALGEKPEEEPKDEVEVSDDDEKEPEVDYRTVTVNTEQKVSDFYDIEERLGSGKFGQVFRLVEKKTGKIWAGKFFKAYSAKEKENIRQEISIMNCLHHPKLVQCVDAFEEKANIVMVLEIVSGGELFERIIDEDFELTERECIKYMKQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLNCTQCLQHPWLMKDTKNMEAKKLSKDRMKKYMARRKWQKTGNAVRAIGRLSSMAMISGLSGRKSSTGSPTSPLNAEKLESEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGGEEEEEE

SEQ ID NO: 20935 - protein, 435 aa, Capsicum annuum
MAGQTVIVSGLNPAAILQSTIGGAPPSTAAAAAENGDTTRKVVPLSKDALQDFMVSIITQKLQGKKKPFYVLDLGEVVSLMDQWNVALPNVHPFYAVKCNPEPSFLSMLAAMGSNFDCASRAEIEYVLSLGISPERIVFANPCKPESDIIFAEKVGVNLTTYDSEDEVYKIKKHHPKCELLLRIKPMNDGNARCPMGPKYGALPEEIEPLLRIAQASRLTVSGVSFHIGSGDADSNAYLGAIAAAKQVFETAAKFGMSKMNVLDIGGGFTSGHQFTTAATAVKSALQQHFSNEPELTIIAEPGRFFAETAFTLATTIIGKRVRGDLREYWINDGLYGSMNCVLYDHATVTATPLACMSNRVNLNCSGSKMFPSTIFGPTCDALDTVLRDYQLPELQVNDWLIFPNMGAYTKAAGSNFNGFNTSAIVTHLAYAYPS

SEQ ID NO: 20936 - protein, 353 aa, Tamias striatus
MATDGLHENETLASLKSEAESLKGKLEEERAKLHDVELHQVAERVEALGQFVMKTRRTLKGHGNKVLCMDWCKDKRRIVSSSQDGKVIVWDSFTTNKEHAVTMPCTWVMACAYAPSGCAIACGGLDNKCSVYPLTFDKNENMAAKKKSVAMHTNYLSACSFTNSDMQILTASGDGTCALWDVESGQLLQSFHGHGADVLCLDLAPSETGNTFVSGGCDKKAMVWDMRSGQCVQAFETHESDINSVRYYPSGDAFASGSDDATCRLYDLRADREVAIYSKESIIFGASSVDFSLSGRLLFAGYNDYTINVWDVLKGSRVSILFGHENRVSTLRVSPDGTAFCSGSWDHTLRVWA

SEQ ID NO: 20937 - protein, 249 aa, Fragaria x ananassa
MGRGRVELKRIENKINRQVTFAKRRNGLLKKAYELSILCDAEVALIIFSNRGKLYEFCSSSSMLKTLERYQKCSYGAMEVQKPAKELEESSYREYLKLKTRCESLQQTQRNLLGEDLGPLNTKELEQLERQLESSLKHVRSTKTQHMIDLLSDLQSKEHMLIEANRDLKTKLDEIDSRTQLRQTWEHGHDHQTMLYGTQHAQTQGLMFQPLDCNPTLQIGYNAVVSQEMPAATPAHAQPVNGFIPGWML

SEQ ID NO: 20938 - protein, 367 aa, Dendrobium sp. XMW-2002-1
  unsure (1)..(367): unsure at all Xaa locations
MGRSPCCDKVGLKKGPWTPEEDQKLLAYIEKHGHGSWRALPNKAGLQRCGKSCRLRWTNYLRPDIKRGKFSMQEEQTIIQLHALLGNRWSAIATHLPKRTDNEIKNYWNTHLKKRLAKMGIDPITHKPKSDNLSSADGHSKCTANLNHMAQWESARLEAEARLVRESKLRSSSISXNTTTIFTSKNQPLLPPAVPMTPAASPCLDVLSAWQGAWTKPAANNSQGRGYTIDLESPTSTLSFSDNMMAPTISGMGLAEDSTREDQEWKCLRKTGFSMHTAAPFVSTEASSWLSESSGGDFAAGFTGMLSDKANEQNSEDGCNDSDNAECGSCVDVEESEGEEDENKNYWSSILNLVNSSSPPNSPPPVF

SEQ ID NO: 20939 - protein, 371 aa, Dendrobium sp. XMW-2002-2
MWRHSCCYKQKLRKGLWSPEEDEKLLKHITKYGHGCWSSVPKLAGLQRCGKSCRLRWINYLRPDLKRGTFSQQEENLIIELHGVLGNRWSQIAAQLPGRTDNEIKNLWNSCIKKKLRLRGIDPNTHKPLAETEVQLAEIDSADQPAPEPEKHTVQQTETGVPNNSVRPGNSPAASYFSLPDLTYSPDCGGSIGQIQQFWLNQSGKFFSNNNSNSEFSFNSVSSLVPSVPRSTLSTSKELKPLTSLLMENSPSGFYWETGNSSNSSASSGSNDPLFDGSIFQWTQLIPERDINVQLHGETEDLKWSEYLNGSIPLSTELQSQNPELCNGMKAEEQFGIDGLSIWLQNHQQQQQQQQQASNNYGKDSQRDIIC

SEQ ID NO: 20940 - protein, 104 aa, Dendrobium sp. XMW-2002-4
MGSNSCGSKEELNKGGWTADEDNLLMAYINTHGEGKWTTVSYNAGLKRSGKSCRLRWLNYLSPKIKRGNFSEEEDDLIIRLHKLLGNRLALSSRYILMKYLLLS

SEQ ID NO: 20941 - protein, 216 aa, Dendrobium sp. XMW-2002-8
MGRSPCCEKAHTNKGAWTKEEDERLVAYIKVHGEGCWRSLPKAAGLLRCGKSCRLRWINYLRPDLKRGNFTEEEDELIIKLHSLLGNKWSLIAGRLQGRTDNEIKNYWNTHIRRKLLSRGIDPTTHRPLHGQADASFVNEVEKVVSFRRREDENKSSNSSSSNSRSNSEEAKRWRCPDLNLELCISPPLQKQEDSEEDMMREEFGLCFTNGLLEFR

SEQ ID NO: 20942 - protein, 151 aa, Dendrobium sp. XMW-2002-9
MEEDGILINYIANHGEGVWNNLAKSAGLKRTGKSCRLRWLNYLRPDVRRGNITPEEQLLIMELHARWGNRWSKIARQLPGRTDNEIKNYWRTRIQKKVKNGDAVDYSSQMIIDEACTSHTSSIEEGMAQQNYPVHPNTNPEGYRLQTTRVN

SEQ ID NO: 20943 - protein, 220 aa, Dendrobium sp. XMW-2002-10
MGRSACCEKAHTNKGAWTKEEDERLIAHIRTHGEGCWRSLPKAAGLLRCGKSCRLRWINYLRPDLKRGNFTDEEDELIIKLHSLLGNKWSLIAGRLPGRTDNEIKNYWNTHIRRKLLNRGIDPATHRPVSTATASNLTMSFSSGSSVKDKRTSSSSSSSRVGRISALLPRCPDLNLDLCISPSLEEQMPQDLLVEESNCGGEFLRLGSSFLLDYRSLEMK

SEQ ID NO: 20944 - protein, 805 aa, Solanum tuberosum
MAERVLTRVHSLRERLDATLAAHRNEILLFLSRIESHGKGILKPHQLLAEFESIHKEDKDKLNDHAFEEVLKSTQEAIVLPPWVALAIRLRPGVWEYVRVNVNALIVEELTVPEFLQFKEELVNGTSNDNFVLELDFEPFTASFPKPTLTKSIGNGVEFLNRHLSAKMFHDKESMTPLLEFLRVHHYKGKTMMLNDRIQNLYTLQKVLRKAEEYLTTLSPETSYSAFEHKFQEIGLERGWGDTAERVLEMICMLLDLLEAPDSCTLEKFLSRIPMVFNVVILSPHGYFAQENVLGYPDTGGQVVYILDQVPALEREMLKRIKEQGLDIKPRILIVTRLLPDAVGTTCGQRLEKVFGTEHSHILRVPFRTEKGIVRKWISRFEVWPYMETFIEDVGKEITAELQAKPDLIIGNYSEGNLAASLLAHKLGVTQCTIAHALEKTKYPDSDIYLNKFDEKYHFSAQFTADLIAMNHTDFIITSTFQEIAGSKDTVGQYESHMAFTMPGLYRVVHGIDVFDPKFNIVSPGADVNLYFPYSEKEKRLTTFHPEIEDLLFSDVENEEHLCVLKDRNKPIIFTMARLDRVKNLTGLVEWYAKNPRLRELVNLVVVGGDRRKESKDLEEQAEMKKMYELIKTHNLNGQFRWISSQMNRVRNGELYRYIADTRGAFVQPAFYEAFGLTVVEAMSCGLPTFATNQGGPAEIIVHGKSGFQIDPYHGEQAADLLADFFEKCKVDPSHWEAISEGGLKRIQEKYTWQIYSDRLLTLAAVYGFWKHVSKLDRLEIRRYLEMFYALKFRKLAQLVPLAVE

SEQ ID NO: 20945 - protein, 168 aa, Paralichthys olivaceus
MGDPALTRDCPLDCKVYVGNLGNNGNKTELERAFGYYGPLRSVWVARNPPGFAFVEFEDPRDASDAVRELDGRNMCGCKLRVELSTGEKRSRSRGPPPSWGRRPRDDLRRRSPPVRRRSPKRRSLSRSRSRSVSRDRHRFRSLSRDKNRKHSRSISRSRSTSQSNERK

SEQ ID NO: 20946 - protein, 349 aa, Branchiostoma lanceolatum
ASTGIYEALELRDKDPSKYLGKGVSKAVSNINDIIAPAVIQKNFDVTKQSEVDQFMLDLDGTENKSKLGANAILGVSLATAKAGAVHKGVPLYRHLADLAGNTDVILPVPAFNVINGGSHAGNKLAMQEFMILPTGASSFREAMQMGCETYHNLKSIIKKKYGQDATNVGDGGGFAPNILENKEALNLLMDAIKAAGYEGRIKIGMDVAASEFHRDKKYDLDFKSPDDPSRYISGDQLAQLYHEMIAAAPIVSIEDTFDQDDWEMWSKFTGQTDIQIVGDDLLVTNPKRIKRGIDDKACNALLLKVNRIGSVTESIDACKMSQKNGWGVMVSHRSGETEDTFIADLVVG

SEQ ID NO: 20947 - protein, 342 aa, Danio rerio
ALELRDGDKSRYNGKGVLKAVGHINDTLGPAIIASEISVVEQEKLDNMMIEMDGTENKSQFGANAILGVSLAICKAGAAEKGVPLYRHIADLAGNTELVLPVPAFNVINGGSHAGNKLTMQEFMVLPVGAESFRDALRVGAELYQTLKGVIKEKYGQDATNVGDEGGFAPNILENSEALELIKTAIDKAGFTDKVVIGMDVAASEFYREGKYDLDFKSPPNADRHISSDELLEIYQTFINDFPVVSIEDPFDQDDWPAWTNMTGSVGIQIVGDDLTVTNPKRIEKAAEDRACNCLLLKVNQIGSVTEAIQACKLAQANGWGVMVSHRSGETEDTFIADLVVG

SEQ ID NO: 20948 - protein, 263 aa, Branchiostoma lanceolatum
MAMEQMTLRGTLKGHGNWVTQIATTPQHPDMILSASRDESIIVWKLTRDENNYGIPYKCLNGHSHFVSDVVISSDGQFALSGSWDHTLRLWDLNTATTTRRFVGHTKDVLSVAFSADNRQIVSGSRDKTIKLWNTLGVCKYTIQEDGHTEWTSCVRFSPNNQNPIIVSCGWDKLVKVWNLTNCKLKTKHIGHMGYLNAVTGSPDGSLGASGGKDSNAMLGDLNEGKHLYTLDGTDEIKPLGLSPNRYGLGVATGLTLRIWDLG

SEQ ID NO: 20949 - protein, 300 aa, Myxine glutinosa
TLKGHNNWVTQIATTPQFPDMILSASRDKTLIMWKLTRDETNYGIQQRSLRGHGHFVSDVVISSDGQSALSGSWDYTLRLWDLTLGTTTRHFVGHTKDVLSVAFSADNRQIVSGARDRTIKLWNTLGVYKYTIQEDGRTEWASCVRFSPNNSNPIIVSCGWDKLVKVWNLTNCKLKTNHIGHTGYLNTVTVSPDGSLCASGGKDGQAMLWDLNEGKHLYTLDGGDLINALCFSPNRYWLCAATGPSIKIWDLEGKVIVDELRQEVISTSGKAEPPQCISLAWSADGQTLFAGYTDCLIRV

SEQ ID NO: 20950 - protein, 317 aa, Petromyzon marinus
MTEQMTLRGTLKGHNGWVTQIATTPQFPDMILSASRDKTLIMWKLTRDETNYGIPQRSLHGHGHFVSDVVISSDGQFALSGSWDGTLRLWDLTTGTTTRRLVGHTKDVLSVAFSADNRQIVSGSRDKTIKLWNTLGVCKYTIQEDGHTEWVSCVRFSPNNNNPIIVSCGWDKLVKVWNLTNCKLKTNHIGHTGYLNTVTVSPDGSLCASGGKDGQAMLWDLNEGKHLYTLDGGDTINALCFSPNRYWLCAATGPSIKIWDLEGKVIVDELRQEVISTSSKAEPPQCISLAWSADGQTLFAGYTDNFIRVWQVTIGTR

SEQ ID NO: 20951 - protein, 300 aa, Scyliorhinus canicula
TLKGHNGWVTQIATTPQFPDMILSASRDKTIIMWKLTRDETSYGVPQRSLCGHSHFISDVVISSDGQFALSGSWDGTLRLWDLTTGSTTRRFVGHTKDVLSVAFSADNRQIVSGSRDKTAKLWNTLGVCKYTIQDECHTEWVSCVRFSPNSSNPIIVSCGWDKLVKVWNLANCKLKTNHIGHPGYLNTVTVSPDGSLCASGGKDGQAMLWDLNEGKHLYTLDGGDIINALCFSPNRYWLCAATGPSIKIWDLEGKIIVDELRQEVISTSSKAEPPQCTCLAWSADGQTLFAGYTDNLIRV

SEQ ID NO: 20952 - protein, 271 aa, Branchiostoma lanceolatum
AYFKRFQVKFRRRREGVTDYYARKRLVIQEKNKYNTPKYRLIVRFTNKDIICQVAYARIEGDIIVSAAYAHELPRYGIKVGLTNYAAAYCTGLLLARRILKKFSLDTIYEGCTEIDGDEYNVEEVDGQPRPFRCFLDVGLVRTSTGARVFGAMKGAVDGGLDIPHSTKRFPGYDAESKDFNAEVHRGHIFGQHVAEYMRKLEEEDEEAYKSQFGSYIKLGITADSVEEMYTKAHAAIREDPEHKPKDKKEVTVKRWNRAKLSLAQRKDRIK

SEQ ID NO: 20953 - protein, 176 aa, Petromyzon marinus
  unsure (1)..(176): unsure at all Xaa locations
GFIKTVKSKAYFKRYQVKFKRRREGKTDYFARKRLIVQDKNKYNTPKYRLFVRLTNRDVICQVAYAKIEGDVMVCAAYSHELSKYGITVGLTNYAAAFTCYLDAGLTRTTTGNKVFGALKGAVDGGLSIPHSTKRFPGYDSESKEFNADVHRKHXLGVNVADYMRSLMENDXDAYK

SEQ ID NO: 20954 - protein, 271 aa, Scyliorhinus canicula
AYFKRYQVKFRRRREGKTDYFARKRLVVQDKNKYNTPKYRMIVRFTNRDIICQIAYAKIEGDIIVCAAYGHELPKYGIKVGLTNYAASYCTGLLLARRLLRKFGLDTIYEGQVEVTGDEYNVESIDGKPSAFTCYLDAGLARTTTGNKVFGALKGAVDGGLSIPHSTKRFPGYDSESKEFNPEVHRKHIFGVNIAEYMRYLMEEDEDAFKKQFSQYVKHGVTADMIEDLFKKAHATIRENPIHEKKPKREVKKKRWNRPKMSLQQRQDRIA

SEQ ID NO: 20955 - protein, 204 aa, Oncidium cv. 'Gower Ramsey'
MGRGKIEIKKIENPTSRQVTYSKRRLGITKKAMELTVLCDAKVSLIMFSSSGKLSDYCSPSTEIKDAFQRYQQVTGFDIWDAQYQRMQSTLMNLREVNHKLQMEIRQRKGENLEGLDVKELRGLEQKLEESIKIVRERKYHVIATQTDTYKKKLRSTREMYPALLNELQEVDDENQQRSFIAEDLSGVYNSAISMANQRLAHCL

SEQ ID NO: 20956 - protein, 245 aa, Lolium perenne
MGRGKVQLKRIENKINRQVTFSKRRSGLLKKAHEISVLCDAEVGLIIFSTKGKLYEFATDSCMDKILERYERYSYAEKVLISTESEIQGNWCHEYRKLKAKVETIQRCQKHLMGEDLESLNLKELQQLEQQLESSLKHIRARKNQLMHESISELQKKERSLQEENKILQKELIEKQKAHTQQAQWEQTQPQTSSSSSSFMMGEATPATNCSNPPAAASDRAEDATGQPSARTVLPPWMVSHINNG

SEQ ID NO: 20957 - protein, 261 aa, Lolium perenne
MGRGKVQLKRIENKINRQVTFSKRRNGLLKKAHEISVLCDAEVAVVVFSPKGKLYEYATDSSMDKILERYERYSYAEKALISAESESEGNWCHEYRKLKAKIETIQKCHKHLMGEDLECLNLKELQQLEQQLESSLKHIRSRKSHLMMESISELQKKERSLQEENKALQKELVERQKAARQQQQEQWDRQTQTQQAQNQPQAQTSSSSSSFMMRDQQAHAQQNICYPPVTMGGEAVAAAPGQQGQLRIGGLPPWMLSHLNA

SEQ ID NO: 20958 - protein, 279 aa, Lolium perenne
MGRGPVQLRRIENKINRQVTFSKRRSGLLKKAHEISVLCDAEVALIVFSTKGKLYEYSSQDSNMDVILERYQRYSFEERAIVDQNIGGQANWGDEFGSLKIKLDALQKSQRQLLGEQLDPLTTKELQQLEQQLDSSLKHIRSRKNQLLFESISELQKKEKSLKDQNGVLQKHLVETEKEKSNVLSNIHHREQTNGAANIHRREQMNETTHIHNQEQLNGATTSSPSPTPVAVLDSVATLNIGSSQSREAAGEEPESQPSPAQANSGKLPPWMLRTISNR

SEQ ID NO: 20959 - protein, 260 aa, Lolium perenne
MGRGRVELKRIENKINRQVTFSKRRNGLLKKAYELSVLCDAEVALIIFSSRGKLYEFGSAGTTKTLERYQHCCYNAQDSSSALSETQSWYQEMSKLKAKFEALQRTQRHLLGEDLGPLSVKELQQLEKQLECSLSQARQRKTQLMMEQVEELRRKERQLGEINRQLKHKLDAEGSSSNSFRAMQQITWAAGTVVDEGAGAYHMHHQQQPNHSAAMDCEPTLQIGYPHQFAAAEQAANNIPRSSAPGGENNFMLGWVLGAN

SEQ ID NO: 20960 - protein, 175 aa, Tripsacum dactyloides
APLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKK

SEQ ID NO: 20961 - protein, 261 aa, Homo sapiens
MAATAREDGASGQERGQRGCEHYDRGCLLKAPCCDKLYTCRLCHDNNEDHQLDRFKVKEVQCINCEKIQHAQQTCEECSTLFGEYYCDICHLFDKDKKQYHCENCGICRIGPKEDFFHCLKCNLCLAMNLQGRHKCIENVSQQNCPICLEDIHTSRVVAHVLPCGHLLHRTCYEEMLKEGYRCPLCMHSALDMTRYWRQLDDEVAQTPMPSEYQNMTVDILCNDCNGRSTVQFHILGMKCKICESYNTAQAGGRRISLDQQ

SEQ ID NO: 20962 - protein, 439 aa, Aster tripolium
MKILLGVGINGGLFGSCVSSRSKVDSSTSGISSHFEIKSTNNVSKDQPTTSNSEHNLPTLTPEDELKVASRLRKFGFNDLKMATRNFRPESLLGEGGFGCVFKGWIEENGTAPVKPGTGLTVAVKTLNHDGLQGHKEWLAEVNFLGDLGNPNLVKLIGYCIEDDQRLLVYEFLPRGSLENHLFRRSLPLPWSIRMKIALGAAKGLAFLHEEAKRPVIYRDFKTSNILLDAEYNAKLSDFGLAKDGPEGDKTHISTRVMGTYGYAAPEYVMTGHLSSKSDVYSFGVVLLEMLTGRRSMDKKRPNGEHNLVEWARPHLGERRRFYRLIDPRLEGHFSIKGAQKAAQLASRCLSRDPKARPLMSEVVDCLKPLPALKDMAGPSYYLQTVQPERAGSSPDPNRTRVGSFSRNGSQHPRTLSIPNASPRHNQFLQDSPNPNGKQ

SEQ ID NO: 20963 - protein, 493 aa, Aster tripolium
MAGVINGDEREIQKNYWVEHSVDLTVESMMLDSMASDLDKEERPEVLSLLPSYEGKRVLELGAGIGRFTGELAKTAGEVIALDFIESVVKKNESINGHCKNVKFMCADVTSPDLRFPAESIDLIFSNWLLMYLSDKEVEDIAERFLKWVKVGGHIFFRESCFHQSGDHKRKQNPTHYREPRFYTKAFKQCHMTDASGNSYELSLIGSKCIGAYVRSKKNQTQICWIWQKVASSEDDRGFQQFLDNGQYKSSGILRYERIFGPGFVSTGGLDPTKEFGALLDLKPGQKVLDVGCGIGGGDFYMADNFDVDVIGIDLSVNMIAFALERSIGLQCSVEFEVADCTKKSYPDNSFDVIYSRDTILHIQDKPALFRTFYKWLKPGGKVLISDYCRKSGKPSEDFAEYIKQRGYDLHDVETYGKMLKDAGFGEVIAEDRTKQFIEVLQRELERVEKEKEEFIQDFTEGDYNDIVGGWKAKLVRTGSGEQRWGLFIAKKK

SEQ ID NO: 20964 - protein, 512 aa, Oryza sativa (japonica cultivar-group)
MGLLGMVGDSFGCSATGERLVSAARDGDIQEAMALLELNPRLARYSTFGIRNSPLHYSAAKGHHEIVSLLIESGVDINLRNCRGQTALMQACLYGHWKVVQILVLFKANIHKKDCFSGATAIHFAALKGHTRCLRLLVADYVPSLPEFWSVMHAKCTDETNKEAFDAVALRRLINNKSDGGVTPLHLAALHGHAECVQLLLDLGASVSEVTINDGSTIDLIGSGSTPLHYAACGGSAVCCQLLVAAGANMRAQNTNGLTPLMVARSWHKSSVEGILTKRSEVPVRILPSSYLSLPLMSIVKIARAQTSVPPEEVRFTNVSRECGWRKTSVSSVCHDPCAICLDTECTVSAEGCGHEFCTKCALYLCATASSSTSIRGVPGSIPCPLCRHTIVSFVRLTSTTPIKELPWTNKSLALCAAGASTGSKYAGPAAITSSKYAGSLHRRSEMRSLRSSSVDLGCSSFRTASSGKLSSIKLNCTGADETMPCLVNCFRPDVQRSSSYRERIRRYSQFS

SEQ ID NO: 20965 - protein, 520 aa, Oryza sativa (japonica cultivar-group)
MTATPAVIGLSAGNRLLSASFGPTDLMPDKVSLGVGGGGGGGGGGGGGDAMSFAPPAPATPKLTAVAAHRLKLSPHGRAQVMRALRHHSSAAAALAPPPPPPPPPTPSPASRAAHAHDLESSLEAIVLLQRSMLEKQWELPFDDDNHAMAIGLAEDDDDTSKATVVVARSSVSARQRRMSGRRRGRTKNGAAHFAVSPELIQSRNRIYLRGTVSKELLTHKQVVHLSHKIKDGIWLQQQRSKLKEKLGNEPSYKQLAHSLKISPPELRSRMHESFLAREMLTMSNLRLVISIAQKYDNLGVELADLIQGGLIGLLRGIEKFDASRGFRISTYVYWWIRQGVSRALAENSKTFRLPTYLHERLIAIRGAKYELEDQGIAPTIENIAGSLNISEKKVLNATEAVNKVLSLDQQAFPSLNGLPGETLHSYIEDQNVANDPWHGFEEWYLKEEVNKLLNSTLNERERDIIRLYHGIGKQCHTWEDISRQFGLSRERVRQVGLIAMEKLKHAARRKNLEALLEDY

SEQ ID NO: 20966 - protein, 464 aa, Dictyostelium discoideum
MKYLANISNKSWLIVTQSCLGGLVFGYATGIIVGTLDPIAIKFNTSTVIKGVIVCSILVGALIGSFAGGFAANKFGRKPLLLFTALTCICGAIGSGLGENVATICILRFIHGLGVGSSSSVCPLMVAEMVPIKRRGIFGSFFQISITVGILIANILAYVIKGNWRLMFCLGSIPGGLLFFVWFVIAESPVFLAKKSAKTTTTTNQESNENQIETQPQNNQGTKFTIIFSKKMRKPMLVGVLLATLAQLTGINAFMYFSNTIFKDAGINNPEIASVALQVWNVLTTLIAIFLVDKLGRRVLLFTGSIVMTTCDLLIALFFVVLTGSAKGWSSIVFLFIFVGAFEASIGTLFWFVINEILPEDSKSIGAPVINACQWTFNTILSFFFLVVVEYLGQSTMFWIFGGIGVFCTIFLYFNLPKSLGTSKNTTEDISIPQDQLEQTIEELENEKNNEINSSKLPPAQMQA

SEQ ID NO: 20967 - protein, 368 aa, Dictyostelium discoideum
MNIQNDKERLLNGSIDEIEIITTDNNENDTIRNDDILKNSQLREQQQHQQIQQQIQQQKKESSLSTIASVIAFYFFISISLVFLNKILLSDFKFEYPLFITWYQQIISFVSIYIMTSISKSVPALSFLPEFEFKSATASKVLPVTAVLTGMVIFNNLCLEYVEVSFYQVARSLTICFSLILTYIVLKSKTSYRATMACLVVFLGFVLGSAGEVNFSWLGIIFGLLSSFFVALYSIAVKRVLPAVNGNEWRLSIYNTAISIGLIFPLILVSGEANTILDEPLLYSGTFWFYMTVAGLMGYLISISVFMQIKHTSPLTNTISGTVKACVQTILAVVFWGNPISTQNAVGILLVIGGSFWYSMQRFFEMKK

SEQ ID NO: 20968 - protein, 238 aa, Dictyostelium discoideum
MRINFKLILIILTSFYGIINCQSTCPYSKTVINGASATFYSAMDNGNCGFGKLTGPTGPGNYMIAALGTKLYQNGAQCGQCFKISNSKNASVTVMATDSCNDAGYCQRDNHFDLSPTAFSILGAQSQGVLDGLSYVKVPCRVSGNVKVMLKDGSNAYWTSFLVFNNAIDVKQVSIKLSGSSTYVPLTQTTYNYWPSSITAGSFQVRIESIGGEFIYVTIPSVVSSKIYDTGSQFSSSC

SEQ ID NO: 20969 - protein, 582 aa, Dictyostelium discoideum
MAIEEESSNSGVSTSIDNLGSSIDGKGSSKGKQGDMEGIDNEVFVYGGDENHFPSSIKYIMGNEICERYSYYALRGILTNYLISFMGYSEKNASSIGHGFNAGAYIFSLVGAYVADGVLGKYKTILYFSILYCFGAAIFSITAIPGITGDSPGERSPWGLIVGLTCIAIGTGGIKPVVSSFCGDQFGPHQKKLLQNLFQVFYWCVNLGSFFSSILSPILRTNVGYWCAFVIPAGILIISILIYLVGNKQYVKRKPQGSVLSTAFCIVGTGISESVKKTFRGSKYNDHYYNNSFLDRAKLKYSPRIVEQVKLVLRVLTVFVPLPFFWALYDQTGTRWTIQANSMDRHLGSWEIDSEIINCINPLLVMIFVPIFEYGIYRPLERKKINFTLLRRMGTGMFLSVIAFYISAIIQVHIDNSPPESVHIALQIPQYVVLTAAEVLLSITGLEFAYANSPRSMKSLVIAGWLICVSIGNMFDAFVIELIELPEYVLSLLFGSVMFVFIFIFIIIAYRFKEIDQSVLDELNGDTPMTDDNANANSKELDVVTQKDLSSSSNPIINNNNNNNNSTLGNSIDYGYDHEKSN

SEQ ID NO: 20970 - protein, 492 aa, Dictyostelium discoideum
MKLSNILLVIFLLSINIIKGSTTELNSNNLNIDDIEHDQDGDFGIDLPLTIESRYSVEFDRNIENGMMTLKPTQPSNYKRNPLSKNIDIDMQGNFYQINVNVLIGQQKFILQVDTGSTLTAIPLKGCNSCKDNRPVYDPALSSSSQLIPCSSDKCLGSGSASPSCKLHQNAKSTCDFIILYGDGSKIKGKVFSDEITVSGVSSTIYFGANVEEVGAFEYPRADGIMGLGRTSNNKNLVPTIFDSMVRSNSSIKNIFGIYLDYHGQGYLSLGKINHHYYIGSIQYTPIQPAGPFYAIKPTSFRVDNTSFPANSMGQVIVDSGTSDLILTSRVYDHLIQYFRKHYCHIDMVCSYPSIFSSRVCFEKEEDFATFPWLHFGFEGGVRIAIPPKNYMIKTESNQQGVYGYCWGIDRGDDMTILGDVFMRGYYTIFDNIENRVGFAIGKNSKNSNVGDITDINQFDSTYYRNDGNKNNFNYLSFSFISIILIINLILL

SEQ ID NO: 20971 - protein, 456 aa, Dictyostelium discoideum
MMMDCFSTPVQRNNNINNNNNNSNNNNNNNNNNCTISTSGSSSSSSGGGEINCNKNEKEVIVKVLKNGLIESNSLFKVYRFEKNMCDGGGFVLNRLIGGDKELQHIDPFVLLDEINTNSPQEYEKGFPDHPHRGIQLVTYMLEGLMVHNDSLGNKVVLKTGDLQWILSGKGIVHSEMPSSTTSKLWVIHYWLNLPKQLKMVEPDYQYVSNESIPLIQRTNGNTDFMIKVISGQYLDNETKILHKSPLKSLGLNPQVLDIDIKLNTDNNNNNNQLISADNGDNGGDNNNNNNNNNNNNNNNNNNNNNDTNDNNGENNEEYTCKKESTTPFEIDINETFGSFLLVLDGPVSINNSKPIGPGKLIVFNRKSNNNNNNNNNNNCTNNNSNINNNSGGSDNIDIDNENCTFNRVSITSKSNSRLLFFSSKQIQEPIFKYGPFVMSDMNDIHQCFIDFEYGL

SEQ ID NO: 20972 - protein, 255 aa, Dictyostelium discoideum
MAANFWESSHCTEWLLDRNKIEESNPKDKQYLTPIELKKLRTHYCFVIQNLGNALKLRQRAISTAIVYFKRFYLKNSFVDCEPRLVAVTCLYLSSKVEECITQAKKCAAKMKEIDHSFNYLMNDILECEFFVLEELDFCLIIYHPYKSLPFYLQSSGLDPASIEIIWGIVNDSYRTDVCLLYPPFVVGLGCILLGSYLLKKDIKQWLSELNVEMKDIWEVSKDLIDYYEFEKQQSLQNQSELDLLYNKLPIRNKK

SEQ ID NO: 20973 - protein, 2246 aa, Dictyostelium discoideum
MTEEIEILFWKVFKNKFIFNEILNQVHNNRWIEYDEPYNYNVYNRCKFKYTYSLQIMIRNGLLPLIKDKIKHGDHIEIDHNSIKILFLKLSKTQPIQPYNQKEITLFNISNNNNNNNNNNNNNNNNNNKYKDEDYLEIIELFMKHRRDQFEITDLIKMAVITNSPDVIRLLVNEPYSVIIYPTAFKFAIIKSNLETIKELINLESINFKNYGIKLISEKFKRKSLSLAAHRKTLKTSITEYIFNNPSLYSIPPPLSLINNQKQQTQSKNKRLKLSEILLSNFNNKNDNTTSEEDENDGVEDEDVQENEDDGAEDEGDEDEGEDDGDEDDEEEDDDDEDEDEDDDDDDDDDEDEDDEEDEDDEEEDDDEDEEDEEGHDKKIKYEYIKFEEFIKLKSSILLKSFMELDIVKGEFKNNNVNSFLKMYHPYERLKVNIQIILKYGTPSLDTKETKEILDKIDNIDQKDSNHLLKLQEFAALHFPNQKNFYFYYSKKYGGKIKQLGKVPPKTPPQGSGSGILQYHHFYKNESSFNNQDESDQDEEKEEEVDVGIQEEFEIYSDLEIENEVEEEVNVNKQREFFNNFNKFRKATVYNLSERYSSVTSIYLNAMKEGDIDTMERLDKSWNPVIRLDVSRFHYFQLPKEKEVLMKVWDYLNEHSFKQIGNNYEILMEFFSSVTDVISPLDLKISNLEDFIMKRLGLILFNTLIINNLNVFQLLLNSFDNFNFLSELVVEVNNLLNKEKILFGSGGKIMQIDNKYINQLIKSIEMAVEKYNKFISEPIENGVESFSIILNHLYDQLIRIKGISVDQLDYIRSIIPEQLLAFKCELYRTFFYLNIRSRKLTKYILTRPRISLYTEGTPNHYANHSGLYNIHSNLGPSALDLRKYLKLDIFTYDYILGRENSSSSGSGADDNNNYNNNNNNNNNTRKFINQFDTILKELIKQLSFDICTNVSNRDSIVDGKDFFNYSLNADLRFSLDIGRKDLFWELLDWIEQYMIKNENLMKYQVYQFNSPYESLLPTGAIFLNVKIIKLPSPKTKTTKTIESRILKIDNFEKPIPNESSVKIGWNTDKLIKPFKPISKLINSFKFQQDVIESICKVMNVNEIQRFIQHNFFVSNFQLLIYTYAAYNNRDDIMSFLLNNYNIKFNAFPTFSEVNKNYSQYLEYWLEKRYFEFPLVLLNSFVVYLCDQDNISDYNQFIQNNSLQIRNKVMKKTIIILMEILYNDEDEDYNLDKSFASLIKYENHKVSLIKSIIEQSDTQLYFKSALVQSLLELKERRKIRTRSIDYDENPFIHAFINGDIKTCNLILKYYPNQFKITKNLISDTLRMKNIHIIKYYYKVGNFNEPYSIIIYPTTFEFAIKCLNLETIKELVNLESINFKNYGIKLISEEFKRKSARRKTPKTTIAEYIFSNPSLYSIPPLSLINNQKQQEPSTNKKLKLSESNLNKKNNINNSDNSDNSDEGSENDEEDYENENDIDSDNCDNNEGCENDEEDEENEDIDTQQQQQQQQQQQQQQQQQQQQQQQQQQQQQKQQQKQQIQLLQVKNVNKRREFLNGFDIPLTFNDSSSSLKTLLYLSAMREGDVDKIKMYDGAFSARFRLDVSGFHYFKLPKEKEVLMKVWNYFNEHSFKQIGNNYEILIKFFSSVTDVIPPLDLKISKLQDFMMGGLSLMLFKSLLKNNLNVFQLLFNSFDNFNFGTGELGQMRDFINRENVLCCKLKELDNNYINKSIKSIEMVVEKFKKPIDKPIKDRVESYSIIINYLYDQLIRFKGISVDQLEYIRSIIPQQLFTFKLDVYRIFFHLNIRSPKLSKYILSGPKIKMFNQRRRNDSAFYNYLKQYLNLYLFTYDYILGRDNANNNNNNNNNNKKYITQFDTILKELIKQLSHDICTNLSNRDEIVDGKDRDFFKHSLNADLKFSLDIGRKDLFWELLDWIEQYMNKNEILMKHQVYQFNSPYESLLPTGIIFSNLKIIELPPPKTTVTTVTTSTIESRILKIDNFEKPIPNESSVKINWNSDKLIEPFKPISKPINSFNFQQDVIQSICRVMNVNEIQRFIQHNFFVSNFHILIYSSALYNNRDDIMSFLLNNYNIKLNGFPTFSKADNQHSQYLECKSIFENHFEKVKNISKLKLEWCESRDLQFPLVLLNAFVVYLCNDRNFSTYSEFIQNDNLEIRNKAIKEIIKILKYHYEDDEEEYNLDENFASIIKNQNHKVSIIQPIIEQPDTQLYFKSVLDHVTLKIKKERKICGA

SEQ ID NO: 20974 - protein, 263 aa, Dictyostelium discoideum
MDFSSIEQNLNNFKKLVAGNSDKAQITPVLVQLKLAATIHLEKPTSLSNVSDKVKKDLVLAREILELISLYSIKIKDIDSFERTFNQLKTYYYDYKSIIAPSTLEYQIIGLNLMRLLAKHKTSEFHSEIELIEFNNLDNSFIKFPLLVEKSITEGSYNKIIQSRSGVPSEYYQVFLDILADSIKEDIANCSEKSFKTLSLKDAEKVLLFNDNNQFQQYIKERNWKVQGDVIQFGNNDNQTVEIPSLQLIHQTLHYAKELERIV

SEQ ID NO: 20975 - protein, 1400 aa, Dictyostelium discoideum
MNFNFEQILEYNFDFKKLHKNKLKNNNLSENEDDYATTVIECLIHLCEVIPTNKIYSGANKFISCFYEFMNERFIETLVLEFYDLMTTDNSKVTTGIFDQFFSLIKKSDIIYKSFYEWDSNILENRFIFKNNNNNIDGDDDDGNEDDYFGRFSILSILEDDNSHIISNYFKFTNYERLEDLWIMICHYQATDIAKALFNLYYDSKEDCISVFASDDNNNKISISILRILEITSIEFSLPVLTVIVENTPNFLNSIPTKTSMLGMKFKLHNNNNNNNNNNNNNNNNNNNNNNNNNNNNNNNNNNNNNINKNNNDNGNGKAENIYRLSGDCKEKEKYDNNYSRETEIPFKVFDTKFLITTMECSDYIRFFTSSSIIFNTEVNQTCYDDLKLIQKRLGFLIYSNSNKFTYPFDFWNNNNNNNNNNNNNNNNNNNNNNNNNNNNNNNNNNNNNNNNNKNDDDELEKLVEYRKGSLISLVFSFAGYRFFSSYIIENLTGTNIGNPNYVFDISELMTDFEIIRGLLLSKYFSILFKSRKFTVPTLTRSTLIPILIFAFISNISYDMNCNIANVYLNYLLLNRELYKGSISISQFGCIVNYLKCQNEIEKQYSGCLKLLEGLYNHKKEKSPNEPYRIDLLFGVINDRLKAPIFINKDKYESLYFVYQEDYQNPSDPFRVLPTRSVDLSKISEGISRMKNDDFLNELEKEEKQKKLKTKQKKKIKKLENEKKQKVLQQDKQQEKEKKQNYQQPQDLQQHNLKIQTQQQQQQQQQQQQQQQQQQQQQQQQQQQQQQQQQQSQQQQQQQQSPQQQSQQQSQQSQQKSQQQSQQKSQQQSPPQQQQQQSQQPQQQSQQQSQQKQKHQKQQQQQKQEKQQQKQEKQQQKQEKPQQKQQLENQIKNLKIEIKKEEENNKEIKNKKEEVEKEKEENNKEIKSKSEFIIVEDEDFVSIGKFKFNRNESNILGRGSNGTLVFKGIWSDKIPVAIKQMQKAFNPLINKEVEALITLTNKNCSNMIRYIDKEEDKHFVYLGLTLCDVSLQYLVENGKLNEFINSSGKSLNELAKDIINGVQFLHSHDIVHNDLNPRNILTLSTNKNNNNNNKSNNKIKSNNNSNNNSNNNSNNSFIISDLGLSKMEVESSYSFTTNVPTGQGGYHPVEVLQSKRMTKSVDIFSLGCILFYLFTNGQHPFGNDKLFRIYNIMLNKVNLELLGHNLLACDLIKSMISNDESKRPTIENVLNHPLFWNVEKKIQFIDAALNICKESNNSGGGGGGNKFNKSLNYLFVISLSSDYIEPKSEPFLKQTWDKLIDINNLSIGSTSQYQYDQIKDLIRFIRNTIVHHKDIKRLIQQQQQQQKQPTIELQFINNILTNQDSILFYFESKIPNLIYHLYKQLKEYSSSFDYLIKFYN

SEQ ID NO: 20976 - protein, 392 aa, Dictyostelium discoideum
MLKLFKRIGRKKDSKIEDFYEFGPEIGRGAFSIVRQGTHKDTGDQVAIKAISKQHVSEADMKRFTREIEIMKKLKHKNIIQLIEVFDSNDYLYLVLELIRGGELFDKIVEKGNYSEKDACNLVRQIVSAVEYMHQHGVCHRDLKPENLLCSGDDEKEEIVRIADFGLSKIFEGGEELKTACGTPDYVAPEILECKPYDTSVDMWSIGVITYILLCGFAPFYADTHHELFQKILDLEYDFPEPEWNGITDLAKDFISQLLIINPEERWTASQCIKHPWLAENHGDKELKSLDSAISSMKDYVRNREASTSNILKMRASQSTPNLHSANSNTNTNSLSSSNSNNTTSNSNNNNNNNSNNSNNNNNNSNNNNNINNNNNNNNNNNNNNNNNNNNI

SEQ ID NO: 20977 - protein, 2254 aa, Dictyostelium discoideum
MTHTKLKEGDVSPNFNAPDQNGIRLTLDDSKFQNKTIIIFFYPKNESKSGANMAREFRDNYQILKTLQCEVIGVNYDDHQKNQQFAQFNDIPFSMLSDTDGAIARRFGVHKDLLIFPSKTTFVINKEHRIDTIYSNPIKVESHLKQALKAVEKMKNSPQNSTNHTVASNTTTNPAVYMVNVTNLMTNRQWNIYRRYSQFHELDSEIKSAFPKIKLPKLPKKYIFKNSTNRELVEERKLLLQKYLKDLVKHEQIEDSDCLINWLVPQNEPAFTSLNNPDKSGYLIKEGHVIRSWKKRYFVLKDGLIYYFKHQSDQEPTGMIPVIGSQIKRIGETERKFSFQIIPKNETFFPTFSIQARDEQDCNDWIKAIELSQQHFQDQEQYRKQEEEERQKKNNGARIKKSGSFEFSTLTSASAPTSPVQSSSSTSNMLPSSYQFSSDGSNNNSVCSSIGALGPNNSNNNNNNNNNSYYYSHSSNNHNHYNHHNNNHNNSHHHHHHHNGLNRGSSQVSLSVNTTSSNSSGSSSSTSLSRRHPPQKSKSDLNLSSVLHSNIRIGIDESDELYILNNSISNENLSSMLEQPGSYQQPQHQQGGGGGGGGGGGNIVNNLPPLSLTQRHISNLSSRSNSNSSGSSSGSGSSSGSGPIGSGGVGGGLNQPVKTSSQQPHHRKSNSSNNPSYISHLHYLQPSNSSSSISSSSSSSSASSASSASPFSSLFTTINQYFNPKSNLPYSPPSSPILNANNNNNNNNNNNNNNNNNNNNDFNLNNNNNNNNNNNNGNTASGSSCNTTPNLLPAPTNVSPIQNRARSSPMTSLPLPNNLLIPIPVFSLNDEYNNINNNNSNIESNNNNNNNNNNNNNNNNNNNNNNNNNNNNNNNNNNNNNNNNNNNTTELVNNNIESNDNDNNNSNNNNNNNNNSNNSLDLINKPLVKIIEPKKKEKKSKSKSKVASISDFITSKKKEKDKEKEKDKEKEKEKEIGGNISTSTTPNKKNGTLRSRALTLPVKPNDSILGTTPHHNHQNNHHHHGDISSINIIREKFISKTTRFSSDGKPRFDINQKLVSTKLSVDKKIRNFIEVVIDDIDHEATSGGNLQKQQHTQLIANDIKKLANTVLNMSVYDQREKNTQIVQSIQTLFATAISNKEMTSLVSKFLFIFSEFSRVVDVLNPVEKNLTNVINKQLQSQQQQQKQNETTGTTTGTAGSSVNPLSFSSNSILVQQKRLSRSLQSFNEINHHYSSSYHEPIIYSSSLNQYNGINIGSGTPTTTSGDNTPLTNTATSSTVSSYSEPSLISSQNQLPLSQQPQPQPQQQQQLNDSSSFPTSPISSRNDLISSNSSIYEPPLSDVASQLIEQQQEQQQQQHQEQPLQPQQQQQQQPQPQPISTLVFDKANQRSSSPILEKKSILTDLLKENYQKETTNNNGIGNMIILSEYDKKLQKQQLYPNQHVIITEEMRNKPERSFVCRICEDTYTQSQLAKHTPFCALTNKHDFKNHSSHDERLYSILNLVKGIICDSFASPNNSEQYSYLIDDEIISQLGQQLEYLFNIPYGPVESPKQCQDVINRVQAIIDENSTDMALHVFGKRICKIIEEKKALFVQYSKFQNAAQTTTSKGKKWSMWGIIPFIKDIIPSPSSKVDSSSSSQISSPILSSPPPPMKQPPPQVIVPPSSLTTSSNTTSISIADFEIIKPISRGAFGRVYLAQKKKTGDLYAIKVLKKLDTIRKNMVNHVIVERNILAMVQNEFVVKLFYAFQSTDKLYLVMEYLIGGDCASLLRALGCFEEHMAKHYIAETVLCLEYLHKSAIVHRDLKPDNMLIDGLGHIKLTDFGLSKIGIIDDKKMEDSGNTNTNTHFNFSTSPTNTSMMDDSSTTGNPNGNGNTSLNSSQTNILSPYPQRKNTLKTPLKKPVKKVVGTPDYLSPEILLGTGHGQTVDWWALGIILYEFLTGSPPFNDDTPELIFQHILHRDREMEWPEEISSEAKDLILKLLNPDPYKRLGANGAYEVKTHPFFANVNWDTLIDQEMDNIFLPKPENNYDTDYFWDRQSMYDDEAEDDFLTINQSQPQHQSQHQSQPQSQPQPQSQNLGQNNNNSESNNNNNNSNSNVSGQNINNSVSSSSNNNGSGNLNNICNNSNVNANNNNSNGNLGNNNNNKNNNINNDNDKNKNNNSNVQNNNNNNNNNILQQSSSPSSTSSSLSNSSNNNHNGGRQINNSKDSDNSIGGGKNNSKIEDIEKDPITFGNFSFTNINHLKDMNNFFLKNKS

SEQ ID NO: 20978 - protein, 773 aa, Dictyostelium discoideum
MSDSSSGSGSGEHLNRYNANDNAFVVTLVINCVVMLIFFLIFCIVRRKFKQFYQYRFEQHHKGVSVPPSDGFFSWVVDTIKYSDNSIKDTAGLDGFMYLRNVKTSFYICVVLMVISSVMLYPTNYYGKYNEHREKDEDGKLPDEVVGLTMISMGNIERGSHLLWVHLVFVFFVTIVVLWFSYQDYHLYSKERIQYKQQSRLSNYTIMLRDIPNSMFTREELSNYFKSHLSNPSDLLDVSLQYPAPHIYALVSERENFVKKYESAIESYRRTKEKPTTKIGFLGCFGEEKDSIDYFQEKIDELTKKIEYERAEAETGYYIKNANSNVGGSSFVIFNQRKVQKEMVQTIMHAKYHVLFSRYYAPDPNDVFWKNIHIGLKSYYVRSLIVAILTFALVFLWGIPVAFLSGFSNLETISRVKAFSWITDIISKSKILQGFLSGFLPNLILIIFMILLIPIIYALSRACGYFSNSRIEASVFSKYFLFLVFNVFLVSAIAGTIFQSIEQIANDPTSIIGSIANSLGGLSFQMINYILIAAAGSFGAILRIVGLIIQLIKLKWLAKTKRQIDDTLHQGPFAYGVNYAKNLLILQLTLAYSTLSPFILIFGAWYFGLSYLVQKYNIIWVNTPNYQCGGFMSPMHFRRTIIGLLIYHILMIGTFNVYKFYYGILVVICLVVTIVFWYFAEYKFKDISKSGIMDQYQKQQTDGTNSGDIEMKASGSSVINDSTSLNPTVHQEFHDASHSISEYNSNSYKPPYYELMKINNFDLDFPIGGSANV

SEQ ID NO: 20979 - protein, 871 aa, Dictyostelium discoideum
MDLFLKNNTLFSDSTSNTTIFGSETTNRYELQDNALVVSLLINTGLSLLILLAFCILRKRFKLFYQYRAEKRQNGIIRAPGTGFISWIKDTYKYNSENIIEISGLDSYFYLRNVKTNFKILLTLMIIGWVMLFPTNSKGRYNENRKVQQDGTLPDQVIGLSTLSMGNIERGSNLLWVHFLFVFIVTLVVMIFTFIDYKDYADKRIQYRKSKRLLNYTILLRDIPVNLFSKQCLKEYFQQFLINNNNNNNNNNNNNNNNNNNNLNSSSPSSSSSLSASSSSSSKSMLNNSIIDISLQYPIPNIHSLIDEREYYVKRYDSVVAEYNKSRVRPSRKSGLFGLYGKRIDSIDYYNGKINDIEVDIQDTKTKAERDYQDLMNKEKLRQESGDDDDHSINISSEVINSLKSAGNGFIIFKERNSQKELVQTIIEKRDNILLKRYYAPDPNDVYWPNIHIGGKQLYIRGLIIMVLTFLLIFFYTIPITFISGFSNLGTLAKIKAFSWLFTLINKSPTLTSFLTGFLPGLALMIFLALLVPILTMFSRFSGYYSKSAIEASIFSKYFLFLVFNVFLVSAIAGTIFQSISAIIDNPPSITTTLANSLGGLSYAMINYVLLAATSLTMNLLRISDLLVDQFKLKFICKTKRDIEDTESTDPFKYGQLYAYNLLVLQLCFAYSTLSPFILVFGVWYFGVSYLVHKYNIIWVNKPHITQLLYPMSFRRTMIALLIYHLLMIGTFNVYSFYYGSLILIPFFLTILFWVYCEYTFYSVSKNGLLDHYQSSKSSNQKSQLNSINNNNNNNKSNLNEKSSLLQSKERNNYIDIEDSNHFNDTCYSIDEYDENLYKPVYYRSLMEPEESIIDSPPIISHSKPPEILNQ

SEQ ID NO: 20980 - protein, 748 aa, Dictyostelium discoideum
MGGIDEDGMINHLFDDIPEFANSSGNDSGGKSSIYSKNETNKNSESTIENTSENVGIELGNQLEKDEFQYGGDETHFPPSIKFILGNEIGERYSYFAMKSILNNYLIMFMGYNSKTAETIGHIFNASAYFFTLFGAYIADARLGKFKTILLFSVIYCFGAGIFSITAIPGVTGSGPGSRSPWGLILGLGGIAIGTGGIKPLISSFCGDQFGPHQKKLLTSLFQVFYWCVNLGSFFSSILSPILRTQVGYWIAFLIPSIILIISIVIFICGTKKFIKRKPQGSVFSTFLKIIICGIQEKIKYLKATDDEPYQDIYYQDSYLDRAKFKFSSQSVDQVKQVLRVLLVFTPLPFFWALYDQTGTRWTTQGNIMNRRIGSITMDTEIIGALNPLLILIFVPIFEYGLYRPIAKRGINFSPLRRMAAGMILSVIAFYIAAFVQLAIDNSPPNSVHIALQIPQYVVLTWGEILLSITGLEFAYANSPRSMKSIVMAGWLISVSIGNLFDAFVIGLIKASEFILYILFGSVMLVFIFIFVFIAYYFKPIDPSVLDALNGQAPTNIDELNSIEVDQQRLDNEIVQQQQQQEEQQQQKQQGKEQQQEKSIISSKNSSPRSLKSNSLNGSTKLRKSKGFKKGDYENNIDDIDIPTSSSMCRRNTSNNNSLNNSKGNEISTNSGEIVNNNISNDNNNNNNNNNNNNNNNNNNNNNNNNNNNNNNNNNNNNNNNNNNEELQEIDIDTSSQYTINSNKSNAK

SEQ ID NO: 20981 - protein, 394 aa, Dictyostelium discoideum
MEESVSNNGGSGGGGNKVEFDQLDDGLTRIIKKQKTCLSKAISDIDTIISSLKQCKQVLSLSSNNDNNIDNNNSKLCTKLVSEHKELHAPISKFGKLVDKNFRNDIEKSTKDIGFDTKILNKVILNHLYRVGKFEIGDIFANEIGIDKKVAISIKDCFIEHHKILESIEQFNLKPVIEWCRLHREGLSSIDSSLEFKLHRLHIIQLLKNQKSDDALQYARDYLEEFSTTHMKDLQQLMGTFLFAKRLDQSPYKDIFEQQSIDDQWFEIRNTFSRDNCSLMGLPQESPLSITITVGIKSLPTLLKLSSFSVLKGVNDDSLTVEINVDEKYKFHSVFACPVSREQSTSQNPPVMLFCGHLLCKNSMQRLLKGSSNRFKCPYCPAEQNLSNVKTVYF

SEQ ID NO: 20982 - protein, 390 aa, Dictyostelium discoideum
MSSTTTNTTTATPAIQVNGNQSSSPQSPSSSTSTLSPPMSPSLLTRYREQKAVNKQIEKQLKEEKKIMDSELKLLLLGTGDSGKSTVVKQMKILHLEGYSQEERINQRQFVYRNIIEIAYSIIRGCGVLNLTIPSQFDSICSSIEEIYETKNYTNLDKNVLKGVAELSKNESFINAANNSGSNFQLHSSSQYFLDDIARFSEEDYIPTDQDILYTRVASTSVSETRFSVRGIKFRMIDVAGQRGHRDKWIHHFSEVTAILFVISLCEYDQVLEEDGKTNRMIESIKVFGDIINQRWFKDIPIILFLNKRDLFAEKIKKTGISICFPDYTGPSDDYEQSLVFLKKKILSANKTSKAVYTNVTTATDTTNIGHVFEAVKDILTRQTMEEGGI

SEQ ID NO: 20983 - protein, 1090 aa, Dictyostelium discoideum
MILKFIIQQCVFKVAKIFSDNLIQIFMDISSVYSSSTLFFSKLSLLMCKVFNSKCAGISVLNKDGLFDTIAFCSSTQELENFSYSLKKISKNITYYDYMEIPLKDSKEFYFGDIVLFGDQTLNPNILDTNILTFITNRTSMEFEKKKVSDQLIIAKNLLDQSPSCSCLVSRNGKIIRKIGAFYERLLGLEIGENISSVEKSSDISTILKQVCFENNNLSTETTITKKNGEKYPAEVFVKEISDIHSNSIGIMIIVRDITDQIRLKEMNIELQKKSELEQKRNQELMEARDLALTATKIKSQFLATISHEIRTPLNGIITMGEMLLSTSPLNTEQHDIAETIFGSSELLLSITSDILDFSKIEASKLELEMIEFDFIGCLEGIGKTIGVSITNKPIEIAFLMDTDIPHRLIGDPNRLIQIMLNMGTNAVKYTDRGHIVFRISVISREQNRCKIKISIDDSGIGIGEDQRAHLFEPFHQIDSSSTRKYGGSGLGLAISSKLAKLMGGEVILERSKPGVGSLFSVTLNFEQIGSNTLKSLLPDKSFSRNKTCIILDNYEYTASIASQRFDQIFEESNIILVKESTVKKFFELVQEYKINGDVNKIDLKNLDPELLPFFDSSLICIIVFHRFMDNLDIFLKYVKDFIEFYKKKIVVALGINHKNFKNLPKRRDFLIFKKPISSTNLIKVSNMARKIIPKSSSSSNLIQTISQIDNQQQQQQQQLQQQEQEQQHQQQQLQQEQQFVTISPHSDSSEKKTTPKKDRGKYDFNISPLRIDRFGTESTSSPKIKLYSDTSSDSGESDEFEFSENLRELKSDGELVVLKNQPYKEQRLSNIQLINDPIVTPPTPKANSEVVSTKAESTFFQSSSITIKETRSDSVNSVNSVNSVNSVNSLNSENSNNSLDVGIRTRPRILLVDDNAVNRKVVKLQLKKLGYDCDTATNGFEGFEMQKKDNYELIFMDLNMPLCDGSMASKLIRSHEELNNYKSRANIVGLSATYLHGSKDYCVSMGMDDFVVKPLKLQPLGELVKKYLEVENNNNNNNNNNNNNNNNNSNNNNSNSNSNPNSNSNSNSNSNSNPNQNPNYCNNLPTDFI

SEQ ID NO: 20984 - protein, 358 aa, Dictyostelium discoideum
MELNNIVDDEYFKSYFNLNVHEVMLKDKPRTLAYKNAIELNSIDFQDKVVIDVGSGTGILSMFAAKAGAKRVYAIEGSLMAGYCSQLVQHNKLDSIIKVVHKRMEEITDEIEDEKVDIIISEWMGFYLFHESMLNSVLYARDRYLKDNGIMFPSRADIFLAPVNMNKLMDKKINFWNDVYGFDFSILSEPALQELPAPYVEYLEKDQLVLKENKILSVNFNTITCEELEDIIVNNIDFKFPENIKPKTIHGFGIWFICYFDGSKGTVELSTAPGDPETHWKQTTILLPSGIDLEGGETMTCRLQMTQDSLNKRIYDLNLEFPDDEEQEMEQDGDADDDEEHEESCDCLKCKIIREHSK

SEQ ID NO: 20985 - protein, 447 aa, Dictyostelium discoideum
MTNNSNIENCNTIYDKQITQFKINRNGSSGCGSSNESGSLLISIKIEHILEFPDEVLLTILSFLEPNDIKNIYLSSRYLSRFCFENKIWKAICKRKWSSSPIFKRKPITNWRSYYLKKKGFMDLSGGLSWIEIFSSSGDKPSPRYQNTCTSVGNEIYFIGGQDHPENRFNTIHKFNCTTQEFTRLIPTGSSPPKFARHTSTVIGSKIYSHGGFDGFSQHFGLFVYCTIENRWETLSPTGDIPISRTNHASTSIGDNFYIFGGMYKNGSDLVFLNDLFEYNTIENKWTQLKGTGDHPPQKCGHKLFNFGGKLLLFGGGYGSQWDIKYNDVHIYDRSLNRWTKVKTKGEINVCTFTVSWSVGPFLFIYGGQSVKDDLLTNDLYMLDTVNMEWSSINTNCTPFPRDMGSGVLVGSTLYMFGGFSSTPLDSLFSLDLLKDENLNISPSPNI

SEQ ID NO: 20986 - protein, 284 aa, Dictyostelium discoideum
MGCGGSKHQGTMGHGGGGGSGGGGGYNGKKPLENKVKFQPIKDKFQSLQEVQDALRTAGLESSNLIIGIDYTKSNTWNGKKTFGGKCLHDIQPGMLNPYQEAIEIIGKTLSVFDDDNLLPTYGFGDSRTTDKSVFSFTTERPCFGFNEVLQKYNEITPLVSLSGPTSFAPIIRETINITAAAKAYHILVIIADGEVSVVNETIKAIEEASKYPISIICIGVGDGPWDTMEKFDDDLPERQFDNFQFVPFHTTMAKAENREVDFAVAALQEIPEQFQYIKQLGLL

SEQ ID NO: 20987 - protein, 368 aa, Dictyostelium discoideum
MEIDIEKLPIIDISSFQNNENDKNQVAKEINKACKEYGFFYIKNHGVDQELIENLQNVIKKFFSLPLEIKMKWKMGLTNREWLGFFKVGQEITYGQVDWKEGCYYSSEMDGDINTIHNVPLYPTAEQEEQYEIQGFKSTIHTYIEKLTHLSQQIIEAISLSLNLPQDYFFKNYTYDPFILMGLLHYPSFHHQEQEEEQEDDESNNGGKKSPNPDESKKPEVEKFGTGQHTDWGLLTVLYQDDVGGLQVKSKNSEEYIDAPPIPGTFICNIGDMLDKMTGGYYLSNLHRVKYNKSGRDRFSIPFFLDPSLNSIPKLIPNYDQLSQFADKPERWDKQNIHEFDGTYGQYFIKKIGRVFPDYVYKKSGELV

SEQ ID NO: 20988 - protein, 736 aa, Dictyostelium discoideum
MIVDEEDGPLVGEEVNNNNNNTIDNITNEESDENSGSVNNNNDNGNGVRSRFNKKDDQTSESSDDQTLPQPPQQQQQSNSNSNNSNNNKNVPKLVKMVVSSDSESDLNSNKNNINPNALIGVCADGTRFPLPYTKNPLTLHPISEWSFFDYAKNASLASLLLLLFNLPGWVFIAWFIFWRFMYNIGLGLLLRYQSNTTFITKFVKTWSNPSHPLYPHLKQFCTSGMGSDYDFDNTPAEYNAWLAFRHIVDIVLANDLVTYVVFALAYYEIPKDVGFSIIPIYLLGAFLCAFTFWAKTDAYRVVKDFAWYWGDFFFLVDQKLTFDRVFSISPHPMYTIGYTFYYGASLITQSYTVLYVSLFAHFCQLIFLVLVEDPHIQKTYPEIVEDPHITREKVKTYFGHDLVVVKNFQFLRAADLFTLLIVIYTLALNLLSLPTWFYIVQAIFWRCVLSFGLGWVLRLQSNQQWWTNKYQSVLGKDKFISFENWKNIYNLCLIMAHISFTSCFFKYVQIDFNFFGSIFWRQILGLMLILINLWSSLSTFEVLGEFGWFYGDFFIEDIPSNLYYTGIYRFLNNPDSVTGFAGFYGLSLIAGSFPLFALSIFSQVANFLFIKFVEKPHMKRLYGSKVRSQSGISKGIQEIVNELTETSPPIQKLVTKTRNLTERVERRVSDRINSFVDELQKHGIPLSTEQFEILKTLKEKYNNNNNTSPSDSDNNNSNNNNNNTNSNNNKKSKKI

SEQ ID NO: 20989 - protein, 1431 aa, Dictyostelium discoideum
MTKPIFKSKTKPLGWSKISSKEVINEDEEEEEGGEEGGEEEEIDNNKNSNNSSSNSNNNNNDTNNNNGEERKVEKEEEKEEINHYRNQFEKDLLDMELKALNRETIDNILSGLNSYEIFKEVNFDFEKLYSIIISEPPPLFDTFFDSVSSFEIFFTDCLILLCSNFPDGIDTSITRPNFNDFYNHFKDRGVINKYISRENIHKALNDKLMTDYFNSGIYLGLLDTLDIAAIRFITIFGKFLSYEVVETISNSLFRYRTDKIEFLSDIIRELLLCNEKYRTLSKSYDLVQKRLQKEEFTFIKVFEDDDPKLFSALYQPPDIIKLITEPEKDSGFWCMIGIFKSKRILDYLIRTEPSKSWFKGKESDYFFSIAEMGGKYFNWTLLEPKLIKKEVNQKSLKGVIPPRELNSQQRNTQFFRVFNGVTGFNDIRFVYANPSLAQHAIKFIQKVTECGLFLNTDVRNVRDSIPNSNSFLFRKFLEVNFFYRYEKDNEVYQHQPTEENSLLYSTSIISRIVEMEVTDLLSVVLKNLTQQGCSLAREAVDERSLLSTIHSDKYYNSSIVVLHNYWPIPPKFCDCSTSFISMANGKLPRTYSGSDGVIPYIFFARNHLTLGFLLSIHNNITDTIDINHWISVAISGGLYYDKEEIFRKYPLLQKESTLQKYPRPVNILEFQTLLENNECIEYIARTFIKEIPPHEVPTVKHSDLLILFEISVMKKRSIRSKESLQAELDLIEEEKREKKKQKDKKKNKSNQNQKNNNNQNNQSNNNKINSPSSNKLTQNVTPPSSPVNIITSSSTTSSSTSSTTSSTTSSTIEPKPPTQTLPIKTSSPTKPESQKPSTPDPLIPKSSKSTTKNNNNNNNNNNNNNNNNNNNNNNNNNKENREMALEVINEMEKIEIEESLLSTSSLVQPQQQSQQSQQQQEQQQQQQQQQQQQQQQQQQQQQQQQQQQQQQEKQQEQQEQQESIQLNQTLTPIIPDFQIGKFKFSRDENNIIGRGSNGTLVFRGIWNDRIPVAVKQMQKAFNPHISKEIEVLIRLTSNNCSNMIRYIDQEEDQLFVYLGLTLCEESLQDLMESKRYKEFIEKTTTTNITTTFNNNIIDENLYEQRILSLFKDVINGINFLHCQDIVHNDLNPRNILVHKGNFVISDLGLSKMQVETSYSFTNNAPTGQEGYHPIEVLQEKRKTKSVDIFSLGCILFYLLTNGQHPFGNNKLLRVANIVYDKPDLEPLKFNAPALDLVRLMISQDEKKRPTIDTILNHPLFWSTNEKIKFYESSLNLLKDPNNSQSKHSKLLNYYQNDNSGGVLFLSKPWNQIIDPFLIDHVENNNNNNNNNNNNKQNSKKLAIVAYQYDQVRDLVRCIRNSLVHHKDILRSITQQQNLPPSSKEFANDCLKSQESVLLYFECKFPDLLFHLYQQFKKSDFNSKDYLNIKF

SEQ ID NO: 20990 - protein, 948 aa, Dictyostelium discoideum
MKLNKSYILIVVLLLSLFYSSVSSTKTTLIKSNNHYNSDNSNNDNKNININNNNDGDGDDDDDNNKILITPENQNHLIHDIGIDSSSTEILFGSSSNSGSCGEKNNTKQNALANQREANTIIFIIMLILTGSVLIVYFIISLDIPFVPESVAVVTYGIILGIVFRFFYSDIVNHVVSFEPENFFLFILPTIIFETGYSLHKTDFFNNIGPILMFAVFGTIITFLVVGFGIYIVGYFGVSIALSLKDSFAFGSIISSTDPVCTLAIFQALNVDPMLYILVLGESILNDATSMMLYSVVEDTSTRDIIISCAMFTVVAIGSVILGVVMALLLSLILKWINIGKFPALETIFMVMFSYMSYVLAGALDISGVLAVFFFGITLNQYGAYSLSPYTKLTSGQLFRTAAFISETFLFLYFGLSLTAHEFKFDLGLFSWSILFTCLARAISVFPMCFLLNKFLKTKIPWVIQVAIWFAGLRGAFAFSLSLDYISEDEHMNAYIRTNTLLVVVFTIFVFGMGTYPLLRVLGIKTSQTDQSLDNISKPMSKQTKQKDRTKLYESFDDKYFKPWFRKRVPPLANEAIEIFEKMVIQSSHDHELDSNPLRFDDDEEDDDDEDLDFDSDLDLNININTDSIHQSDNNNNDNGNNNNNNNNIIINNNSQHHSNDGINPWVYQERIDLYKTLINSTNIPVFGTDNLNNCLYGLQLQLEWQNRSGRLEIQNSTNINLKSWWGNMNYYLSVIPYLSAMNNGLVPQVEIFKIDDNRFCTTYLECDQNIMHQWDIFFQEIINIKNNGSFGNDDKILKVMWDAHIGSIGQASQIFQDTLSLLPLKEKKFGNGWAHFVDVIAVVNFNTNYTQVSTLSKSLPSSMISIFDFPPFIPRFSKNQNNVVMSMFAIDDIAQSSLTWNLFITLIKTATQNENCRNLINNEINNFITSPTTTFITILINILTNKC

SEQ ID NO: 20991 - protein, 299 aa, Dictyostelium discoideum
MWIPDKNSNRPDLLATTGDYLRLWEVGSNQRSIKLKSLLTNVIGGSSSSSSSSSSSSSSSSSSSSSSSSSSSSSSSSSSSSSSTDISSEFCAPLSSFDWNETDPSLLATSSIDTTCTIWNIETGQAKTQLIAHDKEVFDIAFARGTDLFASVGADGSLRMFDLRNLEHSTIIYETPSFVPLLRLCWNKQDPNYLATIQQDSPKVIILDIRVPSVPAAELVFHKSAVNGISWAPHSSCHICTVSDDKQALIWDLSSMPKPIEDPLLTYNALAEINQLSWSSSQPDWIAIAFSSHLQILKV

SEQ ID NO: 20992 - protein, 335 aa, Dictyostelium discoideum
MKFNTIFLVLSIVKFILISAQSCPFSQSIINGASATFYTAIDAGNCGFEKLNGPLGPGNYMIAALGSKLYQNGAQCGQCFKISNSKNASVTVMATDSCHDAGYCQRDNHFDLSPAAFSILGPQSQGVLDGLSYVKVPCEVSGNVKIMMKDGSNDFWTSFFVFNSKVIIKQVSIKLSNSNQFVPLSQTTYNYWPTSITGGQFHVRIESIGGEFIYVTIPKVESRKVYETSGQFSTSCSNLNENNPINYKPQTFNSQQTSNNQNSNTQTPTKQPSPNSQNFIPSYCQQYIQKPNYIFAKESKEMLVLNENENIESNSLKLLPNFLLLILIILLNINF

SEQ ID NO: 20993 - protein, 329 aa, Dictyostelium discoideum
MEQQKAPQVTYLEVGSLVGHNGFVTSIAVSPENPDTIISSSRDKTVMVWQLTPTDATSPGKAHRSLKGHSHFVQDVVISHDGQFALSGSWDNTLRLWDITKGVSTRLFKGHTQDVMSVAFSSDNRQIISGSRDATIKVWNTLGECKFTLEGPEAHQDWVSCIRFSPNTPTIVSGSWDNKVKIWDIKSFKCNHTLTDHTGYVNTVTISPDGSLCASGGKDTFACLWELSSGKPLYKLEARNTINALAFSPNKYWLSAATDDKIIIWDLLTKQVLAEIVPEVKEQAFDSKKKKESKPKAPACLSLAWSADGSVLYAGYNDGLIRVYKSSSQ

SEQ ID NO: 20994 - protein, 349 aa, Dictyostelium discoideum
MGCFNSKEAGAGRPKTTTQQQQQATPEPTVTTAEVRADEKISMDQDISQGNVEDFYVVGKELGRGAFSVVREGTRKTTSDKVALKYIEKKFVKKKHIEQLRREIDIMKKVKHENVLSLKEIFESDSHLTLVMELVTGGELFYKIVERGSFTEKGARNVVRQVCAGVEYLHSQGIAHRDLKPENLLCNGEGEDMTIKIADFGLSKIFGTGEALETSCGTPDYVAPEVLTGGSYDNAVDMWSIGVITYILLCGFPPFYASSQNLLFEKILTADYDFPEPEWTHVSEHAKAFIRNLIVKDPDQRHTAKQCLDDLWLSGSDQSIGSAADLHSHFAEKMKKYNDQRRGGQSSNN

SEQ ID NO: 20995 - protein, 356 aa, Dictyostelium discoideum
MLSSILKKIQPSLLVNFRIITRTYATKEVTVRDAINSALDEELARDEKVFIMGEEVAQYNGAYKITKGLFDKYGGDRIIDTPITEAGFAGIGVGAAMAGTRPIIEFMTFNFAMQAIDHIINSSAKTHYMSGGKVFNPIVWRGPNGPPTAVGAQHSQCFAAWYGSVPGLKVVAPWSAADHRGLLKSAIRDDNPVVYLESELLYNYKFDLSDQEQDKEYLVPIGKAKVEREGKDVTIVGFSRIVSNCMEAAEILAKEGISAEVINLRTIRPIDAETIVNSLKKTNKLVTVEEGWAQSGIGAEISALMMEHAFDYLDAPIERICGADVPMPYASNLENAAMVQTQNIVNAAKRVTQRNK

SEQ ID NO: 20996 - protein, 1671 aa, Dictyostelium discoideum
MSSPHIELHSQRTLSPQPSSNNFELTGNKSCALSASLNGSIDDLNNNNNNNNNNNNNNNNNNNNNNNNNNNNNNNNNNNNNNNDGDKNDKKLLIITNAPTPPLTPPQPTKTQQTLLELNQKFQEQQQQQQQQQQLQKQNKQQQSQKQQEEPPSSQQEEPPLSQQQQEQEQEQEQEQEQEEQSKQKIEGKGGGGEEEECEGGGGGEGEGEEQFKEGDEEEHEGIEIDPNLPTTGYTGKRRSSLQINEASPKLIQTPSVDRTLCILDSLPCPIFQIGIIENTENGNITLTGFANERLTTLLSCSSNLLVDSLKSIPSPHYNTVPSLESCNSIPINNLAPGLLPNTDPTKILDPYISLYNKKQLKERYSNNNNNTNTNNNNNNNNNNNNNNNNNNNNNNNDTTTTTTTTTTTTTTTTTTTTTTTTNESDNNNNNNNNNNNNNNNNNNNNNNNEEIKQNTKEGEEILHESTNSTGTGNSISRPNSILQCILDSFHEQKTITEKVLLSNFLIRQQYKSRATIKPFPDGCICIFEYIENINLNYQQPPTSLNDRINSTNKLTNEMELLSLSPDSNHQHVQKLHNHNHNHHNHNHNNTTQRASSTDSPFIHSVSANSLSSMSSNSSVTSACASLSSNSSSNSNNNSNNASSSNCSSNANSNNTNSSSSNCCCCCNNNNNNNTSSTSSTISSASSTKSKSYLHQQHKNSKVYSTLLNSFENLSFLLKSTPIIIWRADHNGEMVFFKKSDEIPIDEKKVVGNNFQDFLQWVPQTYRTNFQEMFQNSLKCGKIFEFLFWFQTPQNYVQLFKIAGYPIFHIDGKDCIASKRYLIGWLGVTYNYLINDGAEISIKGSANLDSMYEKFKIIYEMPNIERTKLTNNGISSGGDITNANNNGGSSESSNKILEKKKHLISEAEKECFLKCKETYNILFKLSLLGVMFSTFKGIILDANDMLLQTIGYTRGDLENGKIDWMLLTPPEHFEISARALQELKAKRWCQPIEKAYIHKSGKRVPVLITSAMIDGSTEQCITFVFDLSRYRQAEMAAIEATRLKTQFITNISHELRTPCHGIVGMSQLLLDSQLTNTQRDNIDSIKRSTDSLISLINDILDFSKLEYGKVTLENESFELLPMIEEVLDSQATAANRKGIDLIFVMGRDYPVPPVIFGDRNSLKKVLLNLVGNAVKFTETGFVLLEISTDYESGDQISLRFTVKDSGIGIPENKIEQIFVPFGQIDGSFSRKYGGSGLGLSFCKELVALMGGYIRVESGDQEGGKGTTFWFAIKVSISSPSYLPNSVPAANQFFYPEYRPSHYNNVIGNGDSPKNVLIIESNQMVIMSIQSILLSMKCECISASKAITALDLLESSKSTENQIDIIVCSDKSTFVQQILDYVTTEKVILYGVDPNSKYNENSKVYSYLVTPITHSKLISSILLSKNLKSKNSFLTTTNNTNNTNNTNNIENKSSIDSPLSITSTSSSIITPILTSNNLDLNNNNNNNNNSILVSNNGGVDGGNNVPSTLTTIQQSQPKKYILVAEDNDINIKVVVRQLEKLGYTAIVGINGLKALEIIGSFPICLILLDCQMPQMDGFTCSTILRQIEPTGQRIPIIAMTANDSKDRCFEVGMDDYLSKPVRVDRLQKTLSDWIKTDENGNPTNSYNFYPLSYSLVYNNFIDTQLKKEKNDD

SEQ ID NO: 20997 - protein, 555 aa, Dictyostelium discoideum
MGIEDNSQQPNTGSPYGQSPPSQYNPYGQQPPQQQQYNPYGEQQQQPQQQQQYGYQPQFQPTYQQPPPQPQYYSQAQMPFPPQQQQPPPITNLNKANDRESLIGGVGGGGIPPNNNQTMVGSYNEGETKFAPPKYQDIWFSILFGLNFGLLIVVSASAFAKTPYTYYDSNYYDNTSGGSFGFLFAILPFTIVFSLLYIWAWLKLAANHAESLIKYSFFGAMGLMIGYCVFFFVWGAIYLGIIFAIMAFFIILFYISCRSRIPFTATLLSNAVAIIKEYPSVIRAGYVSIFINFVWFIVWGSAFARVNMVYTGAIQTCINIYLVFTLYWVFHVIKNTLHTTVSGLLATWYFCSGPNGVGMPHNPTLGSARRALTTSFGSICFGSLIISLIETLRYLSQMMINNRNVVVKIIGYIFNCILSMLSSIVQFFNTYAFTHVAIYGKSFCDSAKSTFTMFENRLGSTIINDNFVGTTIAIGGLVASLLLSILGALISIPFDMSVYGGALALFIGYLVIITNLEVVYSSTISLFVCYVMEPEVLAHTKPQLYQLYSSTYHLR

SEQ ID NO: 20998 - protein, 500 aa, Dictyostelium discoideum
MKVSLSFLLTILIVIITIKVNLSQEIKISPFFANNLKFEPIPDYIEYDSDSDAGEALFLSNYLDDHKTAKQKSCVDIGAPFQSCDKLLEIDSNLRDTEDFFTFTGFITVNETYNSNTFFWFLESQNGDKNSPLVIFLQGGPGGASTFSLFVETGPYELLDNFTLVQREITWNSEFAMLYIDNPVGTGFSFTDSQEGYSNNEDEIATNLYTFLQQFYKLYPEYYTNELYITGESYAGKYIPAFSYHIIQQNQNSNNPNINLKGIAIGDGLCDPITQVTQYANLAFYTGLADLQQQEVMFEYQDKIVEAINQEQWSVANDLFTDLINGPPDYFQNITGESDYYDIRKTVEPTYGGDFTAFLNQSSIRAMIHVGNNYFQNNNDVYIHLEQDIPKSVKQLFPTILDNIKVILYNGQFDFIVGPSLTETMIRTIEWEGIQPFLESPKIIWKIPSDNVDVAGFVRQWNSFTQVVVRQAGHMVPLDQPARAFDMIDRFINNEPFPSG

SEQ ID NO: 20999 - protein, 247 aa, Dictyostelium discoideum
MADNDNSLNKQVETLKNDAISTGKTAVELAQEKGANVYNETTNAINEGVKYVSDSISTAVEVTKDAAVNMYNTTTNVMNEGYETLKTKTNEIISGAIDNSEQVKEDGSKKVEDVKETANEITNDLKQKSEDLKEDASNKVEEAKDKANEITNDLNKKGEDLKEDGSKKYEEAKDKASELTTDLKKKGEDIVDDANDKVEQLKVKGTEVSNDLKKKSDELSNDLNEKYNDTKKETANKLNEISDKLEQ

SEQ ID NO: 21000 - protein, 337 aa, Dictyostelium discoideum
MNHSSKKNKNRILRNKARIYCDVNLHKPKEYGNYEALNVKWETQDDYEIIRKIGRGKYSEVFEGANIKNNEKCVIKVLKPVKKKKIKREIKILQNLCGGPNIITLYDVVRDPQSKTPSLIFEYINNTDFKHLSPTLTDFDVRYYIRELLHALDFCHSNGIMHRDVKPSNVMIDHQKRKLYLIDWGLAEFYHPNQDYNVRVASRPYKGPELLVDMEDYDYSLDMWSLGCMFAGMLFQKDPFFHGHDNIDQLVKIVKILGTEEFYAYLDKYGIVVDHTILSIIGKHPKKPWSRFITKENQHLAVPEAIDFLEKLLRYDPAERLTTREAMEHPYFKPLSH

SEQ ID NO: 21001 - protein, 514 aa, Dictyostelium discoideum
MICAISGSTTEEPVISTKTGNVYEKRLIEKYIDTNGKEPTTGEPLGLSDLITVKIGKTVKPRPTTATSIPSMLQLFQNEWDSLMLETFTLKQQHETVRQELAHSMYQYDAACRVIARLVKERDAARSALANARNIVQQQQQQTNNNNNNNNNKDVEMSSASTPSSSEDNLLDSTIYKRIAEKSEELIKTRKERTHQSLAEPDAIKQFKVSANVETDCQIKSLEVNSQDNNLIAMGGINGNVYVYSRETNELCTAIKGTSSAPINKVLFAPNNTIVSAGSDAVIRVVKGGESPSKKTYTQYKSTYQFAHKASVTDISLHVLGDYIISSSLDKSLNMYDIVNGTHLTSFGQSQQLCYTSVAFHPDGMFFAAGTQNGVVKIFDLKSKVNSFNFQGLSTAVNCISFSENGYYLTAADNNTVKLFDLRKAATKNSPDIQTITLDNQQIKSINFDYSSQYLGVASSNQINLYSCKSKQKPPISSIHSIDSDCLDFKWARPNSNFFVTSSSSKNIVNIFSN

SEQ ID NO: 21002 - protein, 754 aa, Dictyostelium discoideum
MTYNNSNSKNKIKNKYYKQEDETINEDENDIKEEEEEEEEKEEKEGNINNNNNSNKINIEKDTNFIDKTNLGNGEGDSGGGGGDSGGGCGGGGNDDGKEKKNKLKANEHAPKILSSYSISSSCGNPHHSETSTTPKQPMTTTTTTTTASTANSLSSLNTSSSLGASSSGILNTSNENTPIIGGVLKIDNEILLNSGHKKTLPLFNLICLTICFLGVQFGWALQIAFSTPLFLELGVEQKWVSYIWLAGPISGLIVQPLVGVITDRSECRFGRRKPFILIGSVFISIGLVLISNAETFGSYFGDSEQKKSIAISIAIVGFWILDLSNNAVQAPCRALLVDIAAPSQQSLGSSLFSLMLGTGNLLGYMMGSIDLVRMVPFMKTDTRALFTLSIMVLLFCVVMTLGFVTEEQYIRVNEDQSVENPLKTMFKGIVKMPTYLQRLCAVQFFSWIGWFSFVLFITTWVGVNVFGGDPNAPEYSDSRILFQDGVRWGSLSLTISSGITIAVSLLIPFLVKFIDMKYIYIGGNLLQCIFFALFYFVESKIGSLLLIASTGIPWAIVMILPFSIVGMGVEDNESSGLNIGTLNIFVVVPQMVVSLGIGLILDLSKGNVVYSLLTGSVASFFATLFCFRIIIPKHHGHPIGDIEEIHFNIENNNSGNKYSPMYKSDNNNNNNTNNNNNNNNNNNNNNNNNNNNNNNNFNNNNNNNSDNNNNNQSIINNNKIDNNKSPNQKDIEPILNLNDSYQVNQSQQSYSNY

SEQ ID NO: 21003 - protein, 456 aa, Xenopus laevis
MQGYIQESDFTLVEEGFLARDLMEEIINEVSQTEDRDAFFVADLGDVVRKHLRFLKALPRVKPFYAVKCNSSKGVVKILAELGAGFDCASKTEIELVQDIGVAPERIIYANPCKQISQIKYAAKNGVQMMTFDNEVELSKVSRSHPNARMVLRIATDDSKSSARLSVKFGAPLKSCRRLLEMAKNLSVDVIGVSFHVGSGCTDSKAYTQAISDARLVFEMASEFGYKMWLLDIGGGFPGTEDSKIRFEEIAGVINPALDMYFPESSDVQIIAEPGRYYVASAFSLAVNVIAKKEVEHSVSDDEENESSKSIMYYVNDGVYGSFNCLVFDHAHPKPILHKKPSPDQPLYTSSLWGPTCDGLDQIAERVQLPELHVGDWLLFENMGAYTIAASSNFNGFQQSPVHYAMPRAAWKAVQLLQRGLQQTEEKENVCTPMSCGWEISDSLCFTRTFAATSII

SEQ ID NO: 21004 - protein, 629 aa, Danio rerio
MSVSSFRRGQWASQSLRVTAKELSIVGVRGKNTAIAERFSKYQKAAEETSLDKKKSPEKSTPGLRNGNLSVLKQLWEHPAETPTSPEPKAHLQNHLQQSAVKIPLESTDVQLIEGTDQQCLSDSDQPMEKRTQRDVETLIEKPTVPLNSLKMMFEKGETLHSNVSREPGTTGDSGSDNMEPGTKESLECGVKMLDSTPLRDRMAMYQAAVTKLDFPSSPNSEAADSEARAHSGKQKENVPPVSADVCPESNTIKSPAPDRNGSVLSPEQNQPKLVKMFPLPVRETCVTCLKTVYPLEKLVANQQIYHNTCFRCAYCNTKLSLVNYASLHNNVYCKPHYCQLFKAKGNYDEGFGHRPHKELWEGRPEGVDDQVKLSPQETSLTVEESPLVKVNVLAATLETRTQATSERVEKPLETGQLKISWPPQSEGDESATHTVTDGSGIKPIRPKWPPEGDTVSSNVDLESDLPKLRRSVSLKERSKPFCIFDSAPVAQPKRCQRSPSNEKPDSEEEMSPVSSTTDTTISSEDMTEHNQSEEEDQDKTKEDEQMEHEEKVDVQEEELSSLKCSTPDNSPPLSPESESGLDPEENQASQDVGFWDGEEAEEDTADVTVEDLIKRNRHYDDEDDEDVV

SEQ ID NO: 21005 - protein, 308 aa, Oryza sativa (indica cultivar-group)
MMDLGLSLGLGLASQGSLTSSTTTTSSPGAGSSSPWAAALNSIVGDVRRDQAAAHAAAAVGVGVGGEEMYQGRASTSPDSAAALSSASGKRERELERSGSGVDDDDGADGAGGRKKLRLSKDQAAVLEECFKTHSTLNPKQKVALANRLGLRPRQVEVWFQNRRARTKLKQTEVDCEYLKRWCERLADENKRLEKELADLRALKAAPSPASASAMQPSSSAAATLTMCPSCRRVATAGAPHQPNHQQCHPKSNTTISSSSTAAAAVAVAGGNVLPSHCQFFPAAAAAADRTSQSTWNAAAPLVTRELF

SEQ ID NO: 21006 - protein, 277 aa, Daucus carota
MATVDHSNSSTKARVTRKSRWSLAGMTALVTGGTRGIGHAIVEELAELGACVYTCSRNEQELNERLEEWRAKGFDVTGSVCDVSSVTEREQLFQRISSCFGGKLHILINNVGTNIRRATENYTAEQYSIVMATNLEAPYHACQLAYPLLKASGSGCIVFNSSVAGLVHLGTPGSVYGAAKGAINQLTKNLACEWAKDNIRTNCVAPGYIKTPPVEKLFERKNFLDRLVSRTPLRRPGETEEVSSLVAYLCMPAASYITGQIIAIDGGLTVNCFERVV

SEQ ID NO: 21007 - protein, 340 aa, Sitobion avenae
MNELDSLRQEAETLKNAIRDARKAACDTSLSQATTSMEPVGRIQMRTRRTLRGHLAKIYAMHWGSDSRNLVSASQDGKLIVWDSYTTNKVHAIPLRSSWVMTCAYAPSGSFVACGGLDNICSIYSLKTREGNVRVSRELPGHTGYLSCCRFLDDNQIVTSSGDMSCALWDIETGQQCSSFIGHTGDVMSLSMSPDMRTFVSGACDASAKLWDVRDGTCKQTFPGHESDINAVTFFPNGYAFATGSDDATCRLFDIRSDQELAMYSHDNIICGITSVSFSKSGRLLLAGYDDFNCNVWDSMKAERAGILAGHDNRVSCLGVTEDGMAVATGSWDSFLRIWN

SEQ ID NO: 21008 - protein, 204 aa, Mus musculus
MEPKAPCPAAVPSEERKFRVLVGVTGSVAALKLPLLVSKLLDVPGLEVTVVTTERAKHFYSPQDVPVTLYSDADEWEMWKRRSDPVLHIDLRRWADLMLVAPLDANTLGKVASGICDNLLTCVIRAWDLNKPLLFCPAMNTAMWEHPLTAQQVAQLKAFGYVEIPCVSKKLVCGDQGLGAMAEVETIVAKVQAVLSQHGSIQQS

SEQ ID NO: 21009 - protein, 2344 aa, Dictyostelium discoideum
MNDSNSSNDSCNTENNTLTATKNSINNTTTTTTTPNNNVNCLKTSGSIKLSASSVPFIPGSSASLPSILSNQYKLAASNNVSNNIMMISTPIISSAQQQQQQVPPPQQTTTTTTATATAITPTPITTSQSTSSSMLNLPLKVGKESIETLFRNRFHPKNNIRETVLSSLQSILIPDLSDTINNTKENIEYFYNMIIDENNYILKLLLLNIINDTKRNLVVYNYNQQHQLPIQNTSSPNTPSSTTTTTTTSTKPSKRGDKERERGRRNKDKINEKQLQQQQLQQLQLQQQLDHEGSSLYLPFSSLLSFIKPDKQQQPQQSQQSQLNEIDQMVRPKSLPKDDNDSDNFNIRVLEYNLKLLIKIYFKVSMYQDSIKTHIFDLYIQINQAISEQQRQLQEKEKESKTSKPIPQPIISLVIPTVLVSIGDIIKYKYATPSPPNLTPTTTTKMEEEERIINTILINEFKKTDVSIIESNLYLFECILSISVSNEPTIVVPNTTTATTATTATTSNTSTAAAATTTTPTLSTSSSSLSPPASTQSSLSLSSSSSAVIAPTTVGYIFKFNKELFRKLIALVYSTVVQHQITLSTVFTTLVLKGYLNEDQIQKLLNITLFKLSDPSEQVKLSYLTLLSKMVSYFDLNHQKNLNHKVNDISLPYKLLIMGSTSQPFFNGQIFKKIFDWIMGIGKDQPSFDSLTKYLIDLFDSFNVISILFNEQNKILSQQYLAAQSTMITPPLSLHQIDDRRKFETLISKSDELIWFWTVWECSKFCIANRLKSPYGSAFQTFEIFEKLLLQLNKDRRDFKKIKILLHFMESMEKLIFSTVNGSVLVQSLNNKETQFFRHNVRVCEDWFSRIRVNLLKASILSSSTPDIIRHASLRVQDIQANRFVLDSNTAHFELEFCILHLANALQQLNETESLQGLSNWSDINLNNSDNNNNNNNKNNNNNNNSTFFNNGNINKYTLKLPWMKGVILRSKQKFEESISSLLSVPPMLESNSISFPFVLEQIIKSYLDISNFTEVEQFLQNYQNQIQQQSNSLIIYKDTFIKTLGSFYRGEMEEAHAFAKRTESQNHILQREQLGLGLLGNQIMTDELLLSIMVNQKDLFNNTNIINNNNSGGSSSGTATATAVTTTTTTTTTTTTTTTTTTNTNNDIIGFSNNINSMLKLTKNNILKALNYLGLESNVQTFQYLTQLKIMDEIENGVYNSRVVPINNQIGFLERLRRVRGHISNTKQRSDILLSNIPLTEKMIKLSRKFENYKFSSKLLDTILESHSSSYYLERCKLKYLNGKQTEATLDLIKYAHRDITIPSSSTTTTTTTTTTTPPSTSSNTATTTNNINIDELSTQKFKVYTEIIKYLNSNPSIITELSSSNYSIPQEQLNPEYYFKKATLTKPENSKLWITYADWILNEKSNISEQNDEESLNGGGSGGNENSSNEMLRLKNTNTNELKTAVEAYFQFLKYSMLDGNSNGGLNIRATLKILNILVCSGNKLVETFERCLNELTSTRPFTIIIPQLFARLSHPDTFVQKYVVEILNRIGRDNPNKIVYQTIVGSLNFTNTNNNNNSSCAAATTDDGLDIELLQKQYPNYLQILNIKENLLKHSELLVKETETLIYQLGKLTTLWDDNWQYFIEQIQGWVYINTKQWNDDYQQLKATIKNPTILKHTLKKKNQELLQPIYEKLKRLTAATVLSVCKTPHEKWFTKCHFETINKTIRAFEKQNKPTSPFDVLHDLIAEFQQYRLISLSLSSVNPSLALFRPTITQMPGTDLNYFNINHIHHHHHHHNHHGNNNNQHSTSSGNLPIQNQVTIQLIKPTIYLLPTKTKPKKMAMLGSDGNLYYYLLKGREDLHLDERIMQLLNVVDQLLMNDKKPTLKLLRTRNYSVIPLSQSSGLIQWVEGAVPLFSIYKNWYKNDQVYKQQQQQQQQLQHQQQQQRQQQQQQPPPQQQPQQQPQQQPQQQPQPQQNSTTTSNIVNKPIIARPVDIFYAKITPLLEKAGLNFMTPRSEWPKEILIQVLNELMQETPKWILQRELWFSSSSSSELFLKTQSYSRSLALMSVIGYMIGLGDRHLDNILLDLKTGEIVHIDYNICFEKGAELKIPERVPFRMTQIFEYALGLTGVQGTFRETSIQIMHLLRKNKDILLNLLETFIYDPLFDWKHSNKQTNNNNNNNNNNNMNQAAGEQESIEKKQSSNNSSNPIISTPTKLQQQQKLPNSPLSISSNNTNSTNNNNNNNNNNNNNNNNNNNNNNKDQDSDSSQSQEDEDNNVVEGEGGEGGEGDIDELNLVQDSSNGKDAFKSIQGLTVVNQVRLKLEGTEKKLSIPDQIDLIIRESMNVENLSSTYEGWSPWV

SEQ ID NO: 21010 - protein, 184 aa, Danio rerio
MSDEGKLFIGGLSYDTTEQSLEEAFSKYGTIAKVDVIRDRETDRSRGFGFVTFENPEDAKDAMAAMNGKQVDGRMIRVDEAGKSGGRSGGFRGGSRGGGRGFFRGSRGRGGGGYGGDRSYGSDRSFGGDRSYGGDRSYGGGDRGYGGGERSYGGGDRSYGGGGGGYSNRSGGYSSGGGYRDNRF

SEQ ID NO: 21011 - protein, 245 aa, Danio rerio
MDKLELIQKAKLAEQAERYDDMAACMKQVTEQGEELSNEERNLLSVAYKNVVGARRSAWRVISSIEQKTEGNDKKLQMVKEYREKVEGELRDICNEVLTLLGKYLIKNSTNSESKVFYLKMKGDYYRYLAEVAAADDKMDTITNSQGAYQDAFEISKKDMQPTHPIRLGLALNFSVFYYEILNSPEQACSLAKQAFDEAIAELDTLNEDSYKDSTLIMQLLRDNLTLWTSDNAADEGEGGDGGEN

SEQ ID NO: 21012 - protein, 200 aa, Homo sapiens
MKAVTELNEPLSNEDRNLLSVAYKNVVGARRSSWRVISSIEQKTMADGNEKKLEKVKAYREKIEKELETVCNDVLSLLDKFLIKNCNDFQYESKVFYLKMKGDYYRYLAEVASGEKKTSVVEASEAAYKEAFEISKEQMQPTHPIRLGLALNFSVFYYEIQNAPEQACLLAKQAFDDAIAELDTLNEDSYKDSTLIMQLL

SEQ ID NO: 21013 - protein, 477 aa, Solanum tuberosum
MATAATLSPADAEKLNNLKSAVAGLNQISDNEKSGFINLVGRYLSGEAQHIDWSKIQTPTDEVVVPYDKLAPLSEDPAETKNLLDKLVVLKLNGGLGTTMGCTGPKSVIEVRNGLTFLDLIVKQIEAFNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAVKRLVEADALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLEGKVTIAAKSGVKLEIPDGAVIANKDINGPEDI

SEQ ID NO: 21014 - protein, 477 aa, Solanum tuberosum
MATATTLSPADAEKLNNLKSAVAGLNQISENEKSGFINLVGRYLSGEAQHIDWSKIQTPTDEVVVPYDKLAPLSEDPAETKKLLDKLVVLKLNGGLGTTMGCTGPKSVIEVRNGLTFLDLIVKQIEALDAKFGCSVPLLLMNSFNTRDDTLRIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGRVQLLEIAQVPDEHVNEFKSIEKFKIFNTNNLWVNLSAIKRLVEADALKMEIIPNPKEVDGVKVLQLETAAGAAIKFFDRAIGANVPRSRFLPVNATSDLLLVQSDLYTLTDEGYVIRNPARSNPSNPSIELGPEFKKVANFLGRFKSIPSIIDLDSLKVTGDVWFGSGVTLKGKVTVAAKSGVKLEIPDGAVIANKDINGPEDI

SEQ ID NO: 21015 - protein, 477 aa, Solanum tuberosum
MATATTLSPADAEKLNNLKSAVAGLNQISENEKSGFINLVGRYLSGEAQHIDWSKIQTPTDEVVVPYDKLAPLSEDPAETKKLLDKLVVLKLNGGLGTTMGCTGPKSVIEVRNGLTFLDLIVKQIEALNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAIKRLVEAVALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLKGKVTVAAKSGVKLEIPDGAVIANKDINGPEDI

SEQ ID NO: 21016 - protein, 555 aa, Atriplex dimorphostegia
MWSQLSSLLSEKMDALATSDHASVVSMNLFVALLCGCIVIGHLLEENRWMNESITALLIGLSTGVVILLISGGKSSHLLVFSEDLFFIYLLPPIIFNAGFQVKKKQFFRNFITIVLFGAVGTLVSFTIISLGALSIFKKLDIGTLELADYLAIGAIFAATDSVCTLQVLNQDETPLLYSLVFGEGVANDATSVVLFNAIQSFDLTRIDHRIALQFMGNFSYLFIASTILGAFTGLLSAYVIKKLYFGRHSTDREVALMMLMAYLSYMLAELFYLSGILTVFFCGIVMSHYTWHNVTESSRVTTKHAFATLSFVAEVFLFLYVGMDALDIEKWRFVSDSPGISVAVSSILLGLVMVGRAAFVFPLSWLMNLAKKSHGEKVTFNQQIVIWWAGLMRGAVSMALAYNQFTRSGHTQLRGNAIMITSTISVVLFSTMVFGLLTKPLIMFLLPHPKHFTSCSTVSDVGSPKSYSLPLLEGNQDYEVDVGNGNHEETTEQRTIVRPSSLRMLLNAPTHTVHHYWRKFDDSFMRPVFGGRGFVPFVPGSPTEQSTNNLVDGT

SEQ ID NO: 21017 - protein, 433 aa, Streptococcus sobrinus
MSIITDVYAREVLDSRGNPTLEVEVYTESGAFGRGMVPSGASTGEHEAVELRDGDKSRYGGLGTQKAVDNVNNIIAEAIIGYDVRDQQAIDRAMIALDGTPNKGKLGANAILGVSIAAARAAADYLEIPLYSYLGGFNTKVLPTPMMNIVNGGSHSDAPIAFQEFMIMPVGAPTFKEGLRWGAEVFHALKKILKERGLETAVGDEGGFAPRFDGIEDGVETILKAIETAGYEAGEKGIMLGFDCASSEFYEDGVYDYTKFEGEKGAKRSAAEQIDYIEGLVNKYPIITIEDAMDENDWEGWKALTERLGNRVQLVGDDFFVTNTDYLARGIKEGAANSILIKVNQIGTLTETFEAIEMAKEAGYTAVVSHRSGETEDSTIADIAVATNAGQIKTGSLSRTDRMAKYNQLLRIEDQLGEVAQYKGINSFYNLKK

SEQ ID NO: 21018 - protein, 548 aa, Spirodela punctata
MGVCFSKASKPSGNGYQPPPPQPYKPPPPPAARPAQPSVQIPQTHHTQQRQQSDHQSASQAAPSPAKQHLPSPRNSPAAAVSAATPATVLGKPFEDVKAKYTIGKVLGRGQFGVTYLCTCNSTGAKYACKSISKRKLVNRNDREDVKREIQIMQHLSGQENIVEFKGAYEDRHSVHVVMELCAGGELFDRIIAKGHYSERAAAAMCRSIVNVVNICHFMGVMHRDLKPENFLLSTKDPGAALKATDFGLSVFIEEGKVYRSIVGSAYYVAPEVLMRSYGKEIDVWSAGIIVYILLSGVPPFWGETEKKIFDSIMKDDIDFQSDPWPSISASAKDLVSKMLTRDPKKRITAAQVLDHPWIRVDGEASDKPIDSAVLSRMKQFRAMNKLKKMALKVIAESLSEEEIKGLRQMFQNMDTDQSGTITYEELKTGLARLGSRLSEAEVKQLMDAADVDGNGSIDYIEFITATMHRHKLEREEHLYSAFSYFDKDNSGYITRDELKQALEEHGMGDADSIREIISEVDTDNDGRINYDEFCAMMRSGTHPPGRP

SEQ ID NO: 21019 - protein, 415 aa, Pseudomonas syringae pv. tomato str. DC3000
MAVAYSLDQKGRSMQRLYRKRIVLGVGGGIAAYKSAELVRRLRDQGAEVRVVMTKGGAEFITPLTMQALSGHPVHLDLLDPAAEAAMGHIELAKWADLILIAPATADLIARLAQGIANDLLTTIVLATDATVAIAPAMNQAMWRDASVQANTRLLEQRDFRVFGPASGSQACGDVGFGRMLEADDLARCAADCFQRLTLTGRHVLITAGPTQENIDPVRYITNHSSGKMGFALAEAAVEAGARVTLITGPVNLPTPDRVSRIDVVSARDMLAACEAAIPCDLFIASAAVADYRPEVIAPHKLKKDPSNGDGLLLQMVRNPDILATIATRPDRPFSVGFAAETEHLLDYAARKLKDKNLDLIVANDVANPSIGFNSEENACSVIDRALHATLFAQTSKAKIARQLITFIADRMNQV

SEQ ID NO: 21020 - protein, 497 aa, Pseudomonas syringae pv. tomato str. DC3000
MTTLTRADWEQRAQNLKIEGRAFIQGEYTAAASGETFDCISPVDGRLLAKVASCDAADAQRAVESARSAFDSGAWSRLAPAKRKATMIRFAGLLEQNAEELALLETLDMGKPISDSLGVDIPGGARALSWSGEAIDKLYDEVAATPHDQLGLVTREPVGVVAAIVPWNFPLMMACWKLGPALSTGNSVVLKPSEKSPLTAIRIAQLAIEAGIPAGVLNVLPGYGHTVGKALALHMDVDTVVFTGSTKIAKQLMIYAGESNMKRVWLEAGGKSPNIVFADAPDLQAAADSAASAIAFNQGEVCTAGSRLLVERSIKDRFLPMVIEALGTWKPGNPLDPATNVGALVDTQQMNTVLSYIAAGHTDGARLVAGGKQILQETGGTYVEPTIFDGVNNAMRIAQEEIFGPVLSVLTFDTAEEAIQIANDTPYGLAAAVWTANLSKAHLTARALRAGSVWVNQYDGGDMTAPFGGFKQSGNGRDKSLHAFDKYTELKSTWIKL

SEQ ID NO: 21021 - protein, 460 aa, Pseudomonas syringae pv. tomato str. DC3000
MQPPAFKELWIILRLAGPLIASQMAHMLMVFTDTVMMGKIGPEALAGGGLGAATYSFISFFCVGVMAAVGTLVSIRHGAGDSEGVTRLTQAGLWLAWGMALIAALLLWNLEPILLQLGQAEANVHMAAQFLITLPFALPGLLSFMALRGFTSALGRAGPVMTISVAGAVANFVLNYAMINQWLGLPNLGLMGIGLVTAMVTNCMALALAWHIKRHPAYAAYPISKGLSKLSRSHLKELWRLGLPIGGTYAVEVGLFTFAAFCMGAMGSTQMAAHQIALQTVSMAFMIPVGISYAVTMRIGQHYGAGNILMARTAGRLGIGFGGSVMLLFGIFFWLAPHWVIGLFLDLDDPAFAEIVVLAAKLLAIAAWFEFFDGTQTIAMGAIRGLKDARTTFLIGLGCYWLIAAPAAWLLGFYADGGASGVWWGLALGLFCSAVALTYAFEWKTARLLRKEAVGAAVPG

SEQ ID NO: 21022 - protein, 578 aa, Pseudomonas syringae pv. tomato str. DC3000
MPTAPTPQIPPVQRELSLRAVITGIVLGILLTPSNVYAGLKIGWSFNMSIIALLIGYAIWQGLAKRSPHQPPWTLHESNINQTVASAAASIISGGLVAPIPAYTLLTGQQLDAIPMMAWVFSVSFLGIWIAWYLRPSLLNDTSLKFPEGMATLETLLHIYNHGREAATRLKVLLNAALLSGLAKWVDTFVWAFPRWSPSASLERLTFTADPSLLLVGFGAIIGIRVGVTLLLGALLAWGGLAPWLLAQGLVTLPAGSSGPQFAALVEWLLWPGVSLMVCSTLASLAIRLWGLHRSTKANSGTIWAVPKAGPALGLLLSIILVVSLQALLFGINLWMALLTIPLAICLAAVAARVVGATGIPPIGAIGQLSQLSFGIVAPGQVTINLMSANTAGGSAGQCTDLMNDFKVGKAIGATPRKQLVAQTLGIFVGSIVGVLAYMALIPDPQSMLLTEEWPAPAVATWKAVAQTLTHGLDSLSASIRWAIFIAGLTGLLLGVLDSTLPARRARYLPSAAALGLAFVLPASVSLMMALGAVLTWTVSGRWASLTERFAITAAAGLIAGESITGVGASLWQMFGNG

SEQ ID NO: 21023 - protein, 412 aa, Pseudomonas syringae pv. tomato str. DC3000
MKTLADSQLSRLADQYGTPLWVYDGQLIKKRVQQLAAFDTVRFAQKACSNLHILRLLRDAGAAVDAVSLGELERALHAGFSAQTTQGAAGVVFTADVFDRATLQRVVEAQVEVNVGSIDMLHQLGALSPGHRVWLRINPGFGHGHSRKTNTGGENSKHGIWHTHLQDALTLVHYYRLHLVGLHMHIGSGVDYQHLQQVCSTMAELVVEMDHDIEAISAGGGLSVPYRAGELPINTSHYFAQWDHARKRIEAHLGHPIRLEIEPGRFLVAQAGVLVSEVRATKHMGGKHFTLVDAGFNDLMRPSLYGSYHEMSLITSRDEPLPMQETVVAGPLCESGDVFTQAEGGIVESRLLPVAQVGDYLVFHDAGAYGASMSSNYNSRTHAAEVLVDDGQERLIRRRQPLDDLLRLEEDC

SEQ ID NO: 21024 - protein, 415 aa, Pseudomonas syringae pv. tomato str. DC3000
MDAFNYRDGELFAEGVALSAIAERFGTPTYVYSRAHIEAQYRAFADALSGMPHMVCFAVKANSNLGVLNVLARLGAGFDIVSRGELERVLAAGGKAERIVFSGVGKTREDMRRALEVGVHCFNVESTDELERLQEVAAELNVRAPISLRVNPDVDAGTHPYISTGLKENKFGIAIAAAEDVYIRASQLPNLEVIGVDCHIGSQLTTLEPFIDALDRLLDLVDRLGDCGIHLHHIDLGGGLGVRYRHEEPPLAGDYIKAVRERLAGRDLGLLFEPGRFIVANAGVLLTQVEYLKHTEHKDFAIVDAAMNDLIRPALYQAWMDVTAVRPRDSEPRAYDIVGPICETGDFLAKGRELALAEGDLLAVHSAGAYGFVMSSNYNTRGRAAEVLVDGTQAFEVRRRETVAELFAGESLLPE

SEQ ID NO: 21025 - protein, 485 aa, Pseudomonas syringae pv. tomato str. DC3000
MLKNQLKDPSLLVDRAYVDGQWISADDGATLAISDPATGEVIAQVPALQGAETRRAIEAADRAWPAWRARPAAERAALLERWHQAMLDNVEDLALIMTLEQGKPLNESRGEIRYGASFVKWFAEEARRSYGETIPTPSADRRLMTLKQPVGVCAAITPWNFPNAMITRKCAPALAAGCTIIVKPSDLTPLSALALAVLAERAGIPVGVFSVVTGMPTAIGEELTGNPVVRKISFTGSTPIGRLLMRQSAEHIKRLSLELGGNAPFIVFDDADLEQAVAGIMLSKFRNAGQTCVCANRILVQSGIYDRFAARLVEEVAKLKVGNGLEEGVTIGPLINPAAVSKIARHIDDALSQGAKLLYGGLPNGDGQFVQPTVLGDTHAGMLLANEETFGPVAPLMRFTDEAEALALANATPYGLAAYYFTQDLRRSWRFGEALEFGMVGLNTGIISMEIAPFGGIKQSGLGREGSSYGLDEYLEVKAFHVGGL

SEQ ID NO: 21026 - protein, 480 aa, Pseudomonas syringae pv. tomato str. DC3000
MQLKDSTLFRQQAYINGQWLDADGGQSIKVNNPATNEILGTVPKMGAAETRRAIEAADKALPAWRALTAKERGNKLRRWFELMIENQDDLGLLMTLEQGKPLAEAKGEITYAASFIEWFAEEAKRVYGDVIPGHQPDKRLIVLKQPIGVTAAITPWNFPAAMITRKAGPALAAGCTMVLKPASQTPFSALALAELAERAGIPAGVFSVVTGSAGDIGSELTGNPIVRKLSFTGSTEIGRQLMAECAKDIKKVSLELGGNAPFIVFDDADLDKAVEGAMISKYRNNGQTCVCANRIYVQDGVYDAFAEKLKVAVGKLKIGNGLEDGITTGPLIDEKAVAKVKEHIADAVSKGATVLTGGNSLEGSFFEPTILVNVSKDAAVAREETFGPLAPLFRFKDEAEAIALANDTEFGLASYFYAQNMSRVFRVAEALEYGMVGINTGLISNELAPFGGIKSSGLGREGSKYGIEDYLEIKYLCLSV

SEQ ID NO: 21027 - protein, 419 aa, Pseudomonas syringae pv. tomato str. DC3000
MLELAAGFICLTSLLTYVNYRFIGLPPTIGVMVTALMFSLLLQGLSFLGYPGLEDRVQQLIGQIDFGDLLMNWMLSFLLFAGALHVNLADLKSYRWPIGLLATFGVLIATTVIGALAYWIFALFGWHVSPLYCLLFGALISPTDPIAVLGVLRTANASKPLKTTIVGESLFNDGTAVVVFTVLLGIAQLGETPTVGETALLFVHEAVGGVLFGGLIGYAVYLMIKSIEQYQIEVMLTLALVIGGSAMASELHVSGPIAMVVAGLIIGNLGRNLAMNDMTRRYMDGFWELLDDMLNALLFALIGMELLLLPFSWQHLIAASLLAVAILLSRFVTVAPAILLLRRWRKVPHGTIRILTWGGLRGGVSVALALALPNGPERDLLLSITYIVVLLSILFQGLTIGKLVNAVTREPQAKDPAGH

SEQ ID NO: 21028 - protein, 284 aa, Pseudomonas syringae pv. tomato str. DC3000
MTTSLQPAYALVPGANLEAYVHTVNSIPLLTPERERELAESLYYEQDLDAARQMVLAHLRFVVHIARSYSGYGLAQADLIQEGNVGLMKAVKRFNPEMGVRLVSFAVHWIKAEIHEFILRNWRIVKVATTKAQRKLFFNLRSQKKRLAWLNNDEVHRVAESLGVEPREVREMESRLTGHDMAFDPAAEADDDSAFQSPANYLEDHRYDPARQLEDADWTDNSTANLHQALDVLDERSRDILYQRWLAEEKATLHDLAQKYNVSAERIRQLEKSAMNKLKTSIAA

SEQ ID NO: 21029 - protein, 490 aa, Pseudomonas syringae pv. tomato str. DC3000
MARFELQKLYIDGGYVDASNTETFDSINPANGEVLAKIQRASKEDVERAVVAAEKGQKIWAAMTAVERSRILRRAVDILRERNDELAALETLDTGKAISETRYVDIVTGADVLEYYAGLVPAIEGEQIPLRDSSFVYTRREPLGVVAGIGAWNYPIQIALWKSAPALAAGNAMIFKPSEVTSLTTLKLAEIYTEAGVPNGVFNVLTGSGREVGTWITEHPRIEKVSFTGGTDTGKKVMASASSSSLKEVTMELGGKSPLIVFDDADLDRAADIAMMANFYSSGQVCTNGTRVFVPNALKGEFEAKILERVKRIRPGNPEDENINFGPLVSFEHMESVLGYIAKGKEQGARLLCGGDRLTGGVFDKGAFVAATVFTDCTDEMTIVREEIFGPVMSILGYDTEDEVVRRANDTDFGLAAGIVTRDLNRAHRVIHLLEAGICWINAWGESAAQMPVGGYKQSGVGRENGISSLAQYTRIKSVQIELGDYASVF

SEQ ID NO: 21030 - protein, 616 aa, Pseudomonas syringae pv. tomato str. DC3000
MSGKAQQQSRIKELITLGREQKYLTYAEVNDHLPEDISDPEQVEDIIRMINDMGIPVHESAPDADALMLADADTDEAAAEEAAAALAAVETDIGRTTDPVRMYMREMGTVELLTREGEIEIAKRIEEGIREVMGAIAHFPGTVDHILSEYTRVTSEGGRLSDVLSGYIDPDDGIAPPAEVPPPVDPKAVKAEGADDDEEESADSSDEEDEVESGPDPVIAQQRFGAVSDQMEITRKALKKFGRDDKHAIAELVALAELFMPIKLVPKQFEGLVERVRGALERLRAQERAIMQLCVRDARMPRADFLRQFPGHEVDESWTDGLAKGKGKYAEAIGRLQPDIQRCQQKLSALEEETGLKIAEIKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELGERMEMPEDKIRKVLKIAKEPISMETPIGDDEDSHLGDFIEDSTMQSPIDVATVESLKEATREVLSGLTAREAKVLRMRFGIDMNTDHTLEEVGKQFDVTRERIRQIEAKALRKLRHPTRSEHLRSFLDE

SEQ ID NO: 21031 - protein, 631 aa, Pseudomonas syringae pv. tomato str. DC3000
MPTTFKEIPRERPVTPLLDQADTPHGLRRLGEAELETLADELRLELLYSVGQTGGHFGAGLGVIELTIALHYVFDTPDDRLVWDVGHQAYPHKILTGRRARMSTLRQKDGVAAFPRRSESEYDTFGVGHSSTSISAALGMAIASRLQGSERKSIAVIGDGALTAGMAFEALNHAPEVAANMLVILNDNDMSISRNVGGLSNYLAKILSSRTYTSMREGSKKVLSRLPGAWEIARRTEEYAKGMLVPGTLFEELGWNYIGPIDGHDLPTLIATLRNMRDLKGPQFLHVVTKKGKGFAPAEVDPIGYHAITKLEPLNAPVSVQKKVSSPKYSGVFGQWICDMAEADSRLVGITPAMKEGSDLVDFSERFPERYFDVAIAEQHAVTLAAGMACEGSKPVVAIYSTFLQRGYDQLVHDVAVQNLDVLFAIDRAGLVGEDGPTHAGSFDLSYLRCIPGIVVMTPSDENELRKLLSTGYLHTGPAAVRYPRGTGPNAVIEANLDPVEIGKGVVRRQGQGVAILVFGVQLAEALVVAEKLDATVIDMRFVKPLDEALVRETAASHELLVTLEENAVMGGAGAAVSEFLARANILKSVLHLGLPDVYVEHAKPAQMLAECGLDAEGIEAAINERLALIG

SEQ ID NO: 21032 - protein, 506 aa, Pseudomonas syringae pv. tomato str. DC3000
MRYAHPGTEGAIVNFKERYGNYIGGEFVAPVKGQYFTNTSPVNGKPIAEFPRSTAEDIDKALDAAHAAAAAWGSTSVQARSLVLLKIADRIEANLEVLAITETWDNGKAIRETLNADIPLAADHFRYFAGVLRAQEGSAAEIDGNTVAYHIHEPLGVVGQIIPWNFPILMAAWKLAPALAAGNCIVLKPAEQTPLGISVLIELIGDLLPAGVLNIVQGYGREAGEALASSKRIAKIAFTGSTPVGSHIMKLAADNIIPSTVELGGKSPNIFFEDIMSAEPEFIDKAAEGLVLAFFNQGEVCTCPSRALVQESIYPQFMEAVLRKVEKIKRGDPLDTDTMVGAQASEQQFDKILSYLEIAKGEGAELLTGGKVEKLEGDLSTGYYIQPTLLKGNNKMRVFQEEIFGPVVSVTTFKDEAQAVAIANDTEFGLGAGLWTRDINRAYRVGRAIKAGRVWTNCYHLYPAHAAFGGYKKSGVGRETHKIALEHYQQTKNLLVSYDTNPLGFF

SEQ ID NO: 21033 - protein, 955 aa, Pseudomonas syringae pv. tomato str. DC3000
MLELTLGQISMAQSAVDKTAALKLLADHLVADGLVAEGYLTGLMNREQQGSTFLGQGIAIPHGTPETRDLVFTTGVRLMQFPEGVDWGDGQMVYLAIGIAAKSDEHLRLLQLLTRALGEEDLGQALREAKSPEDLLKLLQGAPQELALDAQMISLGVSADDFEELVWRGARLLRKADCVSNGFAAVLQQVEALSLGDGLWWLHSEQTVKRPGLAFVTPDKPIRYLGQPLTGLFCLASLGEAHQALLERLCLLLIEGRGHELGHATNSRVVLEALGGEVPAEWPTQQIQLANAHGLHARPAKILAQLAKEFEGEVRVRVLETGESAVSAKSLSKLLSLGVRRGQTLEFIAEPSIAADALPALIAAVEQGLGEEVEPLPAASEPEAAPTPVAVAKPINAPAAGSVLSAVPASPGIAIGPAHVQVLQTFDYPQKGESVAAERERLQTAIGEVRRDIENLIQRSKSKAIREIFITHQEMLDDPELIREVEQRLNDNESAAAAWATVIEAAAVQQEQLKDALLAERAADLRDVGRRVLAQICGVETVAAPDEPYILVMDEVGPSDVARLDPAQVAGILTARGGATAHSAIVARALGIPALVGAGDEVLLLKPGTVLLLDSQRGRLTVAPDQATLQRAVEDRDAREQRLKAAAAARMEPAVTRDGHAVEVFANIGDSTGTPAAVEQGAEGVGLLRTELLFMAHSQAPDEATQEAEYRRVLTDLGGRPLVVRTLDVGGDKPLPYWPIAKEENPFLGVRGIRLTLQRPDVMESQLRALLRAADSGPLRIMFPMIGTLEEWREARAMTERLRAEIPVSDLQLGIMIEVPSAALIAPVLAREVDFFSIGTNDLTQYTMAIDRGHPTLSAQADGLHPSVLQLIDMTVRAAHANGKWVGVCGELAADPLAVPVLVGLGVDELSVSARSIGEVKACVRELTLSSAQQLAQKALTAGSAAEVRALVEAV

SEQ ID NO: 21034 - protein, 254 aa, Pseudomonas syringae pv. tomato str. DC3000
MNRFTQKVVVVTGAGSGIGEATAKRFAHEGASVVLVGRNQEKLAKVAAQLKGAEHLIRATDVADLTDVEALFKEVAERFGRLDVLVNNAGVVKSGKVTELGVEDWKAVMSVDLDGVFYCTRTAMPALIASKGNIINVSSVSGLGGDWGMSFYNAAKGAITNFTRALALDHGADGVRINAVCPSLTRSELTEDMLGDEALMAKFMERIPLGRPGEAEDVGDVIAFLASEDARFVTGVNLPVDGGLSASNGQPPQA

SEQ ID NO: 21035 - protein, 316 aa, Pseudomonas syringae pv. tomato str. DC3000
MSSGKDFFVHSHALCESENIGKDSRVWAFAHILPGARLGSECNVCDNVFIENDVIIGDRVTLKCGVQVWDGITIEDDVFIGPNATFTNDLFPRSKVYPQTFARTIIRKGASLGANCTILPGITIGINAMVGAGAVVTRSVPPNAIVVGNPAKIIGYVDAKPVNANSETRAEQKAPGVTATSVKNVTLHTMNEVADIRGSLSAGEFERSVPFKTERYFLVYDVPTAETRGEHAHRICHQFLVAVKGSVHVVADDGVNREEFILDKPNQGIHLPPMTWGIQYRYSQDAVLLVFASHYYDAGDYIRNYEEFKSLIANAE

SEQ ID NO: 21036 - protein, 298 aa, Pseudomonas syringae pv. tomato str. DC3000
MTQRSTVILDGGMGRELQRRGAPFRQPEWSALALSEAPDAVSAVHAAYIESGAQVITSNSYAVVPFHIGEERFAREGQALAALAGQLARGSADASGGRALVAGSIPPLFGSYRPDLYQPELAADVLKPLVAGLSPYVDLWLAETQSCILEAQTIRAGLPADGKPFWLSFTLQDEDTDDVPRLRSGEPVADAAKAAAEMGVATLLFNCSQPEVIGAAIDAAREVFNALNVDIAIGAYANAFPPQPKDAKANDGLDELREDLDPQGYQQWAADWVKRGATHIGGCCGIGPEHIAVLSQKL

SEQ ID NO: 21037 - protein, 403 aa, Pseudomonas syringae pv. tomato str. DC3000
MSQILNVTLITETFTPEINGVANTLGRLCDGLRLRGHRVELVRPRQSDEINSGAADDLMLCRGWPIPGYPGLQWGQSSMHKLLRRWQRRRPDVLYIATEGPLGLSALRAARRLGIAVISGFHTNFPQYTQQYGMGFITRLLTHYLRWFHNRSRVTLVPSVSQKVELERRGFERIELLSRGVDSQLFNPSRCSQALRESWGLQTGDIGVIHVGRLAPEKNLGLLKTGFEALKSSYPQRTIKLIVVGDGPQRSELEQQIPDAIFCGTLRGEVLATHYASADMFLFPSLTETFGNVVLEALASGLGVVAYDEAAAGQHIRHGHNGALAMPGDETAFVDAARWLLEDSENLRRVRLNARQHASRQGWTAIIDQFERQLRDACPSESSKTLRQTSDKTIRPVSSMPLD

SEQ ID NO: 21038 - protein, 473 aa, Pseudomonas syringae pv. tomato str. DC3000
MSSSSTTAAADTQGRQNASPNRLIFISVLVATMGALAFGYDTGIIAGALPFMTLPADQGGLGLNAYSEGMITASLIVGAAFGSLASGYISDRFGRRLTLRLLSVLFIAGALGTAIAPSIPFMVAARFLLGIAVGGGSATVPVFIAEIAGPSRRARLVSRNELMIVSGQLLAYVLSAVMAALLHTPGIWRYMLAIAMVPGVLLLIGTFFVPPSPRWLASKGRFDEAQDVLEQLRSNKDDAQREVDEMKAQDEQARNRPKAKELLRQRWVIKLLLIGIGLGFTAQLTGVNAFMYYTPIILKNTGMGTNAALTATIGNGVVSVIATLLGIWAIGRYGRRHLLMTGLVMVILMQAALGCVLQFMPQNLTQSYTALACILVFLLFMQMCISPVYWLLMSELFPMQVRGLLTGTAVSMQWLFNASVAFTFPIAVDTIGNPTFFIFAAINVGSLIFVFLCLPETKGKSLEQIEKHLKKEL

SEQ ID NO: 21039 - protein, 258 aa, Pseudomonas syringae pv. tomato str. DC3000
MFERLREDIQSVFHRDPAARNAFEVLTCYPGMHAIWLHRFAHVLWRNGWKWLARVVSSFGRWMTGVEIHPGARIGRRFFIDHGMGIVIGETAEIGNDVTLYQGVTLGGTSWNAGKRHPTLEDGVVVGAGAKVLGPFTVGAGAKIGSNAVVTKAVPAGATAVGIPGRIIVKSDDETEARRKVMAEKLGFDAYGVSGDMPDPIARAIGQMLDHLQAVDGRLEGMCDALGRLGSDYCAKDLPQLRNEVFDCVKDAREDTVD

SEQ ID NO: 21040 - protein, 489 aa, Pseudomonas syringae pv. tomato str. DC3000
MLRIKQEALTFDDILLVPGYSEVLPNEVSLKTRLTRGIELNIPLVSAAMDTVTEARLAIAMAQEGGIGIIHKNMTIEQQAAEVRKVKKFEAGVVKDPITIEADATVRDLFELTRMHNISGVPVLHNGDLVGIVTSRDVRFENRLDVPVREVMTPKERLVTVREGADKNEVRELLHKHRLEKVLIVDANFALKGMMTVKDIEKAKAYPLASKDDQARLRVGAAVGTGKDTGERVTALVAAGVDVVVVDTAHGHSKGVIDRVRWVKDNFPQVQVIGGNIATGEAALALVAAGADAVKVGIGPGSICTTRIVAGVGVPQISAIANVAAALEGTGVPMIADGGIRFSGDLSKAIVAGASCVMMGSMFAGTEEAPGEIELFQGRSYKAYRGMGSLGAMSQAQGSSDRYFQDSSAGAEKLVPEGIEGRVAYKGPLSAIIHQLMGGLRSSMGYTGSADIEQMRTKPEFVRITGAGMAESHVHDVQITKEAPNYRVG

SEQ ID NO: 21041 - protein, 457 aa, Pseudomonas syringae pv. tomato str. DC3000
MSFTRRQILTGIAGLAVVGLGAGGASRYWMGRRESEAGSDFVLIAAPLDIELVSGHKTPAWAFGGSAPGTELRVRQGEWLRLRFINQLPVETTIHWHGIRLPLEMDGVPYVSQLPVKPGEYFDYKFRVPDAGSYWYHPHVSSSEELGRGLVGPLIVEEREPTGFAHERTVSLKSWHVDDVGAFTEFSVLREAAREGTAGRLSTLNGVPQAVIELPAGQITRVRLLNLDNTVTYRLNLPDAEAQIYALDGNPVTPRPFGDEYWLGPGMRICLAIKAPPAGEEISLRNGPVRLGTFRSVANSDAPGQWPPELPANPVAEPDMANAEKINFNFEWVGSMSVNTDNGKPPSLWQINGEAWDITDKTCADRPIAKLKLGKSYIFELKNMTQYQHPIHLHGMSFKVIASNRRKIIPYFTDTFLLGRNERARVALVADNPGVWMFHCHVIDHMETGLMAAIEVS

SEQ ID NO: 21042 - protein, 396 aa, Pseudomonas syringae pv. tomato str. DC3000
MSGPQHITILGATGSIGLSTLDVVARHPTLYQVFALTGFSRLDELLALCIKHTPQYAVVPEQVAARKLQDDLAAAGLDTRVLVGEGGLCEVAAHPMVDAVMAAIVGAAGLRPTLAAVEAGKKVLLANKEALVMSGALFMQAVRQSGAVLLPIDSEHNAIFQCLPGDFARGLGAVGVRRIMLTASGGPFRETPLEQLQDVTPEQACAHPVWSMGRKISVDSATMMNKGLELIEACWLFDARPDQVEVVIHPQSVIHSLVDYVDGSVLAQLGNPDMRTPIANALAWPARVDSGVAPLDLFRIGQLDFQEPDEERFPCLRLARQAAEAGGSAPAMLNAANEVAVAAFLDGRIRYLEIAGIIEEVLNREPVTAVVGLDAVFAADAKARLLAGQWLERNER

SEQ ID NO: 21043 - protein, 428 aa, Pseudomonas syringae pv. tomato str. DC3000 [sequence omitted]

SEQ ID NO: 21044 - protein, 370 aa, Pseudomonas syringae pv. tomato str. DC3000
MIKSRAAVAFEAKKPLEIVEVDVAMPKAGEVLLKVVASGVCHTDAYTLSGADPEGIFPSILGHEGGAIVEAIGEGVTSVAVGDHVIPLYTPECRQCKFCRSGKTNLCQAIRSTQGKGLMPDGTTRFSYKGEPIFHYMGTSTFSEYTVLPEISVAKIDKKAPLEKVCLLGCGVTTGIGAVLNTAKVKPGDTVAVFGLGGIGLSAVIGAVKAKAARIIAIDINPAKFEIAKQLGATDCVNPKDFDRPIQEVIVDMTDGGVDFSFECIGNVQLMRSALESCHKGWGESVIIGVAGAGQEISTRPFQLVTGRVWRGSAFGGVRGRTELPSYVDMAQTGEIPLDTFITHTMGLEDINKAFDLMHEGKSIRTVIHF

SEQ ID NO: 21045 - protein, 335 aa, Pseudomonas syringae pv. tomato str. DC3000
MALGNEAPEFDIDDEVLLMEAGIVLKEASNEKQPAAASGRTKAKQSTSLKQHKYIDYTRALDATQLYLNEIGFSPLLSPEEEVHFARLSQSGDPAGRKRMIESNLRLVVKIARRYVNRGLSLLDLIEEGNLGLIRAVEKFDPERGFRFSTYATWWIRQTIERAIMNQTRTIRLPIHVVKELNVYLRAARELTQKLDHEPSPEEIANLLEKPVGEVKRMLGLNERVSSVDVSLGPDSDKTLLDTLTDDRPTDPCELLQDDDLSQSIDQWLSELTEKQREVVIRRFGLRGHESSTLEDVGLEIGLTRERVRQIQVEGLKRLREILEKNGLSSESLFQ

SEQ ID NO: 21046 - protein, 917 aa, Pseudomonas syringae pv. tomato str. DC3000
MLTKLGIKGRELLLTILPASLMAAMLGGYFTWMQLSELQSQLLLRGEMIAQDLAPLSASALGRKDKVLLSRIATQTLEQPDVRAVSFLDVDRSPLAHAGPTMISPTPIGNSSQLLNSTGTDATRYLLPVFGNQRHLTSPIIPAEADTLMGWVDVEISHNGTLLRGYRSLFASLLLIFTGLAITAVVAVRLSRTINGPMSQIKQAVSQLKDGNLETRLPPLGSRELDELASGINRMAATLQNAQEELQMSIDQATEDVRQNLETIEIQNIELDLARKEALEASRIKSEFLANMSHEIRTPLNGILGFTHLLQKSELTPRQFDYLATIEKSADNLLSIINEILDFSKIEAGKLVLDNIPFNLRDLLQDTLTILAPAAHAKHLELVSLVYRDTPLALSGDPLRLRQILTNLVSNAIKFTREGTIVARAMLEDETEEHAQLRISVQDTGIGLSSQDVRALFQAFSQADNSLSRQPGGTGLGLVISKRLIEQMGGEIGVDSTPGEGSEFWISLKLPKAREDKEESLNLPLEGLRAAVLEHHDLARQALEHQLEDCGLHTVVFTNLENLLNGVTAAHETPAAIDLAVLGVTTLEISPERLRQHIWDLENLNCKVMVLCPTTEYALFQLAVHDVYTQLQAKPACTRKLQKALSELIAPRAIRADIAPPLSSRAPRVLCVDDNPANLLLVQTLLEDMGAEVMAVEGGYAAVNAVQQEAFDLVLMDVQMPGMDGRQATEAIRAWEAERGQSSLPIVALTAHAMANEKRSLLQSGMDDYLTKPISERQLAQVVLKWSGLALRNPAPERQNESLEAHVGPLVLDPEEGLRLAAGKADLAADMLAMLLASLDADREAIRVARASQDVQALIERIHRLHGATRYCGVPQLRTACQRAETLLKQDAPHTGDALDDLDKAIVRLETEARVTA

SEQ ID NO: 21047 - protein, 783 aa, Pseudomonas syringae pv. tomato str. DC3000
MDISLKNRLSFKQARLAVLIGFALGTLLSVAQIAIDYASEDASINREIGSLLEIIQNPASRIAYNIDAELAQELTLGLLHSPAVVSARLTDNNDTVLASVERATATGRYRVLSDWLFGESRQFQEKLHLDHLPDETIGTLYLTVDTFAFGSHFLQRAEITLLNGFVRSLALAGILTILFYATLTKPLVRVIRDLSSRDPRTVDQAKITCPPYHEKDEIGVLVATFNRQFETMSSEFSRRRAAEDRLTDHLNELENIVSARTNELKSSNMRLRESNEELQIARSTALDMANARSAFLAHMSHEIRTPLNGLLGMLALSLDSPLGAEQRQQLMIAHDSGKVLVELLNDILDMSKFDAGHLEIERIPFDLGGLIEDTANLLSQNAAPSVELTCLIAPDFPAMVTGDPTRVRQIVSNLLSNALKFTRFGRVDVRLTHHQDAASGEHRVRIEVRDTGIGIAQDAQAKIFQPFTQAETAITRQYGGTGLGLALTNNLCEAMHGTLSIQSQSGFGSQFCAELPLPVHVPAVAQNPLRGRVTVVSSAGSGLVELLGSLLPFWGVDLKRRSIDDSPDDLDLDNAPDLVITDCPECLFAIRPTTPVPILLVTAYGNFMPGEQVAALAPLQQQARPLARNALYHALRRVLNQEDTGKRDTLALDQPTRRVARVLLVEDNPVNQLVAKGILSKLGCEVIISSHGGEALEQLEHGHFDLVLMDCNMPVMDGYQATRQIRSSGRWPNLPIVALTANAMPDERERCKAAGMNDYLAKPFRRAELAGILDQWIPVTDDR

SEQ ID NO: 21048 - protein, 505 aa, Pseudomonas syringae pv. tomato str. DC3000
MSTATILELMRPYWGDRSVIASYVGGAFIEGHGAPVEVRNAHNDSLLLSFPDADESLVEVADKAAKAAQQQWWAMTAQARGRAMYQVGNLIREEQENLAQIESLTANKPIRDARVEVLKVAEMFEYYAGWADKLHGEVIPVPTTHLNYVTYEPLGTVLQITPWNAPIFTCGWQIAPAIAAGNAVILKPSELTPLSSLVVGVLIERAGVPKGLVNVIAGFGHSIGQAFIAKADIRKVVFVGSPATGRHIAVAAAQRCIPAVLELGGKSANIVFDDADLEVALRGAQAAIFSGAGQSCVSGSRLLVQQSIFEKFTNALAVAATQFKVGDPGDPETQIGPINNAKQYNHVKSMVERALKDGAKLVGEQADPIPDRPGYYINPTVLAGTNELHCAQEEIFGPVVVAIAFKDEEDAIRIANDSRFGLAGGVWTRDVGRAHRVAKQVRAGTFWVNGYKTIHVSSPFGGYGESGYGRSSGLDALREYSEVKSVWVETAAKPAASFGYGASLE

SEQ ID NO: 21049 - protein, 240 aa, Pseudomonas syringae pv. tomato str. DC3000
MVTGASSGIGSQVAIWLSQQGARVVLVARNQERLEATRQQLHGEGHGVEPFDLLENSVVGGWMKNLAKTYAPFDGLVHAAGVQMPLPIRALGIDQWETVFATNVTSGFSLIKSFRQKGVFTQGASIVLLSSVMAQVAQPSLMAYCASKGAVESMVRAAALELARDGIRVNAIAPGVVKTEMTRKLEDTVGVDAMSAVEQRHPLGFGEPLDIAYAVNYLLSPAARWVTGTSMVVDGGYLAQ

SEQ ID NO: 21050 - protein, 746 aa, Pseudomonas syringae pv. tomato str. DC3000
MFSLVLIYIAERQTAQAEEDVRRVLLVQGDIQTLHTQIAEGAASVRGYLLTHQEDFLPGYINAQPLINAALVRLDANIRDQQMREHLKSIEPLIRTKVDGLERLRSMGREDHENVAAILVENKYVLDQLRERIGVMREREDALLAERTEAAAATRERLLWSTLLAAACGIFGAILAVLMLSKGIVARVHQVQRNAQRLALGHPLLPQPPEKDEIGQLGTRLVEAGQLLAERERALRDNEERLRLIIEGVKDYGIFALDRNGYVTTWNAGAERIKGYTEQEIIGQHFSVFYLPQECPQHPDMALHEATVNGRYTEESWRRRKDGSRFWASVVITAQYDSNDELRGFSKITRDISDRRVAEIALGTAREEAERASRAKSEFLSRMSHELRTPLNSILGFAQLLDMDSPASQRPQVGHILRAGQHLLKLINEVLDIARIEAGHVSLSLEPVSLSSVLKETLVLVSPMAADGNIELKELPHLPDELGVIADRQRLVQVLLNLLSNAIKYNRPDGQVRIEVDRSAEHVTVSVVDTGYGIAPERLGQLFKPFERLDANPSVEGTGLGLALSKSMLEMMKGTLSVQTTQNEGCRFTLALPFVAVHAPTVATPRPADAVPITRPAARPAYHGKLLCIEDNLSSMALIETLLQRRPGIQLLSSMQGQLGLDLARQHAPQLILLDLNLPDIKGLEVLQRLRRLPATANTPVLMITADASVNAQRELKEAGATAILIKPIQVPVFLALLDQYLPEPV

SEQ ID NO: 21051 - protein, 641 aa, Pseudomonas syringae pv. tomato str. DC3000
MKFRQWDINTRTQIISLGPALLLTVMLISFFTFVRIQDLRQELNHTGQLIANQLAPAVEPGVTAGDIDGLKSLMRATLSMPSVRYVEIQDASNTVMVYIDQTRENEHQPRQMEIFQAPIRHQRAAAHTAPAARRETQDAASPDYLGRVLVGMSSEAFNRRQQEILLKAGILALCALLFTFLLARRLSLSLSRPISEMGEALKAIQQGDYHTPMPVSDDAELGALARHINSLAENLHRTSLEQQRSVAQLIQTREEAERANRAKSDFLAMMSHELRTPMNGVLGMLQLMETTRMTDEQSEYATLATESTEHLLKVINDILDFSRIERDALQMEGIAFNLAELVSVSTHAFNHSALQRKLLLELHVQPGLEAMTVIGDPTRIRQILVNLIGNALKFTEEGKVCVEADWLMLDDEQLRFTCKVHDSGIGIDAERLESMFDAFKQADSSISRRYGGTGLGLPIARKLAERMGGTLYAESVEGAGSAFTLQIALPVSRYVSVDVVPPPSALYAYGKERSILLVEDNPVNRTVVQAMLHNLGCKVDVAVDGVDAVMKAGAGNYALILMDCRLPVMDGYEATRKIRQLSGLERIPIIALTANALHGDRDACLQAGMDDYLPKPFKHADLQQVLQRWLSFQAPATGDKC

SEQ ID NO: 21052 - protein, 791 aa, Pseudomonas syringae pv. tomato str. DC3000
MVEYVVSLDKLGVHDVEHVGGKNSSLGEMISNLAGAGVSVPGGFATTAQAYRDFLELSGLNDQIHAALDTLDVDDVNALARTGAQIRQWIMEAEFPEKLNAEIRTAFAELSAGNPNLAVAVRSSATAEDLPDASFAGQQETFLNIRGVENVIRAAKEVFASLFNDRAISYRVHQGFDHKLVALSAGVQRMVRSETGTAGVMFTLDTESGFRDVVFITGAYGLGETVVQGAVNPDEFYVHKDTLAAGRPAILRRNLGSKAIKMIYGEEASAGKSVKVIDVEPADRARFCLTDAEVSELAKQAMIIEKHYKCPMDIEWAKDGDDGKLYIVQARPETVKSRASANVMERYLLKETGKVLVEGRAIGQRIGAGKVRIIKDVSEMDKVQPGDVLVSDMTDPDWEPVMKRASAIVTNRGGRTCHAAIIARELGIPAVVGCGNATHTLQDGQGVTVSCAEGDTGYIFEGELGFDIKTNSVDAMPDLPFKIMMNVGNPDRAFDFAQLPNAGVGLARLEFIINRMIGVHPKALLNYSVLPPEIKDSVDKRIAGYHDPVGFYVEKLVEGISTLAAAFTPKKVIVRLSDFKSNEYANLIGGKLYEPEEENPMLGFRGASRYISENFRDCFELECRALKRVREEMGLTNVEIMVPFVRTLGEASQVIDLLAANGLKRGENGLRIIMMCELPSNAILADEFLEYFDGFSIGSNDLTQLTLGLDRDSGVIAHLFDERNPAVKKLLSNAIQACNKAGKYIGICGQGPSDHPDLARWLMDQGIESVSLNPDSVLETWFFLAEAQAPV

SEQ ID NO: 21053 - protein, 403 aa, Pseudomonas syringae pv. tomato str. DC3000
MDTSFWKAGHRPTLFAAFLYFDLSFMVWYLLGPMAVQIATDLHLTTQQRGLMVATPILAGAVLRLFMGLLADQLSPKTAGIIGQVIVIGALFTAWQLGIHSYEQVLLLGLFLGMAGASFAVALPLASQWYPPQHQGKAMGIAGAGNSGTVLAALIAPVLAASFGWGNVFGLALIPLVLTLIAFTLMARNAPERSKPKSMADYLKALGDRDSWWFMFFYSVTFGGFIGLASALPGYFNDQYGLSPITAGYYTAACVFGGSLMRPLGGALADRFGGIRTLTVMYTVAAVGIAAVGFNLPSSWAALALFVAAMLGLGAGNGAVFQLVPQRFRKEIGVMTGLIGMAGGIGGFLLAAGLGAIKQNTGDYQLGLWLFAGLAVLAWFGLLNVKRRWRTTWGSAAVTAARV

SEQ ID NO: 21054 - protein, 254 aa, Pseudomonas syringae pv. tomato str. DC3000
MQLFRLDGQVAFVTGAGSGIGQAIAVGLAEAGADVACFDLPGSTGIGSTVERINALGRRALALQGTVTDRATLDAAIARTETELGALSVAVNCAGIANAQAAEELELQRWQTMLDINLTGIFLSCQAQAAVMLPRGKGAIVNIASMSGSIVNRGLLQAHYNASKAGVIHLSKSLAMEWANKGLRVNCISPGYTATPMNSRPEVAEQVKIFEQTTPMGRMASVDEMVGPAVFLVSQASSFCTGVDLLVDGGFVCW

SEQ ID NO: 21055 - protein, 310 aa, Pseudomonas syringae pv. tomato str. DC3000
MSSEHFASVMVDAFIAAVDEGLDLVPVVSDSTSTAKIGPFMQRFPERVINVGIAEQSLVSVAAGLALGGKIAATCNAAPFLISRANEQVKVDVCYNQANVKMFGLNAGTSYGPLASTHHCLDDISVMRGFGNVQIFAPSDPLECRQIIDYVLRYHGPVYIRLDGKPLRELHDPGYRFVPGNVDILRQGSDLTIVALGSVVHEAVDAAAQLAEQGLDAQVINLSSIRPLQRDALLSALSGSRGVITVEEHNINGGLGSLVAELLAENALGITLIRLGIGDGEYAAAGAREPTRALHGIDADGIVAAAARLR

SEQ ID NO: 21056 - protein, 446 aa, Pseudomonas syringae pv. tomato str. DC3000
MANVSMEAKGLLILGFPIAATMIAQTLMSLTDLMLVSRLGEKQVAGVSLGIAVYSFGMLFGLGVITAVTPMIAKAYGRKDFNAVSNYTRQGLWVAALVAMPGVIALILTRSILLFLNVEAETANIASDYCVGALMGLPAFLIYVNLRCFLSAIGRPKTTTWIMFLAVPVNYIIGHVLIFGVMDAEGLGITGAGLASSVTRLAILSTVIATLKYGADFKCFSLFENVMNVKPVVVKKIVLLGLPVGVRILLAEGMLPIIALLISTLGTIDLVAHMVAVRLSGVSAVIALGFSSAASTRVAWQVAANNQNGVRVTGYVASALAFGVSALLAMLLIFFPTELVMLLFDIDDAEVLALTSHLLKVVAAYQILNAIQTAVVGSLLGVSDTKIPTCLVLIGNWLVGLASAYGLVVLFEATVTAVWGGLVLGQVFVVVTCLCRFHMKTKALHE

SEQ ID NO: 21057 - protein, 266 aa, Pseudomonas syringae pv. tomato str. DC3000
MHISLKQQVAIVTGASSGLGAGAARALADAGAAVVINYNSKAEPAEKLAEEIRAAGGRALAVGADVSKEEDVERLFAQTVEHFGALDILVANSGLQKDAAIVDMSLEDWNTVINVNLTGQFLCARAALRQFIKQGMRPEVSRAMGKIIHMSSVHQLIPWAGHVNYAASKGGVDLLMRSIAQEVGELKIRVNSVAPGAIRTPINADARKGDAEKEMLKLIPYGRIGEPEDVANAVLWLASDASDYVHGTTLYIDGGMTLYPEFRGNG

SEQ ID NO: 21058 - protein, 463 aa, Pseudomonas syringae pv. tomato str. DC3000
MTTVSSNTHAISINPVSGEQIGSYAFESDAVLNRTLSRAAAGFAGWKRTPVQQRAQLIIAMGQVLRDDAENIARMISREMGKPVAQARGEVEKCAQLCDWYAAHGPAMLIAEPTQVEHDKARIEYRPLGPILAVMPWNFPIWQVLRGAIPTLLAGNTYVLKHAPNVMGCAYLMLGAFKRAGFPEGVFEVINVTPEGVSKAIADPRIAAVTLTGSVRAGQAIGAQAGAALKKCVLELGGSDPFIVLNDADLDQAVKAAVIGRFQNTGQVCAAAKRLIIEQGVVEEFTRRFVEQTRQLVIGDPLCGETYIGPMARVDLRDELDAQVQDTLAEGATLLLGGRKADGQGNYYEPTVLGDVTDQMTSFRQELFGPVASIITARDAQHALELANDSEFGLTATVYTRDLELAQRMTEELETGGVFINGYSASDPRVTFGGVKKSGFGRELSHFGLREFCNAQTVWRDRH

SEQ ID NO: 21059 - protein, 493 aa, Pseudomonas syringae pv. tomato str. DC3000
MSLTRFQMCIDGQWVDALSGKTFDSLNPALAEPWAQLPDAGEADVERAVQAAQKAFESQEWRGLTATARGKLLRRLGDLIAENKEHLAQLESRDNGKLIRETRGQVSYLPEFFHYTAGLADKLEGGTLPLDKPDLFAYTVHEPMGVVAGIIPWNSPLYLTAIKLAPALAAGNTIVLKPSEHASATVLELARLALEAGIAPGVVNVITGYGPTTGAALTRHPLVRKIAFTGGAATARHVVRSSAENFAKLSLELGGKSPNIIFADADLDSAINGAVAGIYAASGQSCVSGSRLLVQDEIYDEFVERLAERASRIRIGNPLDESTEMGPMATAQQLAVVEGLVADALAEGARLRLGGKRPELDSKGWFYEPTLFECDHNSMKIMQEEVFGPVASVIRFKDEAEALAIANDSQFGLAAGIWTRDLGRAHRLARDIRSGIIWVNTYRAVSAMAPIGGFKNSGYGRESGIDSVLAYTELKTVWINLSQAPMPDPFVMR

SEQ ID NO: 21060 - protein, 476 aa, Pseudomonas syringae pv. tomato str. DC3000
MYPDVQLYIDGQWRASRDGRSIPVIDPATGQSLGSVAHAGIADLDEALSAAERGFATWRATSAYDRYKLMQKAADLVRERADSIARIMTQEQGKPLAEARMETLSAADVIDWLAEEGRRSYGRIVPSRGVSIEQKVIKEPVGPVAAFTPWNFPINQVVRKLSSALAAGCSIIVKAPEETPGSPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLQAFTEKFVGLTREIKVGNGLESGTTMGPVANDRRIPALVDLIEDAVSAGATVSAGGKAVEGQGYFFEPTVLSGLTPAMRIMNEEPFGPVALLVPFDTVEEAIVESNRVPFGLASYAFTTSMKTAQALSTYIEAGMLSINHQGIGLPEVPFGGIKDSGYGSEGGTEAIEAYLNTKLVTQYS

SEQ ID NO: 21061 - protein, 1170 aa, Pseudomonas syringae pv. tomato str. DC3000
MNRTPSVDEQRFRKLLGRNVGLPLGVGVLSAVFFILLISYLLNAIQWVEHTDRVINNTNRSMKLSIDMETGMRGFLLTGDQHFLDPYEIAKPLLVAELNGLQDLVKDNPTQQDRFRRLFTMQQEWNVFAQDMIDLRRNNGDFQTPVLAGRGKRITDQIRTEYEQAVEMEQQLRLTRNAEVTRSTVISVTLYLIFVVIVSGILAYIGRRDLLSLSATYSANLRQQEVNAERLQKVAWLRNGQSELAEQVLGQLTLNMLGRNILQFLTQYLGASVAAMYIRQDHGGLTRAASYGFSREQEQQDQTIHSDEGVVGQAASQDRIITLDELPENYFKVASGLGEGSPRSVVVVPISNDDQVNGVVELGFLRPLTEQDVEFLELVSDNIGTSIEAARYRQRLQEVLAETQQLNEELQVQQEELRTANEELEEQSRILKESQAHLETQQAELEQTNEQLAEQSQALADQRDALDRNNEELNIAQGELQARADELQRASKYKSEFLANMSHELRTPLNSSLILAKLLAENPSENLTAEQVKFAESIYSAGNDLLNLINDILDISKVEAGKLEVRPENSSVSRLVEGLRGLFQPLAAEKKLAFTVDIQAGAPTMLFTDRQRLEQILKNLLSNAIKFTEAGAVSMVVSRQPGAGIVFSVRDSGIGIAEEHQQGIFEAFRQADGTTNRRYGGTGLGLSISRDLAALLGGSISVTSAPGQGSIFTLVLPEQYVEQDPQAPGSEPLVMHTPAVLQLSVPAAPVIQPPLPAPVETPIAVFADDRDKAPFERRCILVIEDEVRFAQILFDLAHELGYDCLVAHAADDGFNLASRYTPDAILLDMRLPDHSGLTVLQRLKELAPTRHIPVHVISVEDRQEAALHMGAIGYAVKPTTREELKDVFAKLEAKLTQKVKRILLVEDDDLQRDSIARLIGDDDIEITAVGFAQQALDLLRDHIYDCMIIDLKLPDMLGNELLKRMSTEDICAFPPVIVYTGRNMTRDEEAELMKYSRSIIIKGARSPERLLDEVTLFLHKVESQLSSERQKMLKTARSRDKVFEARKILVVDDDVRNIFALTSALEHKGAVVEIARNGLEAIAKLNEVEDIDLVLMDVMMPEMDGYEATIEIRKDPRWRKLPIIAVTAKAMKDDQERCLQAGSNDYLAKPIDLDRLFSLIRVWLPKMERI

SEQ ID NO: 21062 - protein, 255 aa, Pseudomonas syringae pv. tomato str. DC3000
MSRTQLFDLDGKVAFVSGASRGIGEAIARLLAQQGAQVIVSSRKLEGCQAVADAIIAEGGQATAIACHIGEMEQITRVFAQIRQQFGRLDILVNNAATNPQFCNVLDTDLSAFQKTIDVNIRGYFFMSVEAGKLMREGGGGSIINVASINAVSPGAYQGVYSMTKAAVVNMTKVFAKECAEFGIRCNALLPGLTDTKFASALVKNDAILNMALSQIPLKRVAAPSEMAGAVLYLASEASSYTTGVALNVDGGFLS

SEQ ID NO: 21063 - protein, 1239 aa, Pseudomonas syringae pv. tomato str. DC3000
MSDRSARHQAFITALKQRILILDGGMGTMIQSYRLEEEDYRGKRFADWPSDVKGNNDLLILTRPDVIGAIEKAYLDAGADILETNTFNATQVSQADYGMESIVYELNVEGARLARKVADAKTLETPDKPRFVAGVLGPTSRTCSLSPDVNNPGYRNVTFDELVENYTEATKGLIEGGADLILIETIFDTLNAKAAIFAVQGVFEELGFELPIMISGTITDASGRTLSGQTTEAFWNSISHAKPVSVGLNCALGASELRPYLQELANKANTHVSAHPNAGLPNAFGEYDELPSQTAKIIEEFAQSGFLNIVGGCCGTTPEHIKAIAEAVSGYAPREIPDIPKACRLSGLEPFTIDRQSLFVNVGERTNITGSARFARLIREDNYTEALEVALQQVEAGAQVIDINMDEGMLDSKKAMVTFLNLIAGEPDISRVPIMIDSSKWEVIEAGLKCIQGKGIVNSISMKEGVEQFIHHARLCKRYGAAVVVMAFDEQGQADTEARKKEICKRSYDILVNEVGFPPEDIIFDPNIFAIATGIEEHNNYAVDFINACAYIRDELPHALTSGGVSNVSFSFRGNNPVREAIHSVFLLHAIRNGLSMGIVNAGQLEIYDQIPAELRDCVEDVVLNRNPEGTEALLAIADKYKGDGSVKEAETEEWRSWPVNQRLEHALVKGITTHIVQDTEESRLGFTRPIEVIEGPLMSGMNVVGDLFGAGKMFLPQVVKSARVMKQAVAHLIPFIELEKGDKPEAKGKILMATVKGDVHDIGKNIVGVVLGCNGYDIVDLGVMVPAEKILQVARDEKCDIIGLSGLITPSLDEMVHVAREMQRQDFHLPLMIGGATTSKAHTAVKIEPKYSNDAVIYVTDASRAVGVATQLLSKELKPAFIEKTRLEYVEVRERTSARSARTERLSYGAAVAKKPKFDWESYTPAKPTFTGTRVLQDIDLNVLADYIDWTPFFISWDLAGKYPRILTDEVVGEAATALFEDAQQMLRKLIDEKLISARAVFGFWPTNQINDDDLEVYGEDGKPLAKLHHLRQQTIKPDGKPNFSLADFVAPKDSGLTDYIGGFITTAGIGAEEVAKAYQDNGDDYNSIMVKALADRLAEACAEWLHQQVRKDYWGYAKDEALDNEALIKEQYMGIRPAPGYPACPDHTEKGTLFALLDPLPEGTPEHTPGKSGVFLTEHYAMFPAAAVSGWYFAHPQAQYFAVGKVDKDQVESYTARKGQDLSVTERWLAPNLGYDE

SEQ ID NO: 21064 - protein, 358 aa, Pseudomonas syringae pv. tomato str. DC3000
MPAPLTDTPEDGTREQWYVACTQKQLRQGKPYRATILGLNIVLFRQRSGQAAALLDQCVHRGTRLSAGKITDDCLVCPYHGWRYDANGHVVHIPSVDAGQGEPKSPGYRYRQRHFAVCEQDGLVWVYTGAGDAHDTPIFRLPAYGERPWQSYFMINTFDADVGSLVQNFLDVPHTVFVHEGIFRSSSGRAMEATLACKAQSIEVVYHDEVDEIGLMQWLTNPDGEPLVHTDRFLAPNVTFCDYLWGARSGFLIVSQITPVNARQSRVYTYIAYRFPMPRWVLRMLRPFIHLYTHIVIQQDVKIIRAHREGLDNVANFKPCNVPADAIHVGVEQLLAAVRHGEALPEAQRRERRIRFEL

SEQ ID NO: 21065 - protein, 354 aa, Pseudomonas syringae pv. tomato str. DC3000
MHPKNAWYVACTADEVADKPLGRQICNEKMVFYRDQNQQVVAVEDFCPHRGAPLSLGYVENGQLVCGYHGLVMGGDGKTASMPGQRVRGFPCNKTFAAIERYGFIWVWPGEREKADPALIHHLEWAVSDEWAYGGGLFHIQCDYRLMIDNLMDLTHETYVHASSIGQKEIDEAPPVTTVEGEEVITARHMENIMPPPFWKMALRGNNLADDVPVDRWQICRFTPPSHVLIEVGVAHAGKGGYHAPHEFKASSIVVDFITPETDTSIWYFWGMARNFKPADEQLTATIREGQHKIFSEDLEMLERQQLNLLQHPHRNLLKLNIDAGGVQSRKILERLIAAEQADTADQIPVAAVK

SEQ ID NO: 21066 - protein, 482 aa, Pseudomonas syringae pv. tomato str. DC3000
MLEVPLLIGGQSCPARDGRTFERCNPVTGEVVSRVAAATLEDADAAVAAAQAAFPGWAALAPGERRARLLKAAEQLQARSGEFIAAAGETGAMANWYGFNVQLAANMLREAASMTTQITGDVIPSNVPGSFAMALRQPCGVVLGIAPWNAPVILATRAIAMPLACGNTVVLKASELSPAVHRLIGQVLQDAGLGDGVVNVISNAPADAAAIVERLIANPAVRRVNFTGSTHVGRIVGELSARHLKPALLELGGKAPFLVLDDADLDAAVEAAAFGAYFNQGQICMSTERLIVDQKVADVFVAKLTAKIETLRAGHPDDSQSVLGSLVDVSAGSRIKALIDDAVNLGATLVIGGQLQGSILQPALLDGVTDRMRLYREESFGPVAVVIRGEGDEALLALANDSELGLSAAIFSRDTGRALALAQRVESGICHINGPTVHDEAQMPFGGVKSSGYGSFGGKASIEHFTQLRWVTLQNGPRHYPI

SEQ ID NO: 21067 - protein, 493 aa, Pseudomonas syringae pv. tomato str. DC3000
MSASDGTPFLQRAIDAECIFNGNWIPSSSALLPVIEPATSELLMNTAMAGAADIAIACREAALAQPAWAAMGPREKAEIFLMAADHAVCAFDELALYVARETGGSLHKGQHEVNETIVLLRQAAGMLSQAHGHGVILPSAAGRLSYARRVAHGVVGVISPFNFPLVLSLRSVAPALAAGNAVVLKPDPQTPISGGFLIARLFEEAGLPKGLLHVLPGAADAGEALCRDTNVQMITFTGSTGAGRKVAEAAGRNLKKVSLELGGKNPLVILEDADLDLAASNAAFGAWLHQGQICMATGLILVHESIVAAFTRKLADKARALTVGNAARGQAALGPLINQRQLQHVHQVVSDSLQAGAQLETGGEYEGLFYRPTVLSGVKPGMRAFEEEIFGPVAVVVSFSSDEQAIELANRSEYGLAAAVISPDVGRATALGDRLRCGMLHINDQTVADECINSFGGRGASGNGSSAGSPSDWDEYSQWQWVTVKNQAPVYPF

SEQ ID NO: 21068 - protein, 243 aa, Pseudomonas syringae pv. tomato str. DC3000
MTMFSSTLFEGKVALVSGGTSGIGQATAEYLARHGARVVAIGLGADATIIAEGVELDLREVNVTNDDALKGVIQSLDRLDILVPAAGGTLGEKEMEWEAFNQVLSVQLNAVYRLINLAHPLLARQGGSIINIASVFSYFGGGKLVAYSAAKGAIVQITKSLAEAYAPDNIRVNAVAPGWITPPLLAKIDDQPRIDRLLSRTPMRRFGSAEEVAKVIAFLASDAASFVTGVVLPVDGGYLTSAI

SEQ ID NO: 21069 - protein, 505 aa, Pseudomonas syringae pv. tomato str. DC3000
MHDLLTADEYAAIAQSISFPSNAFINGAYKPAISGATFSTINPATGEFLSDLAACRAEDVDDAVSKAKKAFDDGRWRLLAPGERKSVLLKFARLLEDNRHELAVLESLDSGKPVRECQLVDVPDTIHTLRWHAELIDKLYDHTAPVGNDALTLVVREPIGVVGCVLPWNFPLLMLAWKIGPALAAGCSVIVKPAEQTSLTTLRVAELAFEAGVPAGVLNIITGTGKDVGEPIGLHKDIDMVSFTGSTVTGRRFLHYSADSNLKRVVLECGGKNPAVVMEDAEDLDLVAEQVVNGAFWNMGENCSATSRLLVHASVKDELLERMGAYIREWKMGDPLDPQTRVGALVSSDHFAKVKSYLDYANADKLDIVYGGDTQEGAFVQLTVVDGVERDSRLFQEEIFGPILSVTTFNSISEAIALANDTVYGLAASVYTGSLRKAIKLSREIRAGIVTVNCFGEGDASTPFGGFKESGFGGRDKSVFAHDQYTEIKTIWIDVSDRSVDETVK

SEQ ID NO: 21070 - protein, 278 aa, Pseudomonas syringae pv. tomato str. DC3000
MNSIVAIKPRAITHRTSGRTRGPVTRLMSPGDLGQLLKPFIFLDQFGFKPEPGNKGFGMHPHSGIATLTYMIEGELAYEDTTGKSGLLPSGGVEWMSAGNGVWHDAKPVNDAPITGFQLWVALPAAQENGPAHSVYLAASQVTREGPAQVLLGRYGTAQSSIPAPADMNYLAVHLQDGEHWRYTPPAGHTVGWLAVNAGQLDADGPITAGEMAVFEESDRPIDLVATGPTCFVLGSAIRHPHDLVTGYYSVHTSQAALIQGEQEIERIGALLRAQGRL

SEQ ID NO: 21071 - protein, 412 aa, Pseudomonas syringae pv. tomato str. DC3000
MKILFISSLYAPDIGGGAEIILQRTVEGLQQRGYSIAVLATTDRPGLQLAEVNRVKVYRAGLLNQYWHFMPQRPERLARFAWHWRDRYNGGMRDYVRQVIELEQPELVVCHNLTGWSVSAWDEITRANRPVVQVLHDLYLLCPSSTMFKKGQSCQRQCSLCTQFRKHHAQQSEQVSTVVGVSRFMLDTLQAQGYFKGARGYVVHNASPFTPPHAGQTKAADDTAPLRFGYLGTLSENKGVGWLINQFQHLPFKATLQIAGRGQSNDEKRFRAMATSPDISFVGFQKPEDFYQHIDVAIVPSMWNEPFGLVAVEACAHSRPVIASRMGGLPEIIQDQLNGLLCSPDDPDSLGLAMLKLHQQPELLARLGSQARNSVASLLNLDLMLDQYESIFAQTLQDRSTWHGERVQLDPG

SEQ ID NO: 21072 - protein, 491 aa, Pseudomonas syringae pv. tomato str. DC3000
MTTQPLNSHRVDPHTAQKFYIDGHWSAPLSPVSIAVVNPATEEVVAHVASGSAADVDRAVAAARAAFAGWSGTSPEVRAQVIGRIHELIIERKEELAQAISLEMGAAISSARAMQVPLAAEHVRVARDLLATYRFQTVEGGTAIEREPIGVCALITPWNWPLYQITAKVAPAIAAGCTVVLKPSELSPLSALLFAQLVHDAGLPPGVFNLVNGSGPEVGGAMAAHPDIDMISITGSNRAGALVAQAAAPTVKRVTQELGGKSPNILLPDADFANAVPPGVMAAFRNVGQSCSAPTRMIVPRNRLAEVEALAAQTAGTIVVGDPQLEHTVLGPIANEAQFHRVQAMINAGICEGAKLVCGGPGRVQGHEQGFYTRPTVFSEVDSSMRIAREEIFGPVLCLIAYDTIDEAVAIANDTVYGLGAHVQGQDLELARSVASRIRAGQVHLNYPSWNPMAPFGGYKRSGNGREYGVHGFEEYLETKAIVGFAPADLM

SEQ ID NO: 21073 - protein, 310 aa, Pseudomonas syringae pv. tomato str. DC3000
MNQHLSISPSVSRPVWHQAIPLLLLEAALVLTWSSGFIGARFSLDYAPPLLVVFWRCVVVTLLLLPFVARQLVTLPPTLLLKNTGIGLLAMTGYVAGVTQGIALGVPAGLAALFADLLPMGMALLAALVLGQRLVWQIWAGLVVGLIGVVLVTHSALEWGNAPLWAYGLPLLGMFSLAIATLWQKHSTTSQPMKLLPNLWLQYFISSFAFAIIQGTQGGLAPIASSGFALSVAWTVGLATLGGYGLYWVCLRRAKATRVASVLYLSPPVTMLWAWAMFDEPLSWQIALGMVVSGVGVWMVIRAEARQVAS

SEQ ID NO: 21074 - protein, 273 aa, Pseudomonas syringae pv. tomato str. DC3000
MRTLELAGNTVPVLGQGTWHMGEKGHQRSAEIAGLCLGIEQGLTLIDTAEMYADGAAEEIVGQAIAGQRDKVFVVSKVYPHNASSAGIPVACEASLRRMNTDYIDLYLLHWPGNYPLTETVEAFERLREAGKIGAWGVSNFDVRDMIELNNPRCATNQVLYNPEQRGIEFDLMPWSADRHLPLMAYCPIGQAGDLLYHPALHEIAKRHEATPAQISLAWVLRQDNLIAIPKATNPEHIRLNIAAEQIRLTEQDLADIDLAWPAPTRKVPLAMV

SEQ ID NO: 21075 - protein, 247 aa, Pseudomonas syringae pv. tomato str. DC3000
MSLQGKVALVTGASRGIGQAIALELGRNGAVVVGTATSESGAERISATFKESGIEGFGLMLDVCDAESVSSVLSTIQERVGAPLILVNNAGITRDNLVMRMKDDEWYDVVNTNLNSLFRLSKGVLRGMTKARWGRIISIGSVVGAMGNAGQVNYASAKAGLEGFSRALAREVGSRAVTVNSVAPGFIDTDMTRELPEAQRESLITQIPLGRLGQAEEIAHVVAFLASEGAGYVTGATIPVNGGMYMS

SEQ ID NO: 21076 - protein, 207 aa, Pseudomonas syringae pv. tomato str. DC3000
MLKIWGRKNSSNVRKALWIAEEVGVPYETQDAGGAFGLVDEAAYRSKNPNGRIPMIEDGDFVLWESNAIVRYLAARHAPDSDLFPADVQTRASADRWMDWTTSTIAAPFSPVFWGVVRTPPEKQDWPTIEQGIKTLHGLLLVADDALSRQPYLSGETFGMGDIPLGCFAYGWFEMPIERPPLPHLQAWYERLKTRPAYRKAVMSPLT

SEQ ID NO: 21077 - protein, 284 aa, Pseudomonas syringae pv. tomato str. DC3000
MTQFRKVLSIQAGQPASDGAGVKLTRVFGGRGIELFDPFLMLDEFGSDKPGDYIAGFPPHPHRGFETVTYMLEGRMRHEDHMGNVGLLQGGGVQWMTAARGIIHSEMPEQEEGTMRGFQLWLNLPGKNKLNEASYQDIQPENVPRLTTEGGVQVVVIAGHFDDGTVRQAGAVQRPDTEPLYLDFHMPAGSRISPQVPEGHLALLYVYEGSIEIEGSPQAVATRQMARLSGEGQLQISSTHGARVLLIAGKPLREPIVQYGPFVMNTREEIEQALRDFREDRLTA

SEQ ID NO: 21078 - protein, 589 aa, Pseudomonas syringae pv. tomato str. DC3000
MPTRTSRRTFVKGLAASSILSGLGLWRSPAWALPNPGQPDGLSGTEFDLTIGETQVNITGNARTAMTINGGIPGPLLRWREGDTVTLRVKNRLDETTSIHWHGIILPANMDGVPGLSFDGIAPDGMYVYRFKVRQHGTYWYHSHSGFQEQSGVYGPLVIDAKEPEPFTYEREHVVMLTDWADEDPARVMKKLKKQSDYYNNNKRTVGDFINDVGEKGWSATTAERWMWAQMKMNPTDLADVSGATYTYLMNGQAPNMNWTGLFKPGEQIRLRFINGSSMTYFDVRIPGLKMTVVASDGLHIKPVVVDELRIAVAETFDVIVEPADGAYTLFAQSMDRTGFARGTLTSRPGMQAEVPPLDPRPLLSMDDMGMAGMDHGSMNHSAKPAMDGMDHSKMDHDSMPGMDHGTMPMQEAPVMQSHPDSERNNPLVDMQAMSTSAKLNDPGIGLRDNGRKVLTYADLRSTFEDPDGREPSRTIELHLTGHMEKFAWSFDGVKFSDAKPLMLKYGERVRIVLVNDTMMTHPIHLHGMWSDLEDENGQFMVRKHTIDMPPGSRRSYRVTADALGRWAYHCHMLYHMEMGMFREVRVEE

SEQ ID NO: 21079 - protein, 244 aa, Pseudomonas syringae pv. tomato str. DC3000
MGDKKKLLLTGASRGIGHATVKHFNAAGWEVFTASRQNWVDDCPWAEGLLNHIHLDLEDIDSVSASMAAIKDKLGGRLDALVNNAGVSPKTPEGGRMGVLESDYSTWIKVFNVNLFSTALLARGLFDELKAAKGSIINVTSIAGSKVHPFAGVAYATSKAALSALTREMAFDFGPHGVRVNAIAPGEIDTSILSPGTAEIVERLVPMHRLGKPEEVASLIYFLCTAGASYVNGAEIHVNGGQHV

SEQ ID NO: 21080 - protein, 364 aa, Pseudomonas syringae pv. tomato str. DC3000
MSAVNRAAVETILRQYTDPYLNQDPVSAGCVRSIDIDGAHVSVQLELGYAADLFRNGWAHVLKTAIENLDGVGSATVAIKSVISAHKAQSQIPGLANVKNIVAVASGKGGVGKSTTAANLALALSREGARVGILDADIYGPSQGVMFGIPEGTRPKIKEQKWFVPIEAHGIEVMSMAFLTDDNTPMVWRGPMVSGALLQLVTQTAWNDLDYLVIDMPPGTGDIQLTLAQKVPVAGAVIVTTPQDLALLDAKKGVEMFRKVNIPVLGVVENMAVHICSNCGHAEPLFGEGGGEKLASQYDVELLASLPLSMLIREQADGGKPTAIAEPDSQIAMVYQELARYVGARIVLQEAASPAMPTISVSDD

SEQ ID NO: 21081 - protein, 253 aa, Pseudomonas syringae pv. tomato str. DC3000
MTCKVAMITGAASGIGQALAVAFARQGVAVAGGYYPADPHDPDETRRLVEEAGGECLMLPLDVTFTASVDDLAAAAIKAYGRIDYAVANAGLLRRAPLLQMTDERWNEMLDVDLTGVMRTFRSAVRHMGEGGALVAISSIAGGVYGWQDHSHYAAAKAGVPGLCRSLAVELAPKGIRCNAVIPGLIETPQSLDSENSLGPEGLAQAAKAIPLGRVGRADEVAALVRFLCSDEASYLTGQSIVIDGGLTVRWPG

SEQ ID NO: 21082 - protein, 257 aa, Pseudomonas syringae pv. tomato str. DC3000
MKDFFKGKKLLVVGGTSGMGLETARQFLKAGGSVVLTGSKQDKADAVRAELSPLGNVSVIVANLMTEEGMNHVRNEINANHSDIGFMVNSAGIFIPKPFIEHDEADYDMYLDLNRATFFITQAVVKNMLAAKREGSIVNVGSIGAQAALAGSPATAYSMAKAGLHAVTRNLAIELAHSGIRVNAVSPGIVHTSIYEGFMDKEAIPDAMKSLNDFHPLGRVGVPEDVANTILFLLSDKTSWVTGAIWDVDAGVMAVRA

SEQ ID NO: 21083 - protein, 359 aa, Pseudomonas syringae pv. tomato str. DC3000
MVIDTAIISKAYDDLRAGFDFAKVYYAVKANPAVEVINLLKDKGSSFDIASIYELDKVLSCGVGPERMSYGNTIKKSKDIRYFYEKGVRLFATDSEADLRNIAKAAPGAKVYVRILTEGSTTADWPLSRKFGCQTDMAMDLLILARDLGLVPYGISFHVGSQQRDISVWDAAIAKVKVIFERLKEEDGIVLKLINMGGGFPANYITRTNSLETYAEEIIRFLKEDFGDDLPEIILEPGRSLISNAGILVSEVVLVARKSRTAVERWVYTDVGKFSGLIETMDEAIKFPIWTEKKGEMEEVVIAGPTCDSADIMYENYKYGLPLNLAIGDRMYWLSTGAYTTSYSAVEFNGFPPLKSFYL

SEQ ID NO: 21084 - protein, 427 aa, Pseudomonas syringae pv. tomato str. DC3000 [sequence omitted]

SEQ ID NO: 21085 - protein, 929 aa, Pseudomonas syringae pv. tomato str. DC3000
MRWLRIAIASTVGLLTLLFMLSAQAEHGAGWSTLLDEKARLSLDEIRSARYQNQFSPIELERVAAAERDSAVWLHYRLHPNQHEQLVRIFAPDLASADMYVMDGDQQIDHLRTGNAVPTEDQRLPSNDFLLPIPQSAASLDIYLRLVSSQKMRPSITLEPAIQSAADETEPFLFGLLFGALAMLIVQNLTRYAHTRSRSNLWLAACESMLGLSALLLLNLLRPIDPWHIAQTPSAHVALLLAAVAGLIYTYCFFVHRNARTLDRLLLGNAVLMGIGALLVVFDATLPINALTFVLVSLTTLSILAVSMWHWQKGYRSARLFVLGMITFNIGYMVVLPGLLWLSLVPPQWLILALLCVFCISGLLMSLALSERYRSITEDRFSVSRDQAASTAEINAKAEFLAKISHEIRTPMNGVLGMTELLLGTPLSVKQRDYVQTIHSAGNELLTLINEILDITKLESGQIELDDVQFDISALVEDCLNIFRAKAEQQQVELISQIQPQVPRVISGDPTRLRQTLLSLLENALKKTDEGEILLGVALESSKSGQPRLRISVQDSGESLSDEERDELLHAELHSRNFLASSRLGGHLGLVIARQLIILMDGEFGIQNSGTPGNTLWLNLPLDAKLLEQPTIDLDSPLKDARVLVVDDNDTCRKVLVQQCSAWGLNVSAVASGKEALALLRTKAHLRDYFDVVLLDQNMPGMTGMQLAAKIKEDPSLNHDILLIMLTGISNAPTKIIARNCGIKRILAKPVAGYTLKTTLADELTQLNKGVVLAKPGPAMPPPVSVPGDFRILVAEDNSISTKVIRGMLGKLNLNPDTASNGEEALRAMKAQRYDLVLMDCEMPILDGFSATEQLRAWEVGNQRVRTPVVALTAHILTEHKDRARQAGMDGHMAKPIELSQLRELVEHWVAHRDKARGLTADGEHYRQN

SEQ ID NO: 21086 - protein, 469 aa, Pseudomonas syringae pv. tomato str. DC3000
MSAVITPAEFNDYKVADISLAAWGRRETIIAESEMPALMGLRRKYAAEQPLKGAKILGCIHMTIQTAVLIETLVALGAEVRWSSCNIFSTQDQAAAAIAAAGIAVYAWKGETEEEYEWCIEQTILKDGQPWDANMILDDGGDLTEIIHKKYPAMLDKIHGVTEETTTGVHRLLDMLAKGELKIPAINVNDSVTKSKNDNKYGCRHSLNDAIKRGTDHLLSGKQALVIGYGDVGKGSAQSLRQEGMIVKVTEVDPICAMQACMDGFELVSPFIDGENDGTEASIDKALLGKIDLIVTTTGNVNVCDSNMLKALKKRAVVCNIGHFDNEIDTAFMRKNWAWEEVKPQVHKIHRTGAGAFDAQNDDYLILLAEGRLVNLGNATGHPSRIMDGSFANQVLAQIFLFDQKYADLAPAKKAERLTVEVLPKKLDEEVALEMVRGFGGVVTKLTKTQADYIGVTVEGPFKPDAYRY

SEQ ID NO: 21087 - protein, 242 aa, Pseudomonas syringae pv. tomato str. DC3000
MTESILVTGSSRGIGRAIALRLARAGYDLVLHCRTGRSEAEAVQAEIIALGRQARVLQFDVSDRVACKAILEDDVETHGAYYGVVLNAGLTRDGAFPALSDDDWDQVLRTNLDGFYNVLHPLTMPMIRRRAAGRIVCITSVSGLIGNRGQVNYSASKAGLIGAAKALAIELGKRKITVNCVAPGLIDTAMLDENVPVDELMKMIPAQRMGTPEEVAGAVNFLMSAEASYITRQVLAVNGGLC

SEQ ID NO: 21088 - protein, 336 aa, Pseudomonas syringae pv. tomato str. DC3000
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDITIPETTQEFAVNMSNQRHWEAPVQRYVSELLAGEDGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKE

SEQ ID NO: 21089 - protein, 317 aa, Pseudomonas syringae pv. tomato str. DC3000
MSDIPQAPADGRSSHWQLQRIVSQLRGAREDWRARNRRVSGEHGGRELPSRAAMGEILEALSGALFPMRLGPVDLREESEDFYVGHTLDVALNALLAQARLELRYVAHQQGADLKGIDAHALELIQGFATALPAIRLLLDTDVLAAYHGDPAARSVDEVLLCYPGILAVIHHRLAHHLYRAGLPLLARISSEIAHSATGIDIHPGAQIGPSFFIDHGTGVVIGETAIIGERVRIYQAVTLGAKRFPADEDGQLQKGHPRHPIVENDVVIYAGATILGRITIGQGSTIGGNVWLTRSVPAGCNLTQANLLQQDDCSKK

SEQ ID NO: 21090 - protein, 664 aa, Pseudomonas syringae pv. tomato str. DC3000
MSSPSTSSSGTVRMNAPVFYFAASFILIFGIIVIAFPQASGAWLLAAQNWAANTVGWYYMMVMTLYLVFVVVTALSGFGKIKLGADHDEPEFSYLSWAGMLFAAGISITLFFFCVSEPLTHLLQPPQGEGGTAEAARQGMQLLFLHWGLHGWGVFAFVGMALAYFAYRHNLPLALRSALYPLIGKRINGPIGYAVDGFGIIATIFGLGADMGFGVLHLNSGLDYLFGVPHTQWIQVGLITLMMGAAILVAIAGVDKGVRVMSDINMLLACALLLFVLFAGPTQHLLNTLVQNIGDYLGALPSKSFDVYAYNKPSDWLGGWTVFYWAWWIAWAPFVGLFIARISRGRTIREFVFGVLLIPLGFTLAWMSIFGNSAIDQVLNHGMAALGQSAIDDPSMTLYLLLETYPWSKTVIAVTVFISFVFFVTSADSGTVVLSTLSAKGGNPDEDGPKWLRVFWGVATALITSGLLFSGSIDALKSAVVLTSLPFSLILLLMMWGLHKAFVMESQRQIAQLYSLAPVSGSRRGGWRQRLSQAVHYPSRDEVYRFLDQTVRPAIDEVTAVFVEKGLNVVNVPDPSNDSVTLEIGHGEERPFIYQVQMKGFFTPSFARGGMGSKQLNNRRYYRAEVHLSEGSQDYDLVGYTKEQVINDVLDQYERHMQFLHLVR

SEQ ID NO: 21091 - protein, 759 aa, Pseudomonas syringae pv. tomato str. DC3000
MLNTLRKIVQEVNSAKDLKAALGIIVLRVKEAMGSQVCSVYLLDAEVNRFVLMASEGLNKRSIGKVSMAPNEGLVGLVGTREEPLNLENAADHPRYRYFAETGEERYASFLGAPIIHHRRVVGVLVIQQKERRQFDEGEEAFLVTMSAQLAGVIAHAEATGSIRGLGRQGKGIQEAKFVGVAGSPGAAVGVAVVMLPPADLEVVPDKTVTDIAAELTLFQNALEGVRNDMRTLSAKLATQLRPEERALFDVYLMMLDDASLGSEVTNVIKTGEWAQGALRSVVSEHVKRFELMDDAYLRERASDVKDLGRRLLAYLQEERQQALVYPDNTILVSEELTPAMLGEVPEGKLVGLVSVQGSGNSHVAILARAMGIPTVMGLVDFPYSKVDGIDLVVDGYHGEVFTNPSEIMRKQFGKVVEEERQLSQGLDALRELPCVTLDGHRMPLWVNTGLLADVARAQQRGAEGVGLYRTEVPFMINQRFPSEKEQLAIYREQLAAFHPLPVTMRSLDIGGDKSLSYFPIKEDNPFLGWRGIRVTLDHPEIFLVQTRAMLKASEGLNNLRILLPMISSTHEVEEALHLIHRAWGEVRDEGTDVPMPPVGVMIEVPAAVYQTRDLARQVDFLSVGSNDLTQYLLAVDRNNPRVADLYDYLHPAVLQALQSVVRDAHAEGKPVSICGEMAGDPAAAVLLMAMGFDSLSMNATNLPKVKWMLRQINLSKAKELLAQLMTNDNPQVISSSLQLALKNLGLSRMINPGSVKGH

SEQ ID NO: 21092 - protein, 212 aa, Pseudomonas syringae pv. tomato str. DC3000
MDGLLLDTEGVYTEVTHLIASRHGRTFDWSIKQHTIGRGARDFSDYVIKALELPMSIDEFLEIREPMLDERFPKAPAMPGAEALVRHLAAHNIPIAVGTSSSVHYFQAKTTQHRAWFELFDTIVTADDPEVGAAKPAPDIFLVAARRLGVAPADCLVFEDSPFGVTAAKAAGMYAVAVPDSHMPVEQYEHADLLLASLADFPLKAWGLPELV

SEQ ID NO: 21093 - protein, 530 aa, Homo sapiens
MGSNSGQAGRHIYKSLADDGPFDSVEPPKRPTSRLIMHSMAMFGREFCYAVEAAYVTPVLLSVGLPSSLYSIVWFLSPILGFLLQPVVGSASDHCRSRWGRRRPYILTLGVMMLVGMALYLNGATVVAALIANPRRKLVWAISVTMIGVVLFDFAADFIDGPIKAYLFDVCSHQDKEKGLHYHALFTGFGGALGYLLGAIDWAHLELGRLLGTEFQVMFFFSALVLTLCFTVHLCSISEAPLTEVAKGIPPQQTPQDPPLSSDGMYEYGSIKKVKNGYVNPELAMQGAKNKNHAEQTRRAMTLKSLLRALVNMPPHYRYLCISHLIGWTAFLSNMLFFTDFMGQIVYRGDPYSAHNSTEFLIYERGVEVGCWGLCINSVFSSLYSYFQKVLVSYIGLKGLYFTGYLLFGLGTGFIGLFPNVYSTLVLCSLFGVMSSTLYTVPFNLITEYHREEEKERQQAPGGDPDNSVRGKGMDCATLTCMVQLAQILVGGGLGFLVNTAGTVVVVVITASAVALIGCCFVALFVRYVD

SEQ ID NO: 21094 - protein, 211 aa, Betula pendula
MGRGKIEIKRIENSSNRQVTYSKRMKGIIKKAKEISILCDAKVPLVIFDSSGKMKEYCSPSTTLINILDMYHKRSEKRLWDAKHENLSNEIARIKKENDNMQIELRHMKGEDITSLNHRELMILEEALQNGHSSIRERQMDLLMRARKKDKILEEENKCLNFTLHQQQMAMEAASCRDVEDDYEQRVRDYNSQMPFAFRVQPIQPNLQDRM

SEQ ID NO: 21095 - protein, 308 aa, uncultured bacterium
MRRELAIEFSRVTEAAALAGYKWLGRGDKNTADGAAVNAMRIMLNQVNIDGTIVIGEGEIDEAPMLFIGEKVGTGLGDAVDIAVDPIEGTRMTAMGQANALAVLAVGDKGCFLNAPDMYMEKLIVGPGAKGAIDLNLPLETNLRNIAAALNKPLSELTVTILAKPRHDDVIAEMAKLGVRVFAIPDGDVAASILTCMPGSEVDVLYGIGGAPEGVVSAAVIRALDGDMQGRLLARHDVKGDSEENRRIGEQELARCQVMGIEAGKALRLDEMARSDNVIFSATGITKGDLLDGISRKGNIATTETLLI

SEQ ID NO: 21096 - protein, 128 aa, uncultured bacterium
MPQLGLGVWKASNEEVISAIHKALEVGYRSIDTAAAYKNEEGVGKALRDSGLPREALFITTKLWNDDQKRPREALLESMEKLQLDYLDLYLMHWPVPAIDHYVEAWENMIDLQKQGLIKSIGVCNFQI

SEQ ID NO: 21097 - protein, 441 aa, Oryza sativa (japonica cultivar-group)
MMKPQHGGMAGHGGGRTRSPFLTSYALTLAFITFVSVLYFKDFSSTLHQPFLTRPPPHRRQIARPRAPSHHHGGGSSSGGGDVVPPFAVGAAAAAGCDVGVGEWVYDEAARPWYEEEECPYIQPQLTCQAHGRPDTAYQHWRWQPRGCSLPSFNATLMLEMLRGKRMMFVGDSLNRGQYVSLVCLLHRSIPESSKSMETFDSLTVFRAKNYNATIEFYWAPFLAESNSDDAVVHRIADRIVRGTALEKHARFWKGADILVFNSYLWWMTGQKMKILQGSFEDKSKDIVEMETEEAYGMVLNAVVRWVENNMNPRNSRVFFVTMSPTHTRSKDWGDDSDGNCYNQTTPIRDLSYWGPGTSKGLMRVIGEVFSTSKVPVGIVNITQLSEYRKDAHTQIYKKQWNPLTPEQIANPKSYADCTHWCLPGLQDTWNELLYSKLFFP

SEQ ID NO: 21098 - protein, 367 aa, Oryza sativa (japonica cultivar-group)
MERELLETFEAAKKAADAAAGADDSPEADRCLDAMRRLRGLRVTTDVLVSTQVGKRLRYLTKHPHSDIQSMATDLLGYWKKVVIEEGKKNGTTENVGSTNSAARAEKAQPMKVDKSSASGSVKPEKREVNVRGQKPESIKVEKITNNDSKNQQVKVERAPKEATRTPDTKKPSSVPNGPPKLTSLVKCNDPTRDKIRELLADAFSRVHGETSKDDREEVRNILDEVDARDPFRVAVTVESALFERLGRSTGAHKAKYRSIMFNLRADNNTDFRRRVLLGQVRPERLVDISPEEMASDARKLENKQIKEKALFDCERGGAPKATTDQFKCGRCGQRKTTYYQLQTRSADEPMTTFVTCVNCNNHWKFC

SEQ ID NO: 21099 - protein, 372 aa, Oryza sativa (japonica cultivar-group)
MLLDLNVESPERSGTSSSSVLNSGDAGGGGGGGGGGGLFRFDLLASSPDDDECSGEQHQLPAASGIVTRQLLPPPPPAAPSPAPAWQPPRRAAEDAALAQRPVVAKKTRRGPRSRSSQYRGVTFYRRTGRWESHIWDCGKQVYLGGFDTAHAAARAYDRAAIKFRGLEADINFNLSDYEDDLKQMRNWTKEEFVHILRRQSTGFARGSSKFRGVTLHKCGRWEARMGQLLGKKYIYLGLFDTEVEAARAYDRAAIRFNGREAVTNFEPASYNVDALPDAGNEAIVDGDLDLDLRISQPNARDSKSDVATTGLQLTCDSPESSNITVHQPMGSSPQWTVHHQSTPLPPQHQRLYPSHCLGFLPNLQIQILFKS

SEQ ID NO: 21100 - protein, 387 aa, Oryza sativa (japonica cultivar-group)
MQRALAVVALLAAAAAIAAAQGESPELLPFAVGAAPEGCDVGEGEWVFDEAARPWYAEEECPYIQPDLTCQAHGRPDAAYQRWRWQPRDCSLPSFNATGMLEMLRGKRMLFVGDSLLRGQYTSLLCLLHRGAPGGGGGSRSFETVDSLSIFRAKDYDATIEFYWAPMLAESNSDGAAVPDDRLIRGAPMNKHSSFWKGADVLVFNSYLWWMTGDKIQILRGADEDMSKDIVEMEAAEAYRLVLHQVTRWLEGNVDPKSARVFFVTASPSHAGAGGECYDQTTPVGAADAASYCGSTSRRMVQVAGEVLGASRVPVGVVNVTRMSELRRDAHTQVYREQRWAKPTAEQLAADPRSYADCTHWCLPGVPDAWNELLYWKLFFPARDEAI

SEQ ID NO: 21101 - protein, 341 aa, Mus musculus
MSLHGKRKEIYKYEAPWTVYAMNWSVRPDKRFRLALGSFVEEYNNKVQLVGLDEESSEFICRNTFDHPYPTTKLMWIPDTKGVYPDLLATSGDYLRVWRVGETETRLECLLNNNKNSDFCAPLTSFDWNEVDPYLLGTSSIDTTCTIWGLETGQVLGRVNLVSGHVKTQLAHDKEVYDIAFSRAGGGRDMFASVGADGSVRMFDLRHLEHSTIIYEDPQHHPLLRLCWNKQDPNYLATMAMDGMEVVILDVRVPCTPVARLNNHRACVNGIAWAPHSSCHICTAADDHQALIWDIQQMPRAIEDPILAYTAEGEINNVQWASTQPDWIAICYNNCLEILRV

SEQ ID NO: 21102 - protein, 382 aa, Neurospora crassa
MKNFFLVTIISILVGICSIFLLPIDLLQVDISTLTNQLLNYTNINTYFATQPSEDISASSTSSSNPTIVITTTPTAANMSVPRLIRKIFLATEQAEGAGARVRRSIGTPQLRNFSPFLMLDHFTIRPGSGFPDHPHRGQETITYLLSGGVDHEDFAGNKGTIEAGDLQFMTAGRGIMHAEMPRQNPDGSANVGLQLWVDLPKELKSCEPRYRDLKAQEIPTVETDEGRVKIKVISGKSHGVDSVKDLAYTPVWILDVEVKPGGKVVQEVPEGWNAFAYTLEGTAIFSSGKDGEKRTVEQFHNVVFEPQGEAVYAEVDAGAEKPARFVLVAGTPLDQKVVQYGPFVLNSQEEVYQAFVDYQTHSNGFERAQGWRSEIGKSMRH

SEQ ID NO: 21103 - protein, 537 aa, Neurospora crassa
MTDNPEEPLIANTQSTERDQDDGSHDVEHAHDSRGGKQHISPPGLFIWLLTFSAGISGLLFGYDTGVISATLVSIGTSLSHRPLTSLDKSVITSCTSLFALLALPFASALADDRGRKRVVLFADTLFIIGALCQAASRTVEVMVIGRSVVGIAIGAASFVTPLYIAELAPATHRGRLVTMNIVFITLGQVVAYVVGWIFGTYGSPETTGWRWMVGLGAVPAVCQVVILLWMPESPRWLVKDGRSQEARAVIAKIAAGDDAQDPSTRREVDAVLKSIEIEVREEATAMRLGGAGAGYANGNAVNAWMEAMRELIRVRRNRRALAIACLLQGLQQLCGFNSLMYFSATIFTMVGFSEPTLTSLVVAVTNFAFTLVALVLIDRVGRRRILLWSLPFMIAGLVLAGYGFSFIELPNSETSSPSTTGGQGGAVIILASIMIYVAGYAIGLGNVPWMQSELFSLSVRSVGSGVATATNWSANFVIGLTFLPLMEALSPSWTFVLYAVICAVGYGLIWTVYPETAGLSLEDAATLLEADDWGVR

SEQ ID NO: 21104 - protein, 605 aa, Neurospora crassa
MRFLPLLGGLLPLLGLVGAAPSCNHECNRACWTSRFNVNTDYENEWPVTGVTRKVSTCSHGTPQFDFEITEVDEWVGPDGHIKKGAMLINGGYPGPLIKADWGDRIEVTVTNKLKTNGTSMHWHGFHQLNSNNQDGVAGVTECLIVPGASKVYSFLATQHGTSWYHSHISSQYANGIVGPIQINGPSSYPYDTDLGVFPISDWYYDSAEHIVDRMMDPNDPFLKGVPGSPPPSNNILFNGMNIAPNGTGGEYARLKFTKNKRHRLRLVNTSADNTFVVSIVGHNMTVIETDFVPVEPYAVHQLYLTVGQRYDVVIKADQEVDNYWINATLSSTPLCGVSLNPYPAAIVSYEGSDESRLPTNRGPRAIDQFCEDDVSSKPLTSRTAPKADFSDTKVDTLSVTLDVKEVNKGISKVLWSVDGSAIDVQWDKPTLEYVVEGNFTFPRQANIIQLPEAVKWSFWVIQNNSPSPHPMHLHGHDFLILGRSRFPANPLVDPGQPILFDPVVDGPHLKFDNPTRRDTTVVPSFGWLVIAFEAGRNPGSWVFHCHIPWHMSQGLSVQFLERVDRINDGAIPNLMPDLQEKCDEWRRYADNDPEFRMKKVDSGI

SEQ ID NO: 21105 - protein, 238 aa, Populus tomentosa
MGRGKIEIEKIENPTNRQVTYSKRRNGIFKKAQELTVLCDAKVSLIMFSNTNKLNEYISPSTSTKKIYDQYQNTLGIDLWGTQYEKMQEHLRKLNDINHKLRKEIRQTRGEGLNDLSIDHLRGLEQHMTEALNGVRGRKFHVIKTQNETYRKKVKNLEERHGNLLMEYEAKLEDLQGGLVDNEAAVALVDGASDNEAAVALADGASNLYAIRLHHGHNHHHPNLHLEDGFGAHELRLP

SEQ ID NO: 21106 - protein, 385 aa, Mus musculus
MARENGESSSSWKKQAEDIKKIFEFKETLGTGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALSKNIHESVSAQIRKNFAKSKWRQAFNATAVVRHMRRLQLGSNLDSSNASVSSNLSLASQKDCLAPSTLCSFLSSSSGVAGVGAERRPRPTTVTTGHTGSK

SEQ ID NO: 21107 - protein, 505 aa, Antirrhinum majus
MWDLNDSPDQRKPEEPEGKWVGSVSNSSSSAVVVEDGSEEEDAEKCGIKRSSKIFGFSVAHNDDDEDETGNISSPVTRQFFPAGESPEIMLGGGGPPRAHWVGVKFCQSDPNGAVLGKAVAAHPLKKSRRGPRSRSSQYRGVTFYRRTGRWESHIWDCGKQVYLGGFDTAHAAARAYDRAAIKFRGVEADINFSLEDYEEDLKQMRNLTKEEFVHVLRRQSTGFPRGSSKYRGVTLHKCGRWEARMGQFLGKKYVYLGLFDTEVEAARAYDKAAIKCNGKEAVTNFDPSIYEEELKAAAEPSNKAADHDLDLSLGNSASKSSGQRPGFVDQPSSSMTFEVDWRRHGLKPENHMTSTDIDNPRRRDNGYSETETLQLLSQTHLNSPGMLKANDERHRFGQLGKTHEPHMIQMFNTPFTSQNYHQIYHNFPAAGASVSGSRNVNGGEFNNYVARNEQQWQMNHHQLFASAAASSGFPHAPPLLSSSRPRDWPLQKNGFHSSYNIRPS

SEQ ID NO: 21108 - protein, 505 aa, Antirrhinum majus
MWDLNDSPDQIRTFDDLSSEGRRVDYSSSSAVVIEDGNSEEELDAAGKKRNSSKIFGFSVHSCCDHDTCTCSSSSPVTRQFFPVEDTAPDNFPRAAHWVGVKFCPNDNGLGKAAIAADVAQPMKKSRRGPRSRSSQYRGVTFYRRTGRWESHIWDCGKQVYLGGFDTAHAAARAYDRAAIKFRGVEADINFSLEDYEDDLKQMSNLTKEEFVHVLRRQSTGFPRGSSKYRGVTLHKCGRWEARMGQFLGKKYVYLGLFDTENEAARAYDKAAIKCNGKEAVTNFDPSIYEDEFKTAESSKSEGDHNLDLSLGNSSASKSSGRERDNHSSSSMQLEADWRQWKPEQQLTSNNVGNPGKQYGYNETETLQLLSQTHLHSPLKVNNEMHRFGQLGKANEPQMLQMYSKPYAPQNYHQIHHHHQQQQFQGGGGSSSSTTNVVINGKSVGGVGEASSVSRNEQQWQMNYHHQFAAASSGFPQAQAQIIKPQNWLQIKKNGIHPSTLMRPT

SEQ ID NO: 21109 - protein, 346 aa, Caenorhabditis elegans
MASETSQFGIETDSITLQRYVLQEQRKHADASGELTALLTNMLVAIKAIASATQKAGLAKLYGIAGATNVQGEEVKKLDVLSNELMINMLKSSYTTCLLVSEENDELIEVEEQRRGKYIVTFDPLDGSSNIDCLVSIGTIFGIYKKRGDGPATVDDVLKPGKEMVAAGYALYGSATMVVLSTGDGVNGFTLDPSIGEFILTHPNMKCKEKGSIYSLNEGYAQTWSKGFAEYIRTRKYPEAGKKAMGQRYVGSMVADVHRTILNGGIFLYPPTVSAPNGKLRLLYECNPMAYIIEQAGGLATTGKERILDIQPTQSRYSANTDSPTRSNHSRIETRRRGGSRISCQI

SEQ ID NO: 21110 - protein, 366 aa, Caenorhabditis elegans
MAFHEYPVTQDYRISRKVLGVGINGKVVECEHRQSGDKFALKVLRDTQKARREVELHVMASGHGHVVSVHDVYKNSYNGVDCLLVVMENMKGGELFNRIQERGQKAFTEREAAGIVNEICSAVAHLHRMSIAHRDLKPENLLYVTTASNAALKLTDFGFAKKTDESEPQGLKTACFTPYYCAPEVLGTEKYDKSCDLWSIGVIMYILLCGYPPFYSQHGQPMSPGMKAKIKSGQYTFPSPEWDCVSEAAKDLIRKLLRTEPTERITIEQTMEHKWISHYRRVPDTPLFTSSNLNDQREQWTDMQDEMEATLASMRVGPENIQIKSLGDSNNKLLAKRRKGGASPKDDPMDDIKEEEKDDEEEKMIS

SEQ ID NO: 21111 - protein, 160 aa, Streptococcus pyogenes SSI-1
MQEALKEAEKSLQKAEIPIGCVIVKDGEIIGRGHNAREESNQAIMHAEMMAINEANAHEGNWRLLDTTLFVTIEPCVMCSGAIGLARIPHVIYGASNQKFGGADSLYQILTDERLNHRVQVERGLLAADCANIMQTFFRQGRERKKIAKHLIKEQSDPFD

SEQ ID NO: 21112 - protein, 111 aa, Streptococcus pyogenes SSI-1
MKERYFFCDVVGKCLEEYVDRGIFDKEPFQTFDQKGIGRLFSTAVSLARSVKPDLKLGICGEHGGDPTSIAFCHSQGLTYVSCSPFRVPLTRLAAAQAAIKASGHSLTQDK

SEQ ID NO: 21113 - protein, 187 aa, Streptococcus pyogenes SSI-1
MKGWPNMTKHITLAVSGSISAYKAADLTSQLTKIGYDVHIIMTQAATQFITPLTLQVLSKNAIHLDVMDEHDPKVINHIELAKRTDLFIVAPASANTIAHLAYGFADNIVTSVALALPATTPKLIAPAMNTKMYQNPITQENIKRLSTIGFTEIPPKSSLLACGDKGPGALADIDVILATIDTIWKL

SEQ ID NO: 21114 - protein, 333 aa, Streptococcus pyogenes SSI-1
MMSETKLMALREAVNLAMTEEMRKDENIFLMGEDVGVYGGDFGTSVGMIEEFGPKRVKDTPISEAAISGAAIGAAITGLRPIVDVTFMDFLTIMMDAIVNNGAKNNYMFGGGLITPVTFRVASGSGIGSAAQHSQSLEAWLTHIPGIKVVAPGNANDAKGLLKSAIRDNNIVLFMEPKALYGKKEEVNQDPDFYIPLGKGDIKREGTDLTIVSYGRMLERVLQAAEEVAADGINVEVVDPRTLIPLDKELIIESVKKTGKLMLVNDAYKTGGFIGEIATMITESEAFDYLDHPIVRLASEDVPVPYARVLEQAILPDVEKIKAAIVKMANKGN

SEQ ID NO: 21115 - protein, 218 aa, Streptococcus pyogenes SSI-1
MLMIKGIIFDMDGVLFDTEPFYLRRREDFFKTKGIPIDHLNSKDFIGGNLQELWKELLGKNRDDAIVKAITTDYDAYKQAHKPPYQKLLITEVNSCLEQLKKQGIKLAVASNSKRQDVLLALETTQIKDYFEIILAREDVSRGKPYPDIYNKAVQKLGLQKKQLLVVEDSQKGIAAAKAANLTVFAITDYRYGIDQSQADHKIDHLGQLCVKIGCFGS

SEQ ID NO: 21116 - protein, 399 aa, Vibrio parahaemolyticus RIMD 2210633
MQTLAGKKILLGISGGIAAYKCAELTRRLIERGAQVQVVMTKAAKEFITPLTMQAVSGRPVSDSLLDPAAEASMGHIELAKWADLVLLAPATADLIARMSAGMGNDLLTTLVLATDSPVAVSPAMNQQMYRNIATQENIATLARRGMNIWGPAAGEQACGDVGPGRMLEPMQLVHLCEQFFQPKVLEGKSILISAGPTREAIDPVRYITNHSSGKMGYALANAAAQLGAKVTLVSGPVNLSTPMGVERINVSSAQEMYEAVMAQAISHDAFISCAAVADYRPEAIASQKLKKTADNDQMTIKMVKNPDIVASVAALTDKRPFTVGFAAETNDVETYARGKLAKKNLNMICANDVSVEGQGFNSNDNAITLFWPDGELALALESKEALSFKILEKMRELM

SEQ ID NO: 21117 - protein, 335 aa, Vibrio parahaemolyticus RIMD 2210633
MKRDLAMAFSRVTEGAALAGYKWLGRGDKNAADGAAVEVMRTLLNKTDISGEIVIGEGEIDDAPMLYIGEKVGLGGDEVDIAVDPIEGTRMTAMGQSNALAVLAAGEKGSFLKAPDMYMEKLVVGPGAKGVIDLEKPLKENLENVASALNKTLDTLVVITLAKPRHDDVIAEMQAMGVRVFAVPDGDVAASILTCMPDSEVDLMYCIGGAPEGVVSAAVIRALDGDMHGRLLPRHEVKGDTEENRIYGAAELQRCEEMGVKANVVLKMEDMARSDNVVFSATGITKGDLLEGISRQGNIATTETLLVRGRCRTIRRIKSTHYLERKDPEVRDIIL

SEQ ID NO: 21118 - protein, 338 aa, Vibrio parahaemolyticus RIMD 2210633
MSGMRTLGEFIVEKQADFPHASGDLSSLLASIRLAAKIVNREINAAGLGDITGAVGTENVQGEAQQKLDVYANDKFKAALEARDQVCGVASEEEDEAVAFNKELNQNAKYVVLMDPLDGSSNIDVNVSVGTIFSIYRRVSPIGTPATEEDFLQPGHKQVAAGYVIYGSSTMLVYTTGNGVNGFTYDPSIGSFCLSHENMMIPEDGKIYSINEGNYIRFPQGVKKYIKYCQENVPEDGRPYTSRYIGSLVADFHRNLLKGGIYLYPSTQSHPQGKLRLLYECNPMAFLIEQAGGIASDGVNRIMDIKPTELHQRVPFFVGSKNMVRKVEEFLELHRDEE

SEQ ID NO: 21119 - protein, 538 aa, Vibrio parahaemolyticus RIMD 2210633
MASNQIEGAVVGIRVNDGIAAAPVVLFTHEMPAVPERDFQSEQGEIERVKRAIGVVVQHLQEQAKQPKGEIFSAHSMMLSDPELWASVESRIQTGMIAEQAWIESLQTLADEFRQAESQYMREREADVHDIARQVMVEMTGVTPNAIDIQEPSILLARDLMPSDVAGLDKSKVLGICLSEGGKTSHSAILARAMGIPAMVKAQGCLDAVRAGQVVTIDGFRGHLWFSPSDAIQQELEAQQIEWQSTRQSALASAQQAAATCDGVHIPVFANIGGPKDIDDALTSGAEGVGLFRTEFLFQNSDELPTEEAQYQVYRDIAAALGDKPLTIRSLDVGGDKPLAAYPMPAEDNPFLGLRGVRLCLQHESLFTAQLRAILRAFHEQPNIQLMIPMVAQVEEVRKVKALLAHQANQLGLDATHLPVGIMIEVPAAVLNADALAQEVDFFSIGTNDLTQYVMAADRGNAAVAELVNYFEPSVLKAIELTCAAGDRAGIPVSMCGEMAGDPNATETLLRVGLQKFSASPSLLPGLKAQIRQLSVDV

SEQ ID NO: 21120 - protein, 620 aa, Vibrio parahaemolyticus RIMD 2210633
MDQNPQSQLKLLVIKGKEQGYLTYAEVNDHLPAEIVDSEQVEDIIQMINDMGIKVVETAPDADDLALNDDTNITDEDAAEAAAAALSSVESEIGRTTDPVRMYMREMGTVELLTREGEIDIAKRIEEGINQVQSSVAEYPGTIPYILEQFDKVQAEELRLTDLISGFVDPDADDTAAPTATHIGSELSETQLEEEDEEDLEDDEESDDDSDDSEEDVGIDPELALEKFNQLRSTYQNLQLAINEYGYDSPKATVANEMMLDVFKEFRLTPKQFDHLVNELRTAMDRVRTQERLIMKSVVEYGKMPKKSFIALFTGNESSDAWLDEILASDKPYAEKIKRNEEEIRRSIAKLKMIEEETSLNVQNIKDISRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPLPEELAERMQMPEDKIRKVLKIAKEPISMETPIGDDEDSHLGDFIEDTTLELPLDSATATSLKMATKDVLAGLTPREAKVLRMRFGIDMNTDHTLEEVGKQFDVTRERIRQIEAKALRKLRHPSRSETLRSFLDE

SEQ ID NO: 21121 - protein, 783 aa, Vibrio parahaemolyticus RIMD 2210633
MKPMKNLAQYYVDLLVKLGIVRFSILLALALVALAVVVQVGITLALKGRVDDIDIVRSVFFGLLITPWAVYFLSVVVDQLEESRQRLTKLVSKLKDMRSRDQELNFQLQQNIEKLNLEIEERIKAEEAREEAMQDLENEVFQRERTQLELAERTALLRSFIDASPDLIYYRNADGVFSGCNRAMEELTGKKEHQLVGLSPWDVYSKEIAQPIVDTDQKVFSDNQAITYEQWLEYPDGRKHYFELRKVPFYSKDGRHLGLVGFGRDITERKRHEESLEKASRDKTTFISTISHELRTPLNGIVGLSRMLLDSQLTEEQRKHMQTINVSAITLGNIFNDIIDMDKFDRRKLELLPAPLNFEDFVAEIESISALMAEQKGLRFDLERLSDLPKAIEVDATRLRQVIWNLVSNAMKFTKEGGVVMTVSADVEEDFATIIMEVEDTGIGIPEAELDKIFAMYYQVKSGKDNLHAVGTGIGLAVSKQLINMMDGDITVTSEEGFGSTFTVSIHVPIVELEEPVIDAKRDNVHLNIFMVEDIELNVTVAKSLLESLGHSVTVAMTGEEALVNFVPDQYDLALLDIQLPDMTGFDVAKYYREHYDHLPPLVALTANVMKDRREYLENGMDDAISKPLAVHAIQSVIDKFFVDRVDKPAVIVKPEVKEEAAPSPVIETHLLDLDMLESYVDIVGVKPVYDSIKMFEDMMPDYIEVLDSNMTAKDQDGIVSEAHKIKGAAGSIGLKRIQSVAQKAQSPDMPAWWENISDWVEEIKNEYQNDIQVLKSWLDQRK

SEQ ID NO: 21122 - protein, 748 aa, Vibrio parahaemolyticus RIMD 2210633
MLSQLREIVEKVSRVDDVHLALDILVKETCAALRTECCTIYLANEEMQRLELMATQGLIFEGDSIHINFNEGLVGLVKRSAEPLNLAEASKHPEFKFFPQLGEQVYHSFLATPIIHRKQVLGVLVIQQKTPRLFSEMEESFLVTLSAQLAVIIAHAQSLGHWQLASKPTVLKGLPASTGVAIGEFWFDNTQPSLSDVFPSSTLDKEREQELLLVAIERALNDFRRMRKKFDSEINKDALAIFDLFTHLLNDPMLRGDLKKQIEKGDRADWALRQVVETYSNRFARMSDVYLRERAQDIRELGQRLLYFLHNSEQENAAIDRPIILVANELTATLLASVPKEHLLAVVSLEGGANSHAAILSRALGVPAVMGANINTDVVNGKLGIVDGYTGEIFLEPNRQLLREYRSLVSEESELFAMVNKDLALPAVTLDNQYIEVMLNAGLSADSNIAINTGVDGVGLYRTEIAFLLQHHFPSEDEQYHQYRAILNSYSNQRVVMRTLDIGGDKPLPYLPIEEDNPFLGWRGIRFTLDHPDIFLIQLRAMLRASAESGNLSILLPMVSGIKELDDAMTLINQAYSEVVLLDERIQAPKVGVMIEVPSMVYLLPAIAHRVDFVSVGTNDLTQYLLAVDRNNSRVADVYESMHPAVLLALKQIHDVCDKYHVPVCICGELAGDPFGALLLLGLGYTSLSMNTSNVAKVKYLIRHSQQQELEKLAEQAMTKSYGEEIHQMMHDFFIQQGFAGFVRAGKK

SEQ ID NO: 21123 - protein, 490 aa, Vibrio parahaemolyticus RIMD 2210633
MQMLRIAKEALTFDDVLLVPAHSTVLPNTADLRTQLTKNISLNIPMISASMDTVTEARLAIALAQEGGIGFIHKNMSIEQQAAEVRKVKKFEAGVVTDPVTVNPDATIADVVALTEKHGFAGFPVVTEHNELVGIITGRDVRFVTDLSKKVSAVMTPKERLASVKEGATREEVQEKMHEARVEKVLVVNDEFKLTGMITAKDFHKAERKPNACKDERGRLRVGAAVGAGAGNEERVAALVEAGVDVLLIDSSHGHSEGVLQRIRDTRAAYPDLDIIGGNVATGAGAKALIEAGVSAVKVGIGPGSICTTRIVTGVGVPQITAIADAAEVANEYGIPVIADGGIRFSGDICKAIVAGASCVMVGSMFAGTEEAPGEVILYNGRSYKAYRGMGSLGAMSQGSSDRYFQSDNAADKLVPEGIEGRIAYKGRLKEIVHQQMGGLRSSMGLTGSATIEDMRTKAEFVRISGAGMQESHVHDVQITKEAPNYRLGN

SEQ ID NO: 21124 - protein, 161 aa, Vibrio parahaemolyticus RIMD 2210633
MRRALALAEQAELEGEVPVGAVLVKDGEVIAEGWNRSICSHDATAHAEIQTLRNAGAVLENYRLLDTTLYVTLEPCPMCAGALLHSRVKRVVFGAPDLKAGAAGTVLNLFESQAAYHYATVEKGLLEDECREQLQAFFKRRRKEIKAKKQEKKVLEGKQED

SEQ ID NO: 21125 - protein, 621 aa, Vibrio parahaemolyticus RIMD 2210633
MTLDISKYPTLALANTPEELRLLPKETLPTLCDELRTYLLNSVSQSSGHLASGLGTVELTVALHYVYNTPVDKLIWDVGHQAYPHKILTGRRDQMPTIRQKDGLHPFPWREESEYDTLSVGHSSTSISAGLGLAISAQKEGKGRKVISVIGDGAITAGMAFEAMNHAGDVHPDMLVILNDNEMSISENVGALNNHLAKVLSGSLYTSIREGGKKVLSGVPPIKELVRRTEEHLKGMVVPGTLFEEFGFNYIGPIDGHDVNELVKTLKNMRELKGPQFLHIMTKKGKGYEPAEKDPIGYHGVPKFDPSHNCLPKSSGGKPTFSKIFGDFLCDMAAQDPKLMAITPAMREGSGMVRFSKEFPDQYFDVAIAEQHAVTLATGMAIAGDHPIVAIYSTFLQRGYDQLIHDIAIMDLPVMFAIDRAGLVGADGQTHQGAFDLSFMRCIPNMVIMAPSDENECRQMLYTGHKHTGPSAVRYPRGSGMGTEIEKEFTALEIGKGRVVRKGEKVAILSFGTFLPNALEAAKNLNATVADMRFVKPLDEALIRQLADEHDVLVTLEENAIAGGAGAGVIEFMMKEKIIKPVLNLGLPDKFIHQGTQEELHEELGLDAKGIEKSIAEYLAK

SEQ ID NO: 21126 - protein, 574 aa, Vibrio parahaemolyticus RIMD 2210633
MISGILASPGIAIGKALLLQEDEIVLNTNTISDDQVEAEVARFFDARNKSAAQLETIKQKALETFGEEKEAIFEGHIMLLEDEELEEEILALIKNDKMTADHAIHSVIEEQACALESLDDEYLKERATDIRDIGSRFVKNALGINIVSLSDINEEVILVAYDLTPSETAQINLDYVLGFACDIGGRTSHTSIMARSLELPAIVGTNDITKKVKNGDMLILDAMNNKIVVNPSEAEVEEAKAVKAAFLAEKEELAKLKDLHAETTDGHRVEVCGNIGTVKDCDGIIRNGGEGVGLYRTEFLFMDRTALPTEEEQYQAYKEVAEAMNGQAVIIRTMDIGGDKDLPYMDLPQEMNPFLGWRAVRISLDRREILRDQLRGILRASAHGKLRIMFPMIISVEEIRELKNAIEEYKAELRAEGLAFDENIEIGVMVETPAAAAIAHHLAKEVSFFSIGTNDLTQYTLAVDRGNEMISHLYNPLSPAVLTVIKQVIDASHAEGKWTGMCGELAGDERATLLLLGMGLDEFSMSGISIPKVKKVIRNSNFAEVKAMAEEALSLPTAAEIEAVVEKFIAEKTQ

SEQ ID NO: 21127 - protein, 462 aa, Vibrio parahaemolyticus RIMD 2210633
MSNQHQYFGHPRGLFLLFGTELWERFSYYAMRAILVLYLTDTTMNGGLGWSTKDALDLYGIYTGLVYITPLIGGYLADNYLGQRRSILLGGALMAIGQFTLALPADALGFGALHTFYLGLALLICGNGLFKPNISTMVGDLYNEGDNRRDGAFTIFYMGINLGALLAGVVSGSVTNSFGWKAGFVAAGVGMIISLVMQMSLSQSWLGDIGREPAAKRDLNNKNAKTKQPLTKEEVDRIKVILVMSLFTIVFWAGFEQAGGLMNIYTQQYTDRMIGGFEVPAAWFQSLNPFFIITLAPVLAVLWVKLGKREPNSPAKFALAMFFLALGFLCMVGAVMEQGGDTNVKTSMLWLVGAFFFHTLGELCLSPIGLSLVTKLAPLRLASLMMGAWFGCNAIANYVAGYVGSHVGELGAMAIFSGIAVTALISGVILMLFSNTLVRWMHGAENTHSTAEQIEEQQTQVA

SEQ ID NO: 21128 - protein, 241 aa, Vibrio parahaemolyticus RIMD 2210633
MTRQVLVTGASKGIGKAIAVQLAKDGFQIIVHYMGDQQGAQDTLDTIEQHGGSGRLIQFDISDRADCREKLEADIAEHGAYYGVVNNAGITKDTAFPAMTEEEWDGVIHTNLDSFYNVLHPCVMPMVQKRKGGRIVTLASVSGLMGNRGQTNYSAAKAGVIGATKSLALELAKRKITVNCVAPGLIDTGMVDEHVKEHAMPQIPLRRMGEPEEVAGLVSYLMSDIAGYVTRQVISVNGGLV

SEQ ID NO: 21129 - protein, 806 aa, Vibrio parahaemolyticus RIMD 2210633
MEIRSSLRKKSILALTLYLCFFIATIGSVVYLVVEPPVRDKLERNLDLRTQLLASQIKEPLITSTGVLNSLVGLAQSSNQSDSLKSTIPQILRLSDEIIVSGGLWPKPELKEERWRFTSLFFNKNSEGNIDQIHSYNNPESGGYDNEPWYRAAAEQSSGTVSWSAVYIDTFTQVQMITASAPYYRNGEFAGVATVDLSLEALFQFIREHTNQYSLGVVIRDANSNVIIEHNFQITKQMYISKLDFGEFHWKLEVVNAKAKVADQVFEQVMSVEGGIIPFLLLCVLVGYYLLNRYIVEPIVRIATKIDDSKTGGIIDIDYGSEDEIGHLITKFNEKTIYLEQERVKAQASTNAKTAFLATLSHEIRTPMNGVLGTAQILLKTPLTDEQRKHLSTLYDSGDHMMTLLNEILDYSKIEQGHVEFSNSPFPIESIIGSIKSVYHTLCAEKGLQFKVTSLVPAGRWYDNDKARLRQVLFNLLNNAVKFTDRGIVEVTLSEQTHYDKTVLVIAIKDTGIGISKEAQKRIFRPFEQAESSTTRRFGGTGLGLAIVKEIAEHMGGHVTVQSQENIGTTFTVEVEISPCEPGKVESGHRHKLNCNGLKALIVEDNRTNAIIMETFLRAKGFECSSVENGQLAVNKIAVEPFDLILMDNHMPVLDGVGAISAIRSMSSAAKSVLIFGCTADVFKETQERMLGVGADHIIAKPIVESELDDALYRHADLLYQYQTKQNQQALEVLGTDSLLISFYVALDNGNLGDALDALLAIMDSLQPNTDEVLSEVITRIKRDLLRQSPPDQEDIDTLTMLLATP

SEQ ID NO: 21130 - protein, 458 aa, Vibrio parahaemolyticus RIMD 2210633
MTFLSQLSTHADKAFLRRLFAIALPITLQSIMFSSRSLVDVLMLGQLGEAEIAAVGVAARATFVTTIMLVGVTTGGALLTAQYWGAGDKIGVRQSTSLTWMIAMVFAALAVCLFVFFPQPIMGLTTDSQEVIELGSSYLVISSASMFAVACVASMAVGLRAMHQPGLSTFFSGIGILSNVFLNWVLIFGHLGFPALGITGAAIATVISGAIEVGCLFGYLWLKKHIIAFGWGDIRASLVLDKITRFLSLSLPTTFNFLAWAGGLFAYHAIMGQAGVQGLAALSVMTPVESIALAMMIGLSNAAAVLVGNQLGAKNFEPVYYQAWATVILNVLIAFGVAVLLFFTNQLILDAFSALSAETRHLAEQFMVILALGVILRSVPMMVIVGVLRAGGDVKFCLYQDVFAQWIIGIPLAAFAAIYLGWEPQWVYLLFLTEEVVKWCICLPRMKSKKWMKNLIEK

SEQ ID NO: 21131 - protein, 562 aa, Vibrio parahaemolyticus RIMD 2210633
MIKFASFLKFRVQINGGRYWSSSPLRSVSNYVKFVFMDNAFKKYSIDTTDYQVGQDNVQKWGFDIHNPVFGISAGLVVFCLISLLLVEPVTARDALNGIKNGIIEQFDAFFMWSTNFFLLFAVGLLFSPLGKIRLGGKEATPDHSTVSWLSMLFAAGMGIGLLFWSVAEPTAYFTDWWGTPLNAEAYSADAKSLAMGATMFHWGVHGWSIYALVALALAFFAFNKGLPLSLRAAFYPIFGDRAWGWLGHVIDILAVLSTLFGLATSLGLGAQQATSGINHVFGLNGGIGTQMVVIAFVTFIAVLSVVRGIDGGVKLLSNVNMIVAFALLIFITFITFDTAMGSLVDTTMAYIQNIIPLSNPHGREDETWMHGWTVFYWAWWVSWSPFVGMFIARVSKGRTVREFLFAVIVIPTLVTLVWMSVFGGIALDQVVNKVGELGANGLTDISLTLFHVYDVLPYSSVISILSIVLILVFFITSSDSGSLVIDSITAGGKIDAPVPQRIFWACIEGSIAAVMLWVGGKEALQALQSGVVATGLPFTFVLLLMCVSLVKGLRTELSAYR

SEQ ID NO: 21132 - protein, 456 aa, Vibrio parahaemolyticus RIMD 2210633
MHRYKEEASSLIKLATPVLIASVAQTGMGFVDTVMAGGVSATDMAAVSVASSIWLPSILFGIGLLMALVPVVAQLNGSARREKIPFEIQQGVVLALLISIPIIGVLLQTQFILQLMDVEAVMAGKTVGYIHAVIFAVPAFLLFQTLRSFTDGMSLTKPAMVIGFIGLLLNIPLNWIFVYGKFGAPELGGVGCGVATTIVYWVMFALLLAYVMTSSRLKSINVFGEYHKPQWKAQVRLFKLGFPVAAALFFEVTLFAVVALLVSPLGPIIVAAHQVAINFSSLVFMLPMSVGAAVSIRVGHRLGEENVDGARVASRVGIMVGLALATITAIITVLSRELIAELYTNNPEVISLAMQLLLFAAVYQCTDAVQVIAAGALRGYKDMRAIFNRTFIAYWILGLPTGYILGRTDWIVEPMGAQGFWLGFIIGLTAAALMLGVRLRWMHRQEPDVQLNFSLQ

SEQ ID NO: 21133 - protein, 576 aa, Vibrio parahaemolyticus RIMD 2210633
MKDKYLDTYQQEALQEALVELKQTKQREKLLADENKAILSAISAMSEAKNRNEIFSGLNSVLKKYISFEDFIVITRDDNRYPFKTLISTNSVFDKVEWLHGNTMDRALNGECILLFEPAKLLEFENLNSFVKTHVNSVILTGIRSEVTQSIILLIGAQKGHFSIENKETLRRFRPLIERAVIDIETKEKLQRIVEVRTTQLARAREEAELANQSKSEFLAMMSHEIRTPLNSVLGMLDILRQSTLSDEQFDALNQMECSAELLLAIISDILDLSKIESGSFQLNEQWIHLNDTVTFVISQQKQVAITKNLSFNFDCQISSDKQYWIDSTRLSQILFNLIGNAIKFTDSGSVSVSVAEENDEVVVSISDTGIGISRAKQAHLFTAFHQGDRSITRRFGGTGLGLAITKHLVEMMRGEISVKSRENEGSDFTIRIPVLTRYNQSRPVKIEHNRPSKALNLLIVEDTQSNQLVIKLILNKLGHNVHIASHGAEALTFLEENDTRIDMILMDVSMPVMDGITATRLIRKKGITIPIVALTAHALESDKDKCLDAGMDSFVSKPVRRQDIYEAIQSLIETA

SEQ ID NO: 21134 - protein, 506 aa, Vibrio parahaemolyticus RIMD 2210633
MIYAQPGSENAIVNFKSHYDNFIGGEWVKPTGGEYFDNISPINGQAYCKVARSGEADINLALDAAHNIKAKWAKTSVTERSNILLKIADRIEQHLEELAVAETWENGKPVRETLAADLPLVVDHFRYFAGCIRAQEGSAAELDEHTASYHFPEPIGVVGQIIPWNFPMLMAAWKLAPALAAGCCVVLKPAEQTPTSILVLMEKIGDLLPPGVINVVNGFGSEAGQALATSNRIAKLAFTGSTQVGNHILKCAADNLIPSTVELGGKSPNIYFSDIFDYEDEYLDKCIEGTLLGFFNQGEVCTCPSRVLVHEAIYDKFVEKLTERAQLIKQGNPLDTDTQVGAQASQEQFDKILSYLEIGREEGAKVVFGGGVSEQPESISQGYYIQPTMLEGHNKMRIFQEEIFGPVIAITKFKDEAEALEIANDTEYGLGAGVWTRDANVAYRMGRNIEAGRIWINCYHAYPAHAAFGGYKKSGIGRETHKMMLDHYQNTKNLLISYSIDPLGFF

SEQ ID NO: 21135 - protein, 553 aa, Vibrio parahaemolyticus RIMD 2210633
MSTDNNGGIKRPDGKVNAIDTDYQIGQDNVALKVGPFGLDIHNRVFAISGMAIVLFVVATLTFRQQVEPFFAGLRAWLVSNLDWFFLASGNVFVIVCLVLIVTPLGRVRIGGTEATPDYSYAGWLAMLFAAGMGIGLVFFGVSEPMSHFSSALGGVNIENGVRTDWAPLGGAVGDTDAASALGMAATIYHWALHPWSIYALLALGLAIFSFNKGLPLTMRSIFYPLFGERVWGWVGHIIDILAVVATVFGLATSLGYGASQAATGLNFLFGVPMTDTTQVVLIVVITALALISVVAGLDSGVKRLSEINMILAAMLLFFVIIVGPTMAILTGFFDNIASYITNIPALSMPFEREDVNYSQGWTAFYWAWWISWSPFVGMFIARVSRGRSVREFIICVILIPSTVCVLWMTAFGGTAISQYVNDGYEAVFNAELPLKLFAMLDVMPFAEITSVVGIILVVVFFITSSDSGSLVIDTIAAGGKVDAPTPQRVFWCTFEGLVAIALMLGGGLAAAQAMAVTTGLPFTIVLLVATVSLIKGLMDEPRLSTKAVKKDK

SEQ ID NO: 21136 - protein, 1051 aa, Vibrio parahaemolyticus RIMD 2210633
MVGIFSWNNLSVKHKLFGLVLLPIISLFFLAGQHVHNLSTQAQDLQKAQLFSVYIDKVSYLFNLPNNPSIPNKAEKTAQLIQELKETTPRVFGDNSEVLPLLASFEEASLSMFTAIDIEEKLDIAEWRADTFEQILLNLDKVYFSNVSYETDRHLSSLMQLEWLMFWSTEERRLSEYLIYSANKRLHYDDAVRDEIQSLIQNQQLLVERFVALNANHNQVQLLIETFSNKVFQTSQEFRDKLLNQEELQALSPLKTGAGLAALNTRLALLHDINDTMEHELQTKLAQTIKATTQQRLVFIVLMSLVTILVISLTIRLVRKVTNNLHLVLEFLSRENYSEDSPLSELIKGKDELSKFAQEVEKLSHEREQAKQKLTKAKEDAERAKDDAIEASKAKSSFLANMSHEIRTPLNGVIGISEVLADTPLTATQRDYVDTIETSSQLLLSLINDVLDFSKIESGMLLISPHSTCVRESIYDIASIVSPKAKEKGIELTVSISPNTPYHIVIDDHRLRQVIMNFMSNAVKFTERGSVELSITTLESNESEAIIEFSVQDSGIGIDEQQQKRIFAPFAQEDDSTTRQFGGTGLGLAISTQLVELMGGSIQLESEKGRGSRFYFQLTAPISQAHFRARHTVNNQIWLVCDDSDLETKLRNELSFYQIQVHQSVHDLSALPTWINDKERIIILYVETTPDAAVKNTDLMRNLEHQHVQVCLIKHLHSQQLDFGHRVAAIITQPLLGQRLLKALESCAGRFTQSISVVQPATRLETLPKVLVVDDNTVNQKIAGLHVTKAGFSFDVAANGEEAVDLFRTSQYCLILMDCMMPVMDGFEATKQIRQIEQKENRTFRIPIIALTASVVDDDIQKCFDVGMDDYVPKPFKADLLKEKLDKAVGLRLPVTASTKLNQSSLTAFEEPEFKQRVGETLSAAPMRRERILLVEDNRVNQKVASLLLSKAGYQFEVAENGQIAVEMFQRDGGFDIILMDCMMPVMDGFEATKQIRAYEASLGLEKTPIIALTASVVDDDIQRCFDSGMDAYVPKPVRKEKLLHQIENVM

SEQ ID NO: 21137 - protein, 295 aa, Vibrio parahaemolyticus RIMD 2210633
MNILLAMIPAFFWGTTYAVTQFTLPDWPPVLLGALRALPAGLLLLAIKPSLPKKHEWKVLLVLGTINIAFFFGLIFVMALTLPSAISGVGMISVPVFAMLFGWAVYKRQPSAIQGISGAVLIALAWFLFDPSSISLNPIGLGAMLAAIMCIVIGSSVTKSLGTKMHWWTVLTWQLILGGVLLSIAAAVLATINPQPYVHAVQNIDMTNTLGLLWVIVLNTALGYGMYVWLLQRMSVVDFTFGGIANPIAGIVSGLLLLGENFTPLQYSLMVGMIVMSLLPQILTSLRARKEAITV

SEQ ID NO: 21138 - protein, 481 aa, Vibrio parahaemolyticus RIMD 2210633
MSKGMTMQQIQNQSLVSFMVANPQQGIAVTNPATGELLGYAPVSTENDILNSIERAHVAQKEWSALPAKTRAGMLNRWFQLLLENKADLGRLMTLEQGKPLAEAQGEVLYGASFIEWFAEEAKRTYGETIPAPSADKRLVTIKQPIGVACAITPWNFPIAMITRKAAPALAAGCSFVVKPSESTPLSAFAVAELAYQAGIPRDVLQVVLGENSRQVGAIFTSHPLIRKLSFTGSTQVGRVLMQQSAADIKRTSMELGGNAPFIVFDDADIDAAVAGAMASKFRNAGQTCVCANRFYVHSKVYDEFVAKFDAAVQQLKVGNGLEEGVNIGPVISESAKQGIQALIDGAIEQGAKPVSALKELDGLFMQPVVLKGVTHDMKIVSEEIFGPVAPVIRFDSDEQLIEMANDTIYGLASYFYSQNIHRVWKIAEALEYGMVGINEGMISTEVAPFGGVKQSGIGREGAKQGIDEYMDVKYLCFGGN

SEQ ID NO: 21139 - protein, 369 aa, Vibrio parahaemolyticus RIMD 2210633
MKTQKQWIELKNNLNIENRAYINGEYSAALTGQTIPVVNPATDEIFTEIARCQSEDVDLAVSCARQAFQSGQWSESSPAHRKAVLKQFADLIDQHQEELALLETLDTGKPISHSFSTDIPGAANSLRWYAEAIDKVYGEVAPTEKDVHAFVSHQPIGVVAAVVPWNFPLWLACWKLGPALAAGNSVLLKPSEKSSLTAIFLGQLASQVGLPTGVFQVVTGFGHEAGDALAKHQDVDCIAFTGSTRIAGQLMVSSGESNLKRVFAEAGGKNANIVFEDCDDLDRAAAETAAGCFYNQGEVCVAATRLLVHESIKDQFIEKVIQASKAFTPKDPMNPSSSMGALIDQDHKSKVLEYISLGESEGAIRALWR

SEQ ID NO: 21140 - protein, 566 aa, Vibrio parahaemolyticus RIMD 2210633
MTGNSSLERKLKREIASRKAAELLLEQKSYELYESTQKLSVALKKLELRSESDLRKFEFEEKIDATLIRFGRTFLSSTFDETMIASFLEQLTSNSVITASYLYLDPVQLTSLRRHHFGHLDLKSDKPIARTPNWQNEALHLPIIIDERVVGELIFSVSLEQIEQAFISKQMELVSDLVHGVISRHLSLEREVELRKRAEESEKATKEFVAMINHELRTPLNGVLGSADLLSKTQLGEDQRQYLGNLIQSGDLLRVIINDLLDFSKMNAGMMEIIDKVFAWDDLEKAITGVFAAKAAEKRIHFSIDKKLGIPEFLIGDLERITQILVNLIGNAIKFTHLGGVVLRVEWVNGTAFFEVEDTGIGIPLAAQSSLFDPFVQVDRSAKRSFEGSGLGLAICKNLVDLMQGEISFESEERKGTTFKVSIPLKEGQAQGAASGELAVVERSDLAGRSILVVDDIRMNQVIVTQMLKKLDITPDLKANGLEALEAVKNKDYELIFMDCRMPEMDGYEATAHLRQKGFDRPIIALTAGTTIEERQKCIDSGMDDILTKPYTATDIEQIMCKWLEQ

SEQ ID NO: 21141 - protein, 523 aa, Vibrio parahaemolyticus RIMD 2210633
MTKGIDKYSIDSTDYTVGQDNVQKWGFDVHNPVFGISAGFIALFLVAALVLDAHTAKTALDGLKWKIIGSFDWLFIIAGNIFVIFCLALIVSPLGKIRLGGKDAVADYSFMSWLAMLFAAGMGIGLMFWSVAEPVAYFTGWYETPLGVEANSPEAARLALGATMFHWGLHPWAIYGVVALSLAFFTYNKGLPLSMRSIFYPLLGDRAWGWAGHIVDILAVLATLFGLATSLGLGAQQAASGIHHVFGVEPGLGLQIVVITVVTLLAVVSVVRGIDGGVKVISNINMVVAFLLLILVGLIGWAASLGSIPTTLMAYVENIIPLSNPFGRTDEAWFQGWTVFYWAWWISWSPFVGMFIARVSRGRTVREFITAVLIVPTVVTVVWMSVFGGLAIDQVVNKVGELGANGLTDVSLAMFQMFDVLPFGNILSIIAVVLVLVFFITSSDSGSLVIDSITAGGKVDAPVLQRVFWAFMEGAIAVALLWIGGSEAVQALQAGAISTALPFTFILLAMCVSLLMGMKTERQ

SEQ ID NO: 21142 - protein, 244 aa, Vibrio parahaemolyticus RIMD 2210633
MNLEGKIALVTGASRGIGRAIAELLVERGATVIGTATSEGGAAAISEYLGENGKGLALNVTDVESIEATLKAINDEFGAIDILVNNAGITRDNLLMRMKDDEWNDIINTNLTPIYRMSKAVLRGMMKKRAGRIINVGSVVGTMGNAGQTNYAAAKAGVIGFTKSMAREVASRGVTVNTVAPGFIETDMTKALNDDQRAATLANVPAGRLGDPREIASAVVFLASPEAAYITGETLHVNGGMYMV

SEQ ID NO: 21143 - protein, 358 aa, Vibrio parahaemolyticus RIMD 2210633
MHQFTSKQDFCHWFNQFQHPQLVENWADIHGVVTITAQGEVKITLPFASNELQRTLQEWIQQQQAFKAVAAFPYHIELGVKALETQVSNAVKGVKNIIAVSSAKGGVGKSTTAVNLALAIAQSGAKVGLLDADIYGPSVPMMLGQEDAKPEVRDGKWMEPIFAHGIYTHSIGYLVNKSEAAIWRGPMASKALAQLLNETDWPELDYLVIDMPPGTGDIQLTLSQQIPVTGTVLVTTPQDLALADARKGAAMFNKVNVPVVGVVENMSYHICSQCGATEHIFGMGGAEKMSQEFGLALLGQIPLHISMREDIDAGVPTVVRRPDSEHSGYYKQLADRVCSTMFWQGKAKPDAISFTMVN

SEQ ID NO: 21144 - protein, 244 aa, Vibrio parahaemolyticus RIMD 2210633
MNKAITYDQHGKFNSQQAFIERYSVLVKRIAHHLLGRLPPSVQVEDLIQAGMIGLIEAQQNYDGSKGASFETYAGIRIRGAMLDDMRKGDWVPRSVHKNNREINQAVAELEGVLNRDPTDSEVAAHLGMSLDQYHSALTDINCSRLVGIEDLGVSDDVISPADETDDSNPFKGVADESFRKALVESIKQLPEREALVLSLYYDEELNLKEIGDVLGVSESRVSQILSQAMQRLRTKLSAWTQND

SEQ ID NO: 21145 - protein, 114 aa, Vibrio parahaemolyticus RIMD 2210633
MNMKKIEAIIKPFKLDDVREALAEVGITGMTVSEVKGFGRQKGHTELYRGAEYMVDFLPKVKLEIVVTEDVADKCVETIIETAQTGKIGDGKIFVTDVERVVRIRTGEEDEDAI

SEQ ID NO: 21146 - protein, 401 aa, Vibrio parahaemolyticus RIMD 2210633
MQKLTILGATGSIGASTLKVVEQNPELFSVVALAAGTNVEKMVALCRQWQPKFAVMADKAAAVALQSEIHTISPNTEVLGGVDALCHVASLEEVDSVMAAIVGAAGLLPTMAAVKAGKRVLLANKEALVMSGQLFIDAVEQYGAELLPVDSEHNAIFQCLPQQVQTNLGRCNLDEHGISSILLTGSGGPFRYADIADLDSVTPAQAIAHPNWSMGPKISVDSATMMNKGLEYIEAKWLFNAARDQLKVIIHPQSVIHSMVQYRDGSVLAQMGEPDMATPIALTMSYPSRVDAGVKPLDFTQVGELTFLQPDFARYPCLKLAIDACYEGQHATTALNAANEVAVDAFLNNRLGFTDIARINELVLHKITASCKPENANSLESLLELDRMSRTIALEIIRERS

SEQ ID NO: 21147 - protein, 1128 aa, Vibrio parahaemolyticus RIMD 2210633
MFKFYKKQKFKRLQSTLMTAFLVLSITPLTITAIFFLQSHSKDLQEQSTSHLLSVRDTKQQQILDYFEAQETEVMGFVRSELAYASGGRFYGLVNAFSRLGNDIEEARENAQQRYIEGSGDQIKTSILPESSNYVGSERYRLLHKRYHWAYLELLKRSDFNDILLVDINGNVTYSINKDDNYGTNLLTGRYKDSALGKTFKRLADDVNERRKVNEDYTPVIISDFELEHGRQVAWLGAPIVQQGYLHSYAMFRLPNNGITKLIADKNRESSINTLLVGSDQQPRTINTKQDSIQNSLEVIDKALAGQTDVGTYTNGLGEEIIAAFAPIQTRGITWALVVQLPEKEAFSRIHQLEKLFVIAMLIAIILVVIASHYLSNFITSPLLKLTWAAEKVSAGDLDETTFNTERKDEIGRLAISFERMQRSIREKIQTIKQQNEELESNIKLIQKQNDELQLADKLKDEFLATTSHELRTPLHGMVGIAETLVSGANGVIPASQKYQLDIIIKSGQRLANLVDDLLDYHKMRYGSMDIQKSAVSLASATRLVLELSNHLLGNKTIRIINQVPADLKAVSADPQRLEQVLYNLIGNAIKYTSEGKIVISATIVDDHVRVQVVDTGQGIPAEHLEHIFEPLIQAGQDASRYRQGAGLGLSISRQLIELMGGSLYVSSQPMVGTTFSFTLPLASEEEIQATQTLVARGHFQIPEINLENGDDLSLPENPDGPLLYVADDEPVNLRVLESFLRLEGYRVRTVSDGPETLALVEQEKPELLLLDIMMPGMSGYQVCSELRETYDHAELPIIMLTALSQTEDRVRGFEAGANDYLSKPFNKQELAARIQAHLTASKAEMRHMENKVLESELRQRAVVEASLLETQGRLLEQLESAPEAIICLREDQRIRFANEAACKLFKRSLEQLKRSSADELIAPKYLTVKQPHYCGKIDIYIEDIRQNIEADILKLPEGSGLDVMYIFNVGGGANAARIHNLETAVEVLSSYAFDGDRDQLQKLKELGGEFTRLADKALGNKKDKQDLMREVLVDAMTHALDYWESVTGESKFAFAEQSGLWRVYLDRSTLQTRTLDKYMRIETLPKTPRWRTVLSSIEFILEHCKEQSPERAYIEAQRDKLQRLLTS

SEQ ID NO: 21148 - protein, 112 aa, Vibrio parahaemolyticus RIMD 2210633
MKIINAIIKPFKLDDVREALADVGIEGMTVSEVKGFGRQKGHTELYRGAEYQVDFLPKVKIEIATHADNVDRVVEAITKAAQTGKIGDGKIFVYDLNQAVRIRTGEMDAEAL

SEQ ID NO: 21149 - protein, 319 aa, Vibrio parahaemolyticus RIMD 2210633
MSISNTVSKVEEFEYDNASETTIDNELEKSSSTTEGKTAVREEFDASSKSLDATQLYLGEIGFSPLLTAEEEVLYARRALRGDEAARKRMIESNLRLVVKISRRYSNRGLALLDLIEEGNLGLIRAVEKFDPERGFRFSTYATWWIRQTIERALMNQTRTIRLPIHVVKELNIYLRTARELSQKLDHEPTAEEIAAQLDIPVEDVSKMLRLNERISSVDTPIGGDGEKALLDIIPDANNSDPEVSTQDDDIKSSLIHWLEELNPKQKEVLARRFGLLGYEPSTLEEVGLRLKKWDERLVLPVSVYVKFKWRVYVDFVKS

SEQ ID NO: 21150 - protein, 433 aa, Vibrio parahaemolyticus RIMD 2210633
MSKIVKVLGREIIDSRGNPTVEAEVHLEGGFVGMAAAPSGASTGSREALELRDGDKARFLGKGVLKAIEAVNGPIAEALVGKDAKDQAAIDAVMIELDGTENKSKFGANAILAVSLANAKAAAAAKGMPLYEHIAELNGTAGQFSMPLPMMNIINGGEHADNNVDIQEFMIQPVGAATLKEAVRMGAEVFHNLAKVLKSKGYNTAVGDEGGFAPNLKSNAEALEVIAEAVAAAGYELGKDVTLAMDCAASEFFDKEAGIYNMKGEGKTFTSEEFNHYLAGLVEQFPIVSIEDGLDESDWDGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 21151 - protein, 932 aa, Vibrio parahaemolyticus RIMD 2210633
MTRYGLRARVITLTLAPTLIIGLLLSGFFSFNRYQDLEKQVITTGNSIIEPLAIASESHLLAESREAVRRLISYAHRKNSKLVRSIAVFDEHHELFVTSNFHPNFEALMFPKDKPIPKLGNSEIYENSLILRVPILSEGHYLSELSNENQGTKAIGYIAVEMDLSSLRLQQYQEVFSAFLVLILGLGLASVFASRLMHDVTQPITHMKNVVDRIRRGHLDVRIEGKMHGELDQLKNGINAMAVSLSEYHVEMQHSIDQATSDLRETLEQLEIQNVELDIAKKRAQEAARVKSEFLANMSHELRTPLNGVIGFTRQMLKTQLSNSQTDYLQTIEKSANNLLNIINDILDFSKLEAGKLALENIPFDFRESLEEVINLQATSAHEKGLEITLKVDPKIPPGLVGDPLRIQQILTNLVGNSIKFTERGNIDVSVEMRSQAGDSVELQFMVRDTGIGISERQQAQLFQAFSQADASISRRYGGTGLGLVITQKLVSQMGGEISLTSRLHQGSTFWFTLRLNSTEMPMSDLIEVELLTGKQLLLVEPNMQAASVTQQILSQEGILVTYRSSLPENEEHYDYVLLNLAANQTYDEQSVAAWIEQAKRMAPSVIMGTPSTELALADQIMTEHQIQCLTKPLSRRKLLQSLINEHVEAPQAITAPVETEESERLPLTVLAVDDNPANLKLISALLKERVETVTACSNGQQAVNLATEKKYDLIFMDIQMPLMDGVTACQNIKELELNKDTPVIAVTAHAMAGERDRLLAAGMDDYLTKPIEEHVLQQVLVHWNPNTCTESIGKVAPSYVDEPESEAPATAENTQPDVIIDWQAALKQSANKEDLAKDMLRMLIDFIPEVEEVVDHALEQDDYSREELIHVIHKLHGSSSYCGVPRLKSLCATLEHALRSGASIEEIEPEMFELQDEMIKVTTTAKLYLEQ

SEQ ID NO: 21152 - protein, 477 aa, Vibrio parahaemolyticus RIMD 2210633
MQQIKNETLKEVFKQWASDDGVVVINPATEQELIRLKPSSIEELDCLIEACSAEQVRWAKLSAKERSSCLKNWHQLLMEHAEDIATIITLEQGKPLSESRGEVSYGASFVEWFAEEARRAYGEVIPAPAIDRRLSTIKQPVGVCAAITPWNFPIAMITRKAAPALAAGCGMIIKPSELTPLTALAVVELAYQAGIPKPLLPVVISEQAAEFGQVLSMDPRIKKISFTGSTRVGKILMKQASETVKAVSMELGGNAPFIVFEDADLESAADGLIASKFRNAGQTCVCTNRLYVHQNAKERFMEKVLAKMTELNVGNGLESGVTVGPVITMASKHRLEAVIDQALQEGATIANRPQKLAGRFMEPVILDNVDQGMAIVQQELFGPVLPVLTFEDDEQVLAMANDTEYGLACYFYTDSLKRIIKFTEGLEYGMVGVNEGIISTEVAPFGGIKESGVGREGAKQGLDEYLETKYICLGGLN

SEQ ID NO: 21153 - protein, 1226 aa, Vibrio parahaemolyticus RIMD 2210633
MGSKVRQQIEAQLKQRILLIDGGMGTMIQGYKLEEQDYRGERFANWHCDLKGNNDLLVLSQPQLIKEIHSAYLEAGADILETNTFNATTIAMADYEMESLSEEINFAAAKLAREVADEWTAKTPDKPRYVAGVLGPTNRTCSISPDVNDPGYRNVSFDELVEAYSESTRALIRGGADLILIETIFDTLNAKACAFAVDSVFEELGVALPVMISGTITDASGRTLSGQTTEAFYNSLRHVRPLSFGLNCALGPDELRPYVEELSRISESFVSAHPNAGLPNAFGEYDLSPEDMAEHVKEWASSGFLNLIGGCCGTTPEHIRQMAQAVEGVTPRALPDLPVACRLSGLEPLTIEKETLFINVGERTNVTGSARFKRLIKEEQYDEALEVARQQVENGAQIIDINMDEGMLDAQACMVRFLNLCASEPEISKVPIMVDSSKWEVIEAGLKCIQGKGIVNSISLKEGKEKFVEQAKLIRRYGAAVIVMAFDEVGQAETRTRKLEICTNAYRILVDEVGFPPEDIIFDPNIFAVATGIDEHNNYAVDFIEAVADIKRDLPHAMISGGVSNVSFSFRGNNYVREAIHAVFLYHCFKNGMDMGIVNAGQLEIYDNVPEKLREAVEDVVLNRRDDATERLLDIAAEYADKGVGKEEDASALEWRTWPVAKRLEHALVKGITEFIVADTEEARVNAVKPLEVIEGPLMDGMNVVGDLFGEGKMFLPQVVKSARVMKQAVAHLEPFINAEKQSGSSNGKILLATVKGDVHDIGKNIVGVVLQCNNYEIIDLGVMVPCEKILKVAIEENVDIIGLSGLITPSLDEMVHVAKEMERLNFDLPLLIGGATTSKAHTAVKIEQNYKNPVVYVNNASRAVGVCSSLLSDERRPAFIEKLDADYERVRDQHNRKKPRTKPVTLEQARANKVAIDWDAYTPPVPAKPGLHIFDDFDVATLRKYIDWTPFFMTWSLVGKYPTIFKHEEVGEEAQRLFHDANELLDRVEREGLLKARGICGLFPAASVGDDIEVYTDESRTEVAKVLRNLRQQTEKPKGFNYCLSDYIAPKESGKQDWVGAFAVTGGIGERELADEYKAQGDDYNAIMIQAVADRLAEAFAEYLHERVRKEIWGYAADENLSNDELIREKYQGIRPAPGYPACPEHTEKGPLWELLNVEENIGMSLTTSYAMYPGASVSGWYFSHPDSRYFAIAQIQDDQLESYADRKGWDRIEAEKWLGPNING

SEQ ID NO: 21154 - protein, 444 aa, Vibrio parahaemolyticus RIMD 2210633
MSVYHTLCFLSAAAMLIAFVNSKIGKMQTTIAITAGSMVLSLLILIAGQNNWFHLTEIATETVTRINFEDFLLKGILGFLLFAGGLGIKLPNLKDQKWEITVLALGATLFSTFFIGFVLYGLCMLIGIQFDLVYCLLFGALISPTDPIAVLAIVKKLDAPKRISTQIEGESLFNDGFGLVIFVTLFTIAFGSEAPTVGSVTLLFIQEAIGGIVYGFLLGLVFHYLISATDDHSMELLLTIGVPTAGYAFAEYIHVSGPLAMVVSGIMIGNWTRFIGFSKESEDHLDHFWELVDEFLNGVLFLLIGMSMLLFKFHEEDWIMMAIAVPLVLASRYLSVFISYIGFKRYRKYNPWSVKILTWGGLRGGLALAMALSIPSGIWVVQDKLIDVKEIILVMTYSVVVFSILIQGSTITPMIEKAKAEEKKMEDEKLAQSSLAEQREQTEA

SEQ ID NO: 21155 - protein, 394 aa, Vibrio parahaemolyticus RIMD 2210633
MLSNQTIEIVKATAPLIAETGPKLTAHFYDRMFTHNPELKDIFNMSNQRNGDQREALFNAICAYAANIENLPALLGAVEKIAHKHTSFLITKDQYQIVGKHLIATIDELFNPGQEVLDAWAEAYGVLANVFIQREEQIYQANASQEGGWRGLREFELVGKQLESEHICSFVFKPTDGSKVTKYKPGQYLGIYINSDKFENQEIRQYSLSSSVQENTYRISVKREQGGKVSNYLHDELNIGDKVKLAAPAGDFFMDVDTNTPVVLISAGVGLTPTLSMLESLTEHHAPVTWVHATENSKHHAFKEHVNQLVTAKENMNALIWYNQPTAEDKIGEDFHFTGFVNLHEIEAALKQDNVQVYFCGPVGFMQHVAKQLQELGVPQEQFHYECFGPHKVV

SEQ ID NO: 21156 - protein, 273 aa, Vibrio parahaemolyticus RIMD 2210633
MKHCEKQKVWNKIVSEAREMSEQEPMLASFYHATIIKHESLCAALSYILANKLNTASMPAMAVREVVEEAFAADPTITDFAACDICATVNRDPAVSMYSMPLLYLKGYHALQGYRVANWLWKQGRHALATYLQNQISVACQVDIHPAARIGSGIMLDHATGIVIGETAVIDNDVSILQDVTLGGTGKECGDRHPKIREGVMIGAGAKILGNIEVGEGAKIGSCSVVLQAVPPHTTVAGVPAKIVGRPKTDKPSLDMDQGFNGKSQSFIHGDGI

SEQ ID NO: 21157 - protein, 286 aa, Vibrio parahaemolyticus RIMD 2210633
MTKEAYPMALVTQDSLDSYIRSVNSYPMLTADEERELAERLHYKGEIEAAKGLILSHLRFVVHVARGYSGYGLPMADLVQEGNIGLMKAVKRFNPEVGVRLVSFAVHWIKAEIHEYVLRNWRIVKIATTKAQRKLFFNLRKSKKRLGWFNNGEVETVARELGVEPSEVREMESRLAAVDSTFDMPTDDDDSATSSYTAPMLYLEDKSSDVADNIEAANWEMHTNNRLGHALASLDERSQRIVRSRWLDDEKATLQDLADEFGVSAERIRQLEKNAMKKLKLAVGEF

SEQ ID NO: 21158 - protein, 417 aa, Vibrio parahaemolyticus RIMD 2210633
MDYFNYQDDGQLWAEDVPLQALAEQYGTPLYVYSRATLERHWKAFDSAVGQHPHLVCYAVKANSNLGVLNALARLGSGFDIVSGGELERVIAAGGDAKKVVFSGVGKTPAEMKRALELGIKCFNVESEPELERLNKVAGELGVIAPISLRINPDVDAKTHPYISTGLRDNKFGIAFDRAPEVYQFAQSLPNLNVQGIDCHIGSQLTSIDPFIDATDRLLALIDDLKAQGINIRHLDVGGGLGVVYRDELPPQPSDYAKALLGRLENHQDLELIFEPGRAIAANAGILLTRVEFLKHTEHKNFAIIDAAMNDLMRPALYQAWQDIVPVSPRNGEPQTYDLVGPICETGDFLGKDRALVLQEGDLLAVRSAGAYGFVMSSNYNTRTRAAEVMVDGNQSHLVRQREELTSLWQLEQILPE

SEQ ID NO: 21159 - protein, 632 aa, Vibrio parahaemolyticus RIMD 2210633
MDVKERTQRRFSIGNQLMLAVLTLSLIFTLVISAISLYRDFQEELSHLDTDLKQVESSYLSSFSASLWVEDRELLLTQALGAMRLPSVDYLRIATKDEVIIELGTEITQDVVERRWPMQFSVGEKTFELAELTVQSDLSAVYQDLWQQFFFLLTTEAIKILLLMVGVLWVAFRLLVNPLQLLSGAVSDFSGGNAPSTVTLPKRWCFDEVSLLAQKYNRSVQKVREHQAELEAERDKAEVANRKKSEFLATMSHEIRTPMNGIIGVASLLSDTKLDPQQKEFVEIIDNSSQSLMTIIDDILDFSKVEAGKVELASETYHFRQLLDDVISLHTVKAQQKNLQLLSDIDPKLPAEVQGDEGRLKQVLNNLLSNAVKFTERGHVKLLVSLHEQNNDIAQVRFRVVDSGIGIAKEHQQAVFERFQQADGSTTRKYGGTGLGLAICAQLVHIMGGDIKLTSELGLGSCFDFTIPLTVVSGLPTYTDPLNVLDFPRTEANEATNKNPDKPWVLIVEDTEVNQRVVRIMLEQLGLKVSVASHGEEAFQLCREHAFDLIFMDCQMPVMDGFIATEQIRDMNEWGAHVPIIALTANVVKEDQQRCFEAGMNEFVAKPVTKARLQQIFEQYLPKALKNIATPK

SEQ ID NO: 21160 - protein, 382 aa, Vibrio parahaemolyticus RIMD 2210633
MTLEIKPGQTHIKSKAMVAWAAGEPLKMEEVDVQLPKAGEVLVRIVATGVCHTDAFTLSGDDPEGIFPSILGHEGGGIVEMVGEGVTSVEVGDHVIPLYTAECGECKFCKSGKTNLCQAVRETQGKGLMPDGTSRFSINGETIFHYMGCSTFSEYTVLPEISLAKVNKQAPLEEVCLLGCGVTTGMGAVLNTAKVEKGDTVAIFGLGGIGLSAIIGARMAGASRIIGIDINESKFDLAKQLGATDVINPQKFDKPIQEVIVEMTDGGVDYSFECIGNVNVMRQALECCHKGWGESVIIGVAGAGQEISTRPFQLVTGRVWRGSAFGGVKGRSELPEIVNRYMAGEFGLQEFITHTMGLEDVNKAFDLMHEGKSIRTVIHMDK

SEQ ID NO: 21161 - protein, 253 aa, Vibrio parahaemolyticus RIMD 2210633
MILDSFNLEGKVAIVTGCDTGLGQGMALGLAKAGCDIVGVNISEPTETIEKVEAEGRKFVDIRANLMKLDDIPTIVDRAVTELGRIDILVNNAGIIRRNDAIEFSEQDWDDVMNINVKSVFFMSQAVAKQFIAQGEGGKIINIASMLSFQGGIRVPSYTASKSGVMGVTRLMANEWASHGINVNAIAPGYMATNNTAALRADEQRNKEIVDRIPAARWGTPEDLAGPCVFLASKAADYINGYTIAVDGGWLAR

SEQ ID NO: 21162 - protein, 299 aa, Vibrio parahaemolyticus RIMD 2210633
MLIRAIPFVFVILWASGFVGARFGLQYAEPATLLSIRMAFNVLLFLVLVAVLRRRLPTGTDFWHSCVVGALIHGFYLGGTYFAIALGMPAGLSSLLVGIQPILTAALLVAFVREEFKPSQWLGLALGFVGIAMVLMGKMEWQSEQHKVLAIGLCLLALVGITLGTLYQKKHCQQVDMVGGATVQYLAALIMFLPVAMQFETMQVQWELEFILTVLWLVVVLSCVAILLLLYMVRNGASSSVASVFYLVPPTTAIQAWLAFGESFDWMGISGFVLAATAVYLVVKKPDLTIKKAIKTEYT

SEQ ID NO: 21163 - protein, 539 aa, Vibrio parahaemolyticus RIMD 2210633
MHGFRALKSEVIMSNMTNAAPHTPIQEADYSAIHPPSLLKRLELTNPVFWLSGSFLSLFVLLALTNTESLTAMVNAGFGFATKYFGAYWQVLLLLNFLIGLALAFGRTGYVRLGGLAKPDIDTFKWLSIVLCTLLAGGGVFWAAAEPIAHFVTAPPLYGEASPKTSAINALSQSFMHWGFLAWAILGCLSSIVLMHLHYDKGLPLKPRTLLYPIFGDKAIHGWIGNLADACSIIAVAAGTIGPIGFLGLQISYALNSLFGFPDNFITQSMVIVAAIVMYTLSALSGVSKGIQLVSRYNIILSVLLIGYILFFGPTSFIIDGYVQGVGRMVDNFFPMALYRDDTGWLSWWTVFFWGWFIGYGPMMAIFIARISRGRTIRQLILSISIAAPLITCFWFSIVGGSGLAFELANPGLISSAFEGFNLPAVLLAITGELPFPMIISVLFLILTTTFIVTTGDSMTYTISVVMTGSAEPNAVIRSFWGLMMGVVAIALISMGSGGITALQSFIVITAVPVSFILLPSILKAPGIANQMAKDQGLV

SEQ ID NO: 21164 - protein, 795 aa, Vibrio parahaemolyticus RIMD 2210633
MFLEKDMQKNTLWFNGLSMDDVDKVGGKNASLGEMVSNLANVGVSVPNGFATTSYAFNQFLDHEGLDERIHQLLDELDVDDVEALRKTGATIRQWVLQAPFPADLEQEIRNNYEELIEGNTELSVAVRSSATAEDLPDASFAGQQETFLNVKGIDAVLEATKHVYASLFNDRAISYRVHQGFDHRGISLSAGIQRMVRSDKASSGVMFTLDTESGFDQVVFITSSWGLGEMVVQGAVNPDEFYVHKPMLEAGEHPIVKKTFGSKLIKMIYSNNQEIGKQVDIIDTSEEERNTFSLNEEEIKELAKQAMIIEKHYQRPMDIEWAKDGIDGKLYIVQARPETVCSQTEQNVIERYELNNKADVLVEGRAIGQRIGKGPVRLVDSLDQMSLVQEGDVLVTDMTDPDWEPVMKKASAIVTNRGGRTCHAAIIARELGIPAIVGCGDATSKLTDGATVTVSCSEGETGYVYQGDLDFEVKRSSVDELPLLPTKVMMNVGNPDRAFDFAQIPNEGVGLARLEFIINKMIGIHPKALLNFDAQSDELKAEIKQRIRGYKDPIDFYVSKLTEGIATIASAFWPKRVIVRMSDFKSNEYSNLVGGKAYEPHEENPMLGFRGASRYISPVFEDCFELETQAIKRVRNEMGLKNVEIMIPFVRTPSEAASVIDLLAKFDLRRGDQGLKVIMMCELPSNAVLADEFLKYFDGFSIGSNDMTQLTLGLDRDSGDVAHLFDERNAAVKIMLKMAIDAATKAGKYVGICGQGPSDHEDLAEWLMEQGISSVSLNPDTVIDTWLQLGKVSK

SEQ ID NO: 21165 - protein, 302 aa, Vibrio parahaemolyticus RIMD 2210633
MVYLLPFFTVMIWGGNSIVNKMAASTIEPSAMSFYRWFVAMVLLTPFCLPAVIKQRHVIRPYLTKLAFLALLGMVLNQSLGYYAGLTTTASNMALITSLVPLISVFLSVPLLGKSVSMLSIVGGVISLGGLAFMLGHGDVTYFLHQDMTQGDSLMLLAALVYAAYCVLLKRWKMPFNSLTLVYMQGFFSVIMLTPLWLSSEQLLPSQEALPLIAYAGIAASIFAPLMWVKAIDLIGADSSAMFMNLMPVVSVALASTLLGEEIHVYHIIGGLMVISGVILSQIKVRKKQDLVVSESLTTTTR

SEQ ID NO: 21166 - protein, 988 aa, Vibrio parahaemolyticus RIMD 2210633
MLLATASIGRKLLLSFIAMAMLVMLSALIGVSGFSLVAKTERNVVDAAIPAMIEARQVSELSTRIISSVQMLSNAQNEQERKEAGRVLFEQLESLLTHIKELGGESFDSKLLDALESNVQNVINNLAELGVTVERKLWLAKEIDTRVEEMRLLSEELEQLTRTQVQNTSTIAVANVTHIYDLLEANKKDQVYQALDALVEVDLDLTERLHELHLLAFKMLNQIEEARTLTNVDRIQQIQTAFENNLKIMKRRVLAVEDPTRSKQMSQLLTELGKRQVVFTILLQQYENNEQSQQLMQKTLELFSELNSTVNKLVDDSNKTTTFAVDQLTNTLKFAQWSLTVISIVGLIVVVLILWRVVYVSVVKRLAEYSAALLSVAQGNLAVELEVKGKDELAHMGQAIITARNTAQALKVVAEGEAKAKRELEEHKEHLEELIEQRTSQLRQANLRLNEEVVNHAQARNEAEQASRAKSAFLATMSHEIRTPMNGVLGTARLLMDSGLNPIQKRYAEIINRSGKTLLAILNDVLDYSKIEAGHLEIRRLGFDLHQMVEDTFQLMNSRAQEKQLLFSYHIESDVSRYWKGDVTRISQVLNNLVGNAIKFTEDGEIDIYVSLNPEDESQVLFEVSDTGIGISKKDQKTLFDAFTQAEGGLNQIGGTGLGLAISKRIVEAMGGVLEVDSEEGEGSRFWFSIPLEESEPVEIGVVASARCKVKAKVLLVEDNEVNRVVAEGFLQSMGHQVVMAEDGLQAERIIDKQDFDIALVDINLPDCDGTDLIQRLKRIERNKPGDKALSPTPMIAVSAHVFAEEVERYLAAGFDGYLPKPVEKEALATLIQDVLDGKQLLLPQSGECLPLSETSDTNLTIENQVEQDHQQREEPEMVIINPSVIQSDMKILGREKMLHIIDLFRNTSADVLGQLVESAEKNDSLAVKNLAHKLKGSAGSLGLTALMNTCQSIEIAAEPLDTYNAQQGLLDEQVATSVNALDELMAE

SEQ ID NO: 21167 - protein, 1221 aa, Vibrio parahaemolyticus RIMD 2210633
MFSILRKIIILTATVTSLAVSFNALAKENTKDSIVVGVITQNDSSNSVVDSVGPFYGINLDYLSNIAKVLGLNLELRAYQHIPPLLNDVENGVIDGAVGFSKTPEREKRFLFSKPFFSSTIAAWYRDASYKDRDIRDIKWVCVEGSVYCDNLTSQGIDNIIYVKTRLEAFDDVRRGKANALIYTYVGITEYLDANDIVKGIVDIPNWLQEEEVSFIASLDNQKLIDNIDKILEWEQSGKNIRSVASKNPYHINDKLLVAYRRNHKSNLTITYSSSDEAYPFLYRDSHTGKLDGFFPDFIDLIQSRTGLAFSYVKPTSSLSNGLTAFDADIVPVSYVGPVPKSDWLITKPFMHSNYVSIQAEESERDKSSPEKAGILLSLKKQGLVHLGVWQQDRFDRYDDLKQLLTDLKSGVLDVAYIPDDVVHSMIAQDQVDGLVINEQDVLTFSNAFAVAKHNTQLQHMLNSIIETIDSNEIEKLLRSHRSFNLVYGYDDEQMAKFFLAGAVAFSLMFAAAYFILAHLRLKVKLAELNANNEEAEKQWLMGIIQEINSLVFIHGEDNQLEMSNCANYKSKQCQECKLKSCSTNAPLVNNSDELATVIGGQRISEEVASAGCELGIKHVYRERKTIASPSGKKKFVLTVIQDITQQKEREQALIDAQKEAQTAVRARENFLATMSHELRTPLSAAHGILDLLNRQVTADSNRELIAQAMRSLNHLNVLVDEVLDYSKLEAGQLTVAPAKTDLLKTLCDVFRSFEPRALAKGLDYKVTIKPFSDAFIEIDALRLVQITTNLLSNAVKFTAEGEIGISVILHEKQLILKVADTGIGMTDGQLEGILNPFVQADDSITRKYGGTGLGLSIVDRLIDCMGGVLCIDSQFGLGTTITVKLPIERCDSEPEVRLNWTYSEALPLSIRQWCDAWKMQPATLARSMANLYAAQDNEAGFDGVMLRDDREILGSLTLRELQYPDALFNLLSQTQQETKLDELKSEEVSWILGTVLVAEDNPINQSVISMQLRELGIEPVIVNNGREAWEYINQDENVVLLLTDFHMPEMDGYELIKHVRASGFKSLPIIGVTAEDARLASERTQDIGIDDVLYKPYDLNKLKTVLVPFIGKKEKTRLPDWIKRFKTQDAKEIARVFSQSMAMDIENLQAAPTERDKKRVIHGIKGAVGAIGISMLTELCIEAERVTAAEFDRRAAELILRIEQEIDNIDYWAEMNEYTA

SEQ ID NO: 21168 - protein, 461 aa, Vibrio parahaemolyticus RIMD 2210633
MLLTREYIDKAFWQKLIAIGLPVSLQSMLFALLGVVDIFMVSLLGESATAAVGVGNRIFFFNLAVVFGLCGAVTVLASQYYGSGNMAGIRRTLAQSWCISILVTLPFIVLYAIFDEEIVSFMSDDPEYVTYARDYLVVTGFSLIATAIVVPIEAVLRSVGQTKLATNVSISAIVVNAVLNSVLIFGLFGFPQWGVFGAAVGTFVSRFFQTAVLIYFFYNRYAHLIPTKFDWAQGRLKQYRQKYFKVSLPMLVHDALWTGGLIVYSIIYGQLGVSELAIISFLSPIEGVLISTFMGFAVAASVLLGNDIGAKHYDRVEKTAWWYVLTSAILATLLFFLVWLSSPLIHHLLVLSPLTDAEMALNVCLVMALGMILRVFNMVGIGGVLKSGADIRYSIFIDTFGQWAIGIPLTYYTGMVLGLPLHFVLMSLLAEEFVKGVLTTYRIQSKRWINNMVEDDQTVTA

SEQ ID NO: 21169 - protein, 204 aa, Vibrio parahaemolyticus RIMD 2210633
MKLYETAMTPSCKRVSIFLKEIGGEVERVALNVREGDNLSESFKQKSVNGKVPLLELDDGTTICESVAICRYLDEAFENDLALFGANQLERAQVEMWHRVVEFQGLYAAFQAFRNITAIYQDRENCVAAWGEESKSRVLEFLPTLDKRLSESEYIATDQFSVVDITGYIFIGFAVNGLSIEVFEKYPNIARWFEQVSARDAFQS

SEQ ID NO: 21170 - protein, 785 aa, Vibrio parahaemolyticus RIMD 2210633
MNKFRLVNSCLFIAMLVACTFAYMAHINSKSTQQLHSALSEVGHQLIEERDVIVNQYAIKERKNFELTKSLVDIEVEAEKLADTFDNAVWFPISPNRQKIQQTLAKFEQRVIQTTSQLDMLIGVQVENQYALLMLLDIYEEEFSTHIGETQLDKHYVEFFSRDLVNQSGEQSESGANFLGRLHESDKKIELLTNELLDHNYFVFVEEAEHSLLDLAQNEARFTWLFVFVAVMLLVGSFLYQLQYRMHNLKQLNSELEAETDKAERAAKAKSSFLAAMSHELRTPMNGVLGISQLIAEETKEPVTKEHIKVILDSGQHLMTILNDILDFSKVEENKLELEKAPFHLEQVLTPVCSAIQPLIDEKSIDLIVENDVPNNTEFTGDCARLRQILFNLAGNAVKFTNEGHVLIRTELNSEDKHLLIIVSDTGIGIAPDKQGRVFNSFEQADSSTTRRFGGTGLGLAIVKKLTELMGGSITLKSVEGVGTQFIVTLPIPWNESEKPSPQHTPVQTRSTQNLRILLAEDNRVNALVAKGFCEKLGHAVDVAENGLVAVEKARDNDYDLILMDNHMPEMNGVEATRFIREKLGVKTLLFAYTADVFREAHDHFIAAGADHVLTKPLQRESFADALKQFSARLKVKQTEEVSPVSNVLQLQRKPIENLRLTEEELSNSEMLASLKEHPNELLDLLNSIITDFELAVDDLIENFMQSDFDALKLTMHTTKGMALNLGLKILASQALELETQLKMNQVPAIEQLQMLINRLQVNIHQGHRLRDELVKAQQNSEQVF

SEQ ID NO: 21171 - protein, 486 aa, Vibrio parahaemolyticus RIMD 2210633
MEMKTHYIDGAMYIGCSEEHFTTYNPANGEPLANIKQANQSDMEAAIESAKRGFEVWSAMTAIERSRILNKAVAILRERNDELAALEVADTGKPIQEAIAVDITTGADVIEYYAGLAPSLQGEQQPLNENQFFYTRREPLGICAGIGAWNYPIQIAMWKSAPALAAGNAMIFKPSEETPLTALKLAEIYSEAGLPDGVFNVVQGDYRVGQMLTAHPDIAKVSFTGESGTGKVVMGDSAKTLKQVTMELGGKSPLIVFDDAKLDDAVSAAMVANFYTQGEVCTNGTRVFVHESIYDDFVAQLKTRTEKLVVGDPLDENTQIGALISKEHESKVLSAIESAKASGATLLTGGYKVTDNGLQNGNFVAPTVFIDCDDSMSHVQQEIFGPVMSVLKFSEEAEVIERANDTDYGLAAGVFTQNLSRAHRVIHKIQAGICWVNAWGDSPAEMPVGGYKQSGIGRENGVETLKHYTQTKSVLVQLSDFESPYA

SEQ ID NO: 21172 - protein, 873 aa, Vibrio parahaemolyticus RIMD 2210633
MTLRSKTIIGIALIEALALGVLIISGLNWFKSSNETSLEVGSQNLVSVFAQASRDAVIATDLAYLDSFARSVVSEHKLAYIRIVNQDGIELTLQGDYTGVDTNVRPFDASDGVYDVAKAITLGDQTFGVVEMGVHVEHVHQMLSFATHASLVIAFVEMSLVALFSFALGSYLMKRLDLLRTGVIKVSQQGPGSQISISGNDEVTRVGEAFNQMSRSLAQAQNKLQQEHQTQQQLSAKISQLAEVAEHARDTIIITHPDGTIAWVNSAFEQLTEYSLEEVVGKSPGELLQGEDTDANTVALLSQSVRSHSPVRVEILNYTKSQRPYWVELELSPVFDENGELLRFIAVERDITDRREMEKRLSSALDKSKKATQAKSEFLANMSHEIRTPMNAIMGISEILLENENRREPRELLLLLHKSANNLVTIINDILDYSKVEAGKLTLVEEEFDLRSLVESCTALCAYQADKKNLKLLVDMPLAMNTVVVGDKGRINQILLNLIGNAVKFTDEGHVLLKVRESELGFDFSVTDTGIGIPEDRLTHIMDKFEQVDTSATRRHEGTGLGLAISKRLISMYNGELCVRSDFGNGSCFSFSLQLPKRSQPHSEPVELNANRLLLIDDYQPRVEHLMRLAKEIGIEVTHRNDWSAAQSLGRDLDDFDRIIASVNNAQDRDALYELDATESAAKRVLFLAPCVMEEGQAWSCERDRLLPQPVTQHKLQTLLSSKIQKRRALSSQDNPDFSNLHLLVAEDSHINRILIEKMLQDTGVKLTLAEDGVEAVELYKQLSPDLVITDISMPNKDGFGVTKDIRELQENGEFPWCPIVAFSAHAMQEEQQKSIALGMNDYLTKPVQKSDLLDMIAKWGRHTQMAEKHASG

SEQ ID NO: 21173 - protein, 348 aa, Vibrio parahaemolyticus RIMD 2210633
MRIEQELKLGFKDVLFRPKRSTLKSRSQVNLTRDFTFKHSGRQWSGVPVIAANMDSVGSFEMAKALAEHGVMTAVHKHYTVNDWADFVKSADNATLKNVMVSTGTSDADFQKTKDIMALSDELIFICVDIANGYSEHLVEYVERVRAEFPDKVISAGNVVTGDMCEELILAGADIVKVGIGPGSVCTTRVKTGVGYPQLSAIIECGDAAHGLGGMIIGDGGCSCAGDVSKAFGGGADFVMLGGMLAGHEESGGEIIEKDGETFMKFYGMSSQSAMDKHSGGVAKYRAAEGKTVLLPFRGSVHGTISDILGGVRSTCTYVGAAKLKELTKRTTFIRVQEQENNVFGKEK

SEQ ID NO: 21174 - protein, 246 aa, Vibrio parahaemolyticus RIMD 2210633
MKKVALITGSKGGIGSAISSQLVNDGYRVIATYFTGNYECALEWFNSKGFTKDQVRLFELDVTNTAECAEKLAQLLEEEGTIDVVVNNAGITRDGVFKKMTAQAWNDVINTNLNSLFNVTQPLFAAMCEKGGGRVINISSVNGLKGQFGQANYSAAKAGMIGFSKALAYEGARSGVTVNVIAPGYTGTPMVEQMKPEVLESITNQIPMKRLATPEEIAASVSFLVSDAGAYITGETLSVNGGLYMH

SEQ ID NO: 21175 - protein, 858 aa, Vibrio parahaemolyticus RIMD 2210633
MTITSKLKKRRSLSTLITKIIILVLAPIILGIFVQSYYFSKQIIWQEVDRTKQQTSALILNIFESHFAAIQIHHDSNSKSDVILDFYSERNEEALNYFFLSIDQSDPSHTPEFRFLTDHQGIIWDDGNAHFYGINDSMLDGLTSKVTFSNNWYYVTSITSMGARHLLLRRVPVLEPKTGEVMGYSYNAVVLDNNFALMEKLKNEGNVDNVVLVANDIPVASSLAGDESYKIFDVLKRKETQKKLDQLLIIQTPIEVNAAITNLKLLTVQDNQSVVTLQIQHFLAMLASVIGMIMIALMTKEWIENRVVEELGSLMSYTRSAREEKGFERFGGSDIEEFDHIGSTLESTFEELEAQKRSFRDLFNFALSPIMVWSEAGVLIQINPAARKELVIENDIETMHPVFKGFKDKLVPHLRMAAQGATLTGVNVPIGDKVFRWNLSPIRVDGDISGIIVQGQDITTLIEAEKQSNLARREAEKSAQARADFLAKMSHEIRTPINGILGVAQLLKDSVEAEEQKNQIDVLRHSGEHLLAVLNDILDFSKIEQGKFNIQKHPFSFADTMRTLENIYRPICENKGVELVIENQLDGNVEIFTDQVRLNQILFNLVSNAVKFTPSGCVRLHAELEQFYGADNSVLVVEISDTGIGIESDKLDEMFEPFVQEEATTTREYGGSGLGLTIVKNLVDMLDGDVQVRSQKGQGTTFVVTLPVKDRERVLAPLDSSQRVKPAELFDESLKVLLVEDNHTNAFILKAFCTKYKMQVDWAKDGLEAMEFLKDHSYDLILMDNQLPHLGGIETTKEIRQNLKLGTPIYACTADTAQETSDAFMEAGANYVLLKPIKENALHEAFVDFKQRFLIERT

SEQ ID NO: 21176 - protein, 882 aa, Vibrio parahaemolyticus RIMD 2210633
MERWMLRLSIKTRLALLALLPAVVIVAFAIHQFYANSVRVDHLNQTVSNIQGFQLISQASHFIYSMEKDRRQYGQETPLSIEVDVQNNVVLSMHHKFSTNPHTSEYADDLKEAMLGMVSGDLTNTDEVGDWAFQLLQEMSLSLLQNYQLYGNSDGHAMQNFIAYLAQLSYWTQKEAWLTYRLVMDPDAKLNQSVFFQTIDRQQQNLDAFLHLGASYAHVDKLLGLFSSPRYQRNLESRARLMNGDMPRSDYAAYLDELDFRVQRLQMMIEGFTRQAEQSLLTQVNEQKRNVLLITCGVAVVLLLLGWLGFATWYRVNSKIGAIIHALNALVNEEEKEKKVAVDGSDEFTLFAQQVNRVVEEKQRQTHEILHAKESAVAANRAKSVFLANMSHEIRTPLNGIMGMTEILSQSELSPHQQEVVDDIDTSSHTLLALLNDILDLSKIESGRLELSLVEADIREVVYQSVILFQSKATSKQLELDISLDENIPARVMVDDHRIKQIITNLVSNAVKFTEQGYILVDVSYEEALEQGRGSLTFLIKDSGIGIERDKLATIFEPFTQEDEGVSRQFGGTGLGLAICRQLVSMMGGKLVATSTKGVGTCFGFSIEVEALPLFGWHSDVVKRGLFICDNYAYAEQIVQECRLAQIELVGVNSLSEAKALDEDFDVIFLCNDGQMDIDSCLSELAEVYDVRRVVVCQHHLTSSYTNAENVHAVLTQPFLGNRFKHAIEELAKLEKNTLRDNVTNIASRAESKISRTHRRILIAEDNLMNQKIASFFLDKAGYDYLITSNGQEALDAITKGEQFDAILMDCMMPVMDGLTATKEIRRWEKKVGCKKTTIIALTASVLEEDIHNCFAAGMDAYLPKPYKSNQLFELFNELKLA

SEQ ID NO: 21177 - protein, 239 aa, Vibrio parahaemolyticus RIMD 2210633
MKSEKVAVVTGAARGIGQAICEQLLEDGFHVVGLDISPVEWSHSAQLSSYQVNLCDAAAVSEVVDSIVEQHGRIDALVNNAGITRDALLPDMLEQDWDSVIDVNLKAVFLLTQRVAPVMLEQGTGSIVSISSIVGTDGNIGQSNYGASKGGVIAMSKGWAKELSRKGAQIRVNCVAPGFITTDMTKNLPEKVIQMMESKTPLGRMGSVQDIANGVAFLVSDKSAFITGQVLKIDGGLVL

SEQ ID NO: 21178 - protein, 216 aa, Vibrio parahaemolyticus RIMD 2210633
MKYQAAIFDMDGLLLDTERVCMRIFQEACEVQNLPFYEDVYLSIIGRNAAGIETIFRKAYGENLDRLHLEWRTRYNAVVKHQAIPVKDGVVELLEWLKAQGLPIAVATSTAKEVAKIKLELAGLSKYFDNLTTGCEVSHGKPDPEIYFLAANRLDVEPSQCLAFEDSNNGVRAAVAANMVTYQIPDLVEPCDEVKQFGHAIVPSLHEVLAELKQTR

SEQ ID NO: 21179 - protein, 195 aa, Lupinus angustifolius
SQWPRLIYAVAFCLIATIVVADYHPYNAGQPYYYYQPPSYYYQSPPPPSPSPSPPPPYVYKSPPPPSPSPPPPYAYKSPPPPSPSPPPPYLYKSPPPPSPSPPPPYVNKSPPPPSSSPPPPYIYKSPPPPSPSPPPPSPSPPPPSPSPPPPSPSPPPPYVYKSPPPPSPSPPPPSPSPPPPYHPYLYSSPPPPVY

SEQ ID NO: 21180 - protein, 136 aa, Populus tomentosa
GGARGKKNGLDYLFHLYEQCRDFLIQVQSIAKERGEKCPTKVTNQVFRYAKKAGASYINKPKMRHYVHCYALHCLDEDASNALRRAFKERGENVGAWRQACYKPLVAIASRQGWDIDSIFNAHPRLAIWYVPTKLR

SEQ ID NO: 21181 - protein, 488 aa, Oryza sativa (indica cultivar-group)
LAVYVSDQVPQILIGDPGRIRQIITNLVGNSIKFTERGHIYLTVHVVEEVMSCLEVETGIQNTNTLSGYPVANRRRSWESIRLFNRELHSSEKSFAPIASDSISLVISVEDTGVGIPFEAQSRVFTPFMQVGPSIARIHGGTGIGLSISKCLVGLMKGEIGFASKPHVGSTFTFTAVLMRAHCKGNDIKSSEFKGINALVVDHRPVRAKVTKYHLQRLGVKTELTAELNQFISKLNSGSLTAKLVLIDKETWLKESHCTPLLVNKLRNNDKPDSPKLFLLGSSASSPKGGSDTSREHNLNVIMKPLRASMLQVSLRRALGGVDKVHCRNGVVGNSTLGSLLHKKQIIVVDDNIVNLKVAAGALKKYGAEVTCADSGKKAITLLKPPHNFDACFMDIQMPEMDGFEATRRIRVMERDLNERIERGEAPPECASIQRWRTPILAMTADVIQATHEECLKSEMDGYVSKPFEGEQLYSEVARFFQNHDQVE

SEQ ID NO: 21182 - protein, 497 aa, Oryza sativa (indica cultivar-group)
GKAQEKGLELAVYVSDQVPQILIGDPGRIRQIITNLVGNSIKFTERGHIYLTVHVVEEVMSCLEVETGIQNTNTLSGYPVANRRRSWESIRLFNRELHSSEKSFAPIASDSISLVISVEDTGVGIPFEAQSRVFTPFMQVGPSIARIHGGTGIGLSISKCLVGLMKGEIGFASKPHVGSTFTFTAVLMRAHCKGNDIKSSEFKGINALVVDHRPVRAKVTKYHLQRLGVKTELTAELNQFISKLNSGSLTAKLVLIDKETWLKESHCTPLLVNKLRNNDKPDSPKLFLLGSSASSPKGGSDTSREHNLNVIMKPLRASMLQVSLRRALGGVDKVHCRNGVVGNSTLGSLLHKKQIIVVDDNIVNLKVAAGALKKYGAEVTCADSGKKAITLLKPPHNFDACFMDIQMPEMDGFEATRRIRVMERDLNERIERGEAPPECASIQRWRTPILAMTADVIQATHEECLKSEMDGYVSKPFEGEQLYSEVARFFQNHDQVE

SEQ ID NO: 21183 - protein, 374 aa, Gossypium hirsutum
MLADFMPFLANVLLQVGYAGMNITSKLALESGMKPLILVAYRQIFATLAIAPFAFFLERKTRPKLTMPILFQIFLCSLTGATANQVFYFVGLQNTTATIACALNNVLPAATFLLAAICRQEAVGIKKASGQAKVIGTLACVGGAMLLSFYHGHIIGIGESSIHWNYANKMANSSPSPSGSNFFLGPFLVMASAVAWALWFIIQGQTSKSFPAPYTSTTLMCFMASIECTIIGIFSDPKPSAWSLSSSMRLIAALYAGIICNAVAFCVMSWCIQKRGPLYVSVFSPLLLVIVAILSWALLREKLYVGTVVGSLLIVGGLYAVLWGKDKEMKQMKGNEKGGEEQVVVEEGAVEVTKAGDRDHDLEMQLQQGGAACG

SEQ ID NO: 21184 - protein, 376 aa, Gossypium hirsutum
MLADFMPFLANVLLQVGYAGMNITSKLALESGMKPLILVAYRQIFATLAIAPFAFFLERKTRPKLTMPILFQIFLCSLTGATANQVFYFVGLQNTTATIACALNNVLPAATFLLAAICRQEAVGIKKASGQAKVIGTLVCVGGAMLLSFYHGHIIGIGESSIHWNYANKMANSSPSPSGSNFFLGPFLVMASAVAWALWFIIQGQTSKSFPAPYTSTTLMCFMASIECTIIGIFSDPKPSAWSLSSSMRLIAALYAGIICNAVAFCVMSWCIQKRGPLYVSVFSPLLLVIVAILSWALLREKLYVGTVVGSLLIVGGLYAVLWGKDKEMKQMKGNEKGGGGGEQVVVEEGAVEVTKAGDRDHDLEMQSQQGGGARG

SEQ ID NO: 21185 - protein, 209 aa, Arabidopsis thaliana
MENGKRDRQDMEVNTTPRKPRVLLAASGSVAAIKFGNLCHCFTEWAEVRAVVTKSSLHFLDKLSLPQEVTLYTDEDEWSSWNKIGDPVLHIELRRWADVLVIAPLSANTLGKIAGGLCDNLLTCIIRAWDYTKPLFVAPAMNTLMWNNPFTERHLLSLDELGITLIPPIKKRLASGDYGNGAMAEPSLIYSTVRLFWESQAHQQTGGTS

SEQ ID NO: 21186 - protein, 93 aa, Homo sapiens
SFREQDIYLPIANVARIMKNAIPQTGKIAKDAKECVQECVSEFISFITSEASERCHQEKRKTINGEDILFAMSTLGFDSYVEPLKLYLQKFRE

SEQ ID NO: 21187 - protein, 169 aa, Saccharomyces cerevisiae
  unsure (1)..(169): unsure at all Xaa locations
GAHXVTSNVVLVSGEGERFTVDKKIAERSLLLKNYLNDXGDDDDEDDDEIVXPVPNVRSSVLQKVIEWAEHHRDSNFPDEDDDDSRKSAPVDSWDREFLKVDQEXLYEIILAANYLNIKPLLDAGCKVVAEXIRGRSPEEIRRTFNIVNDFTPEEEAAIRRENEWAEDR

SEQ ID NO: 21188 - protein, 777 aa, Neurospora crassa
MAQAYDDEELSISLSPSQIRSRNKRSGDGASGFGPSTGNLHEYGQHGQQLHPNINAVMADAPLRDKMRTEQRIGAYNIVKTLGEGSFGKVKLAVHRMTGQQVALKIIARKKLISRDMQGRVEREIEYLQLLRHPHIIKLYTVIKTPTEIIMVLEYAGGELFDYIVQHGKMKEDEARRFFQQMLCAVEYCHRHKIVHRDLKPENLLLDDNLNVKIADFGLSNIMTDGNFLKTSCGSPNYAAPEVIGGKLYAGPEVDVWSCGVILYVLLVGRLPFDDEHIPSLFAKIARGSYMVPTWMSPGAASLIKKMLVVNPVQRATIDEIRQDPWFLKDLPAYLHPPVEEFLNTGVDPNKAIKVSDIAPNAPPQEQEKLHNEVTEKISKTMGYGKRDVEEALEADEPSAIKDAYMIVRENKLMQSNLDFATSHPPSASILHLPSGEHRLTQKKSKSLSLRPSSFWSNTNEEYQDTLLKTDEEIPGLTTEESVPSPLHDPNMSSARSIASVSTATSPRPYVSKIGILPSSLPTYHRVFMEREKAKAEGLEPPDAIPTIVEPANQPRSQAEQEETIRRLKPHSRSQLRLDEANKRPQGLTPVHPPKKNKPARWQFGIRSRNAPWEALVCIYKALNKLGAGWIVDEDYERAHRDDDDTDDYDGPSIGSRKKSSSSMDPTKTYRLPADPWHIKIRWTTDKLKKHSVASGLSEAGENTHVSRDGSDSKYQVVAMRMEIQIYEMEHGVYLVDFKVDGYETPDGKLLEDKEVTSPFPFLDMAAKLIMQLADAD

SEQ ID NO: 21189 - protein, 586 aa, Neurospora crassa
MMWSLLVSLALLCFGTVARAAVVTINWNVTWVWASPDGFGRPVIGINNQWPCPKLEANVGDTLIVNLHNGLGNQTTGIHWHGINQLQTPEMDGPSGVVQCPTPPGSSVQYKFVLDEPGTFWYHSHEKGQYPDGLRGPLIVQDPNDPYKGRYDEEIVLTVSDWYHSQSIPLVQNMLSPANTRFAPPFPDTILLNDKKDVKFNFVKGKTYRVRLINMSAFASAFLWIDSHPLTMIMSDSTYLQTETAYQLHASSAQRYDFLISAIDRDSGNYPILVALDINRDFRNQTLAPAFPHNQTAWLMMDENAPLTRPTNTIDVWRPADDTHFKPLDNLAMVPAYDHLVKLDFRFCLDANGYPRACLNGKPFISQKVPSLYTAATVGGNNTNPLVYGQINPVVVRKGDIVQLVINNQEAAGHPFHLHGHSFQILDRARPYAGDWPGRDVNYNPVPNRRDTVTVWSWSHAVLRFRADNPGVWLFHCHIEWHVEMGLTASFIEGPEQLRGKQFPADHLENCRVGGVPTRGNAAGNELDPLDTTGMLTISPTGYTGATWIPPPANTVSMTPGNSTSPLARRRAASRVQRRDTVFENS

SEQ ID NO: 21190 - protein, 922 aa, Neurospora crassa
MANSLLNMVIDGPKDGNDEESHPYPDSSSKSHGAVSAHNSDCLQAMTQHQEHDHFNDNDSHISASASTPSTQAMEEDHAWSVATRTTTQSSIDDTVTLQRHVPPTHPFAAPDMSLIFDFSPVPLLLLSSSCCITRVSKRFCQDWHVTEEDCIGKFLLPFLESQIRETGASKSRLIAEAVDDAVAARSERTSKAITVKSAFTCRARVIPIFRDAELVSIYLEWHERPSSEVLDNEQVQPGLSTDEAFRILVQATKDYAIFLLDTKGHIATWNTGAQLLKGYTREEIIGKHFSIFYGKEDLDIKKPDMELDICLREGRVEDEGWRYKKDGTRFWANVVITAVYKNGVHVGFGKVTRDLTERKASESRLIAAYEESEKLKSDFLANMSHEIRTPMHGMLSACALLLDSPLTERQRDIVNIMDESGQILLQVINDILDYSKLASGSFSVSSDVVGVASIITSVVRAVQTTLPPAVHFELFLAPNLPKSVQGDPLRYRQIVQNIVGNAAKFTDKGSIRVKASVDSEDNDSYTILTEVIDTGIGIRESASASLFTPFSQFDLTTTKRYKGTGLGLSIAKSLAELMGGRIGYRPNPERHGSVFWFTARFKKIKSLEQIQDWKHQMAAKDGSPISPIQPDVTVLQQRLASVAGTKSILLVEDNVINQKVMLGMLRSLGFRSIDLAADGAAAVKMVTGKPVGYDIVLMDINMPILDGNEASQKIRDAGVKVPIIAMTAYALKGDREKCLEYGMNDYVPKPVDRKFLIKVLATWILEKVDYRKAYDERLQQLKDCDEKLHRLSVSEGVAAARRESVDGGSKPGMALQGDEGVVKGWASPFREVDQAQASNAGVRQGTFQEPASVRIPKMLAQRTERTKVGPLPLPSGDQGAPMLSDAQQGKQELPNGGFAEGEGLNQLPPVSDGEISPRTLV

SEQ ID NO: 21191 - protein, 541 aa, Neurospora crassa
MVLGFQFSFHSPPLNPVTKKAQRVPIFNPIDRHGRVFFFSWTGFMVAFWAWYTFPPLLTHTIKHSLHLTPAQVANSNIISLLATLLVRLISGWACDRYGPRLVFAFILLLGAIPIGLAPTITNVTGLYVIRFFIGILGGSFVPCQVWTTAWFDKNVVGTANAVAGGWGNAGGGVTYFVMPAVFDSLVRNWGMSDGKAWRVTFVVPLICLLVVGLALVLVCEDMPTGRWRDRNQGVEVPVVIDGVDLKSGSGAETPMTTTTKMDEEKGSKSVSDTESTTRPDVEKGEVVSAGPSNTTTIPSVTTILLSPQTLFHILTYACSFGSELAINSVLSSYFLSVAPSSLSQTSAANYAAIFGFLNFITRPLGGLASDYLFSFFGGSSPCSSPSSSSLSPSSPEAKPKALWARKLLITTCTLLTGTFLLLLGLLRPSSLGTAIGLVILAAIFIEAGNGANFGLIPFVHPERNGVVSGVTGAGGNLGGVAFALVFRFVGGHGMKGGYEKAIWIVGIINLVVAVVGVGIKPVPVAGMGSTKKEGGRRWFW

SEQ ID NO: 21192 - protein, 502 aa, Plasmodium vivax
MKKSSKEISSSQSLKNGGSDHFFNTSLMYVLAACLASFIFGYQVSVLNTIKNFIVIEFGWCTGNKVECDDSTLKSSFLLASVFIGAVVGSGFSGYLVQHGRRFSLLVIYNFFILVSILTSITHHFHTILFSRLLSGFGIGLITVSVPMYISEMTHKDKKGAYGVLHQLFITFGIFVAVLLGMAMGEAPDAKSVDALGEFQKIWWRLMFFFPCLISILGIVLLTFFYKEETPYYLFENGKIEESKKILKKIYGTDNVDEPLKAIKDAVEQNEAAKKNSISLMRAMQIPSYRNVILLGCILSGLQQFTGINVLVSNSNELYKEFLSNKLITTLSVIMTVVNFLMTFPAIYIVEKLGRKTLLLCGCAGVICAFLPTAIANQIDSTSAFVKNLSIAATFVMIISFAVSYGPVLWIYLHEMFPSEIKDSAASLASLVNWVCAIIVVFPSDIIIKKSPTILFFIFSGMSILSFLFIFFFIKETKGGEIGTSPYITMEERQKHMGKSAV

SEQ ID NO: 21193 - protein, 366 aa, Brassica napus
MFKQESNNICNRENNRGARACDTCGSTICTVYCHADSAYLCNSCDAQVHSANRVASRHKRVRVCESCERAPAAFMCEADDVSLCTACDLEVHSANPLARRHQRVPVVPIIGNSCSSLATANHTTVTEPEKRVVLVQEDAKETASWLFPKNSDYHNNNNNQNNELLFSDDYLDLADYNSSMDYKFTSQYNQPRHKQDCIVPEKNYSGDRVVPLQLEETRGNLRNKQQNITYGSSGSQYNNNGSINHNAYNPSMETDFVPEQTAPDTTVSHPKTHKGKTAQLPEPLIQILSPMDREARVLRYREKKKRRKFEKTIRYASRKAYAERRPRINGRFAKMSETEVEDQEYNTMLMYCDTGYGIVPSFYGQK

SEQ ID NO: 21194 - protein, 255 aa, Xenopus laevis
MEEREDLVYRAKLAEQAERYDEMVESMKKVAGMDVELTVEERNLLSVAYKNVIGARRASWRIISSIEQKEENKGGEDKLKMIREYRQMVETELKSICNDILDVLDKHLIPAASSGESKVFYYKMKGDYHRYLAEFAQGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEDQNKEALQDVEDENQ

SEQ ID NO: 21195 - protein, 245 aa, Xenopus laevis
MDKNELVQKAKLAEQAERYDDMAACMKRVTEEGGELSNEERNLLSVAYKNVVGARRSSWRVVSSIEQKTEGAEKKQEMSREYREKIEAELREICNDVLNLLDKFLIANATQPESKVFYLKMKGDYYRYLAEVAAGNAKTEIVGQSQKAYQDAFDISKTEMQPTHPIRLGLALNFSVFYYEILNCPDKACALAKAAFDEAIAELDTLSEESYKDSTLIMQLLRDNLTLWTSDTQGDEAEQGEGGEN

SEQ ID NO: 21196 - protein, 643 aa, Schistosoma mansoni
MYGFTSGPPVQSIPAFLTKLKLLVDDEETNELIYWDPHGTSFHIRDGNRLAKELLPLYFKHNNLSSFIRQLNMYGFRKINRVDPSLPLKSDTEDMEFSHPYFIRNKDILLSKIQRRTSNMFSPIMGSRNQSFGVKVPYVQANSGLNGSISVSPQRPITATDFLRLAETVRHLRCNQETLSQQISVLKSENQLLYRELSDLREHHDKQSQLIQTLFTFLSAFAKEGRSASVCIGQTKRKALPSITPSGSRLQNKELKLDLRKGFQIERNSVQPLQLVQTSDLLGSHKRPKFDIRNLSAKIGNTSSGANITDQISDIGSVVHILPSNLQLTPVSLECDVNTQSLVDKNPVNVQDGPRYYLSKVDDNFTHPTNDEEFPVGLNVEEDGVTDVNNSILELNWPCSRSDTPYCLTDSPGLSDVIPSKLDGVTDESICDLLLNGDSQTEQEVGNNQPFSESTLSKYKKEPIRKQHKIQNRPRCIAPFAESDPQFVSTTLQDIDSLPWEKYQDSGFDFNLDVEQNQTENSRSSSNGLIVGNEIIPVEPANLNACDDVIQFLRSEIPGKKLKSDEPLKTVATTEAHASTQNGAIDLTSSSSAPTTWKARLSANNRLTISSSPKVKRKQVPVLIRRQSITPLSTPDFCEEELE

SEQ ID NO: 21197 - protein, 646 aa, Schistosoma mansoni
MYGFTSGPPVQSIPAFLTKLKLLVDDEETNELIYWDPHGTSFHIRDGNRLAKELLPLYFKHNNLSSFIRQLNMYGFRKINRVDPSLPLKSDTEDMEFSHPYFIRNKDILLSKIQRRTSNMFSPIMGSRNQSFGVKVPYVQANSGLNGSISVSPQRPITATDFLRLAETVRHLRCNQETLSQQISVLKSENQLLYRELSDLREHHDKQSQLIQTLFTFLSAFAKEGRSASVCIGQTKRKALPSITPSGSRLQNKELKLDLRKGFQIERNSVQPLQLVQTSDLLGSHKRPKFDIRNLSAKIGNTSSGANITDQISDIGSVVHILPSNLQLTPVSLGNDECDVNTQSLVDKNPVNVQDGPRYYLSKVDDNFTHPTNDEEFPVGLNVEEDGVTDVNNSILELNWPCSRSDTPYCLTDSPGLSDVIPSKLDGVTDESICDLLLNGDSQTEQEVGNNQPFSESTLSKYKKEPIRKQHKIQNRPRCIAPFAESDPQFVSTTLQDIDSLPWEKYQDSGFDFNLDVEQNQTENSRSSSNGLIVGNEIIPVEPANLNACDDVIQFLRSEIPGKKLKSDEPLKTVATTEAHASTQNGAIDLTSSSSAPTTWKARLSANNRLTISSSPKVKRKQVPVLIRRQSITPLSTPDFCEEELE

SEQ ID NO: 21198 - protein, 500 aa, Pseudomonas fluorescens
MNTLPSQVWRTNIGSAPSQLLNYIDGNFVTSASSFANINPVNGKLISDVFEADAKQVNEAVVAAQNALKGPWGKLSVQDRAALIHKIADGIQARFEEFVAAEVADTGRPVHQARTLDIPRAIANFRTFADLAKTSHTDLFEMSTSDGSGALNYTVRKPLGVIGVISPWNLPLLLFTWKVAPALACGNTVVAKPSEESPSSATLLAEVMHDAGVPPGVFNLIHGFGKDSAGEFLTQHPGISALTFTGESKTGSTIMKAVADGVKEVSFELGGKNAAVVFADADLDAAIEGVLRSSFTNSGQVCLCSERVYVHRSIFDEFVSGLKVEAERLVVGYPDQDGVNMGPLISHGHRDKVLSYYRLAVDEGATVVTGGGVPKFNDERDQGAYVQPTIWTGLSDKARCVTEEIFGPVCHISPFDDEDEVINRVNDSNYGLACAIWTTNLSRAHRVSRQIHVGLVWVNTWYLRDLRTPFGGVKLSGLGREGGRFSMDFYSDIANICIKI

SEQ ID NO: 21199 - protein, 352 aa, Oncorhynchus mykiss
MNVKEFLAKAKEDFLRKWECPPQSTTGLDDFDRLKTLGTGSFGRVMLVKHKGTEQFFAMKILDKQKVVKLKQIEHTLNEKRILQAVSFPFLVRLDYAFKDNSNLYMVMEYVPGGEMFSHLRRIGRFSEPHARFYAAQIVLTFEYLHSLDLIYRDLKPENLLIDHHGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRYGNLKNGVNDIKGHKWFATTDWIAIYERKVEAPFIPKCRGAGDTSNFDDYEEEEIRVSVTEKCAKRVFRVLARVNVDISGLKHT

SEQ ID NO: 21200 - protein, 251 aa, Sphingomonas sp. P2
MAVVTGGAQGIGLATARRLAVEGASVVIADRAAEAAEASAAQLQAEGSNALAVAVDLEHCEGAVELYQTVIDRFGRIDVAVHNVGGTIWAKPYWDYTPQEITAEINRSLWPTLWCCHAVLPHMRTAGRGAIVNIGSVATRGVNRVPYAAAKGGVAALTAALSLELEASGIRVNCVAPGGVNVTRVTPRNPAAPTEADRLGFSQVFEQTLRDTPMARFGEPDELAAAICFFASDDASYVTGQTLFVAGGGIG

SEQ ID NO: 21201 - protein, 700 aa, Mus musculus
GARRGWRLAPVRRGVCGPRARPLMRPLWLLFAVSFFGWTGALDGSGGTTRAMDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYTLKGEISSHELNNVQDNEMLRKVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFIAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPDNERRTTKAESAWLFRMWYNFDHNYLKPLLTHSGPPLTTTLPACCGPIARCLTSPQAYENQEQLKDDDSDLILNDGDISLTYGDSTVNTESATASAPRRFMGNSSEDALDRELTFGDHELVIRGTRLVLPMDDSEPALNSLDDTRHSPA

SEQ ID NO: 21202 - protein, 769 aa, Mus musculus
EEFHGNGVLAKYNPEGKQDILNQTIDFEGFKLFMKTFLEAELPDDFTAHLFMSFSNKFPHSSPNVKSKPALLSGGLRMNKGAITPPRSSPANTCSPEVIHLKDIVCYLSLLERGRPEDKLEFMFRLYDTDGNGFLDSSELENIIGQMMHVAEYLEWDVTELNPILHEMMEEIDYDRDGTVSLEEWIQGGMTTIPLLVLLGLENNVKDDGQHVWRLKHFNKPAYCNLCLNMLIGVGKQGLCCSFCKYTVHERCVARAPPSCIKTYVKSKKNTDVMHHYWVEGNCPTKCDKCHKTVKCYQGLTGLHCVWCQTTLHNKCASHLKPECDCGPLKDHILPPTTICPVVLTMPSAGASVPEERQSTAKKEKSSSQQPNKATDKNKMQRANSVTMDGQGLQITPVPGTHPLLVFVNPKSGGKQGERIYRKFQYLLNPRQVYSLSGNGPMPGLHFFRDVPDFRVLACGGDGTVGWILDCIEKANVVKHPPVAILPLGTGNDLARCLRWGGGYEGENLMKILKDIESSTEIMLDRWKFEVTPNDKDEKGDPVPYSIINNYFSIGVDASIAHRFHIMREKHPEKFNSRMKNKFWYFEFGTSETFSATCKKLHESVEIECDGVQIDLINISLEGIAILNIPSMHGGSNLWGESKKKRSHRRIEKKGSDKRPTLTDAKELKFASQDLSDQLLEVVGLEGAMEMGQIYTGLKSAGRRLAQCSSVVIRTSKSLPMQIDGEPWMQTPCTIKITHKNQAPMLMGPPPKTGLFCSLIKRTRNRSKE

SEQ ID NO: 21203 - protein, 478 aa, Mus musculus
LVKPHWFSIVEEASLFLIDFFICVPAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 21204 - protein, 889 aa, Mus musculus
ANIWVTGLRYLISYGKHTLDMLESSQDNMRTSWISQMFSEIDVDGLGHITLCHAVQCIRNLNPGLKTSKIELKFKELHKSKDKAGTEITKEEFIEVFHELCTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKILGDKLYTTSPNMEESYLPSPDVLKGKILIKAKKLSSNCSGVEGDVTDEDEGAEMSQRMGKENVEQPNHVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNVGWFRQNGNCGYVLRPAIMREEVSFFSANTKDSVPGVSPQLLHIKIISGQNFPKPKGSGAKGDVVDPYVYVEIHGIPADCAEQRTKTVNQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNNPLVVLNLSEPYPTMELQAIVPEVLKKIVTTYDMMMQSLKALIENADAVYEKIVHCQKAAMEFHEHLHSIGTKEGLKERKLQKAVESFTWNITILKGQADLLKYAKNETLENLKQIHFAAVSCGLNKPGTENSEAQKPRRSLEAIPEKASDENGD

SEQ ID NO: 21205 - protein, 408 aa, Mus musculus
PLDAPKIWQYCMSSHFLVFVYITFQHISHGDGRQEVTSRTGRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARAKFRQIVSAVQYCHQKRIVHRDLKAENLLLDADMNIKIADFGFSNEFTVGSKLDTFCGSPPYAAPELFQGKKYDGPEVDVWSLGVILYTLVSGSLPFDGQNLKELRERVLRGKYRIPFYMSTDCENLLKRFLVLNPVKRGTLEQIMKDRWINAGHEEDELKPFVEPELDISDQKRIDIMVGMGYSQEEIQESLSKMKYDEITATYLLLGRKSAEVRVFTEGQWTEPVSTIVLALTKWKQNQLSC

SEQ ID NO: 21206 - protein, 512 aa, Arabidopsis thaliana
KQMNMENVSASKSVSNWSGTCYATPLIGAFIADAYLGRYWTIASFVVIYIAGMTLLTISASVPGLTPTCSGETCHATAGQTAITFIALYLIALGTGGIKPCVSSFGADQFDDTDEKEKESKSSFFNWFYFVINVGAMIASSVLVWIQMNVGWGWGLGVPTVAMAIAVVFFFAGSNFYRLQKPGGSPLTRMLQVIVASCRKSKVKIPEDESLLYENQDAESSIIGSRKLEHTKILTFFDKAAVEAESDNKGAAKSSSWKLCTVTQVEELKALIRLLPIWATGIVFASVYSQMGTVFVLQGNTLDQHMGPNFKIPSASLSLFDTLSVLFWAPVYDKLIVPFARKYTGHERGFTQLQRIGIGLVISIFSMVSAGILEVARLNYVQTHNLYNEETIPMTIFWQVPQYFLVGCAEVFTFIGQLEFFYDQAPDAMRSLCSALSLTAIAFGNYLSTFLVTLVTKVTRSGGRPGWIAKNLNNGHLDYFFWLLAGLSFLNFLVYLWIAKWYTYKKTTGHAL

SEQ ID NO: 21207 - protein, 393 aa, Zea mays
DPNDAFSAAHPFRWDLGPPAPAAPAPPPPPPPAPQLLPHAPLLSAPRELEDLVAGYGVRPSTVARISELGFTASTLLGMTERELDDMMAALAGLFRWDVLLGERFGLRAALRAERGRVMSLGGRFHTGSTLDAASQEVLSDERDAAASGGLAEGEAGRRMVTTGKKKGKKGVGARKGKKARRKKELRPLDVLDDENDGDEDGGGGGSDSTESSAGGSGGGERQREHPFVVTEPGEVARAKKNGLDYLFHLYEQCRVFLLQVQSLAKLGGHKSPTKVTNQVFRYAKKCGASYINKPKMRHYVHCYALHCLDEDASNALRRAYKARGENVGAWRQACYAPLVEIAARHGFDIDAVFAAHPRLTIWYVPTRLRQLCHQARGSHAHAAAGLPPPPMF

SEQ ID NO: 21208 - protein, 391 aa, Zea mays
MDPNDAFSAAHPFRWDLGPPAHAAPAPAPPPPPLAPLLLPPHAPRELEDLVAGYGVRPSTVARISELGFTASTLLGMTERELDDMMAALAGLFRWDVLLGERFGLRAALRAERGRVMSLGARCFHAGSTLDAASQEALSDERDAAASGGGMAEGEAGRRMVTTTAGKKGKKGVVGTRKGKKARRKKELRPLNVLDDENDGDEYGGGSESTESSAGGSGERQREHPFVVTEPGEVARAKKNGLDYLFHLYEQCRVFLLQVQSIAKLGGHKSPTKVTNQVFRYANKCGASYINKPKMRHYVHCYALHCLDEEASNALRRAYKSRGENVGAWRQACYAPLVEIAARHGFDIDAVFAAHPRLAVWYVPTRLRQLCHQARGSHAHAAAGLPPPPMF

SEQ ID NO: 21209 - protein, 390 aa, Zea mays
DPNDAFSAAHPFRWDLGPPAHAAPAPAPPPPPLAPLLLPPHAPRELEDLVAGYGVRPSTVARISELGFTASTLLGMTERELDDMMAALAGLFRWDVLLGERFGLRAALRAERGRVMSLGARCFHAGSTLDAASQEALSDERDAAASGGGMAEGEAGRRMVTTTAGKKGKKGVVGTRKGKKARRKKELRPLNVLDDENDGDEYGGGSESTESSAGGSGERQREHPFVVTEPGEVARAKKNGLDYLFHLYEQCRVFLLQVQSIAKLGGHKSPTKVTNQVFRYANKCGASYINKPKMRHYVHCYALHCLDEEASNALRRAYKSRGENVGAWRQACYAPLVEIAARHGFDIDAVFAAHPRLAVWYVPTRLRQLCHQARGSHAHAAAGLPPPPMF

SEQ ID NO: 21210 - protein, 441 aa, Cryptococcus neoformans var. neoformans
MDNTPRHLFQTPNNVYILQQPWQFVKELGQGAYGCVSSARNSSTGETCAVKKVTNVFQKKILTKRCLRELRLLHHFRGHKNITCLYDMDIVFDPPGSGQFREVYLYEELMEADLHAIIRSGQPLSDAHFQSFLYQTLCGLKYIHSANVLHRDLKPGNLLVNADCELKICDFGLARGFQPGAVQTDQGQAGFMTEYVATRWYRAPEIMLSFANYTSSIDMWSVGCILAELLGGKPIFKGEDYVDQLNKILNLLGTPTEDTLRRVGSPRAQDYIRSLPIKPRVKFGTLYPNASPLALDLLSKLLTFDPAKRYGCEEALEHPYLAVWHDPADEPLCEVPFDFSFEEEDSVSGMRDLILEEVRSFRYLVRQQTMPPVRKDSHELPPAPPAPQHPGAGVGPAFHEKRTAKAIWRNILGLHWRNSWRGRNYHRIIFVESVTVIGKHR

SEQ ID NO: 21211 - protein, 314 aa, Toxoplasma gondii
MAGPKGKSDKRKTYFSRLFALLEKYPRVLVVEADHVGSKQMADIRLALRGKAVVLMGKNTMIRTALKQKMSEMPQLEKLLPLVRLNVGFIFCIEDPAEVRRIVAENKVPAPARQGVFAPIDVFIPAGPTGMDPGSTSFFQALGIATKIVKGQIEIQNEVHLIKEGDKVTASAATLLQKLNIKPFEYGLAIQHVYDDGSVYKASVLDITDEVILEKFRAGTMNVAALSREVGFPTTASAPHSILEAFKFCTSLVLESDYSFPQMQRIKDILENPEAFAAVAAAAAPAAGAAAAAEAPKEEEPEEEEDDMGFSLFD

SEQ ID NO: 21212 - protein, 1221 aa, Vibrio parahaemolyticus
MFSILRKIIILTATVTSLAVSFNALAKENTKDSIVVGVITQNDSSNSVVDSVGPFYGINLDYLSNIAKVLGLNLELRAYQHIPPLLNDVENGVIDGAVGFSKTPEREKRFLFSKPFFSSTIAAWYRDASYKDRDIRDIKWVCVEGSVYCDNLTSQGIDNIIYVKTRLEAFDDVRRGKANALIYTYVGITEYLDANDIVKGIVDIPNWLQEEEVSFIASLDNQKLIDNIDKILEWEQSGKNIRSVASKNPYHINDKLLVAYRRNHKSNLTITYSSSDEAYPFLYRDSHTGKLDGFFPDFIDLIQSRTGLAFSYVKPTSSLSNGLTAFDADIVPVSYVGPVPKSDWLITKPFMHSNYVSIQAEESERDKSLPEKAGILLSLKKQGLVHLGVWQQDRFDRYDDLKQLLADLKSGVLDVAYIPDDVVHSMIAQDQVDGLVINEQDVLTFSNAFAVAKHNTQLQHMLNSIIETIDSNEIEKLLRSHRSFNLVYGYDDEQMAKFFLAGAVAFSLMFAAAYFILAHLRLKVKLAELNANNEEAEKQWLMGIIQEINSLVFIHGEDNQLEMSNCANYKSKQCQECKLKSCSTNAPLVNNSDELATVIGGQRISEEVASAGCELGIKHVYRERKTIASPSGKKKFVLTVIQDITQQKEREQALIDAQKEAQTAVRARENFLATMSHELRTPLSAAHGILDLLNRQVTADSNRELIAQAMRSLNHLNVLVDEVLDYSKLEAGQLTVAPAKTDLLKTLCDVFRSFEPRALAKGLDYKVTIKPFSDAFIEIDALRLVQITTNLLSNAVKFTAEGEIGISVILHEKQLILKVADTGIGMTDGQLEGILNPFVQADDSITRKYGGTGLGLSIVDRLIDCMGGVLCIDSQFGLGTTITVKLPIERCDSEPEVCLNWTYSEALPLSIRQWCDAWKMQPATLARSMANLYAAQDNEAGFDGVMLRDDREILGSLTLRELQYPDALFNLLSQTQQETKLDELKSEEVSWILGTVLVAEDNPINQSVISMQLRELGIEPVIVNNGREAWEYINQDENVVLLLTDFHMPEMDGYELIKHVRASGFKSLPIIGVTAEDARLANERTQDIGIDDVLYKPYDLNKLKTVLAPFIGKKEKTRLPDWIKRFKTQDAKEIARVFSQSMAMDIENLQAAPTERDKKRVIHGIKGAVGAIGISMLTELCIEAERVTAAEFDRRAAELILRIEQEIDNIDYWAEMNEYTA

SEQ ID NO: 21213 - protein, 350 aa, Vibrio parahaemolyticus
MKTKILHIINDLSQNGGAQKFLVDLVLEHNPEYEIKILVLCAENDYLEQLSARGIQCFNWQTLSLSEKWSLLRWPDLVHGHLYPSIYLALLAIGKKRIQTEHCSYNRRRDYPLFKFIEYVLYWGHHYTVSISEKVQEELVKFMPRYQHKYRVVHNGVDLNRFPMTAKQAHDLSEKATINIGMVGRLHEHKDHETLIHAIAKLPECYHLHLAGDGDRKASLQRLAQSLNVSPRVHFHGVVSDIPLFLSDMDIYVQSSHVEGFGLAAVEAMAAGLPVLASDVPGLNEVTGSSEYLFEVGDSNRLAQKVAELCEDAALYNSASHYSVNRAKLYTIDKFREGYYGIYQQLCTDK

SEQ ID NO: 21214 - protein, 801 aa, Arabidopsis thaliana
MVGFPANQAKTVEEELPLQVVADQDPEVKTFKDSFDFPSIDSFPDFDSITWSESNRNVEDFSIEDTDFDFFEYHMEIPQEDVVTVSDVMCPENQTTVNSESIEGKLEVFNDDMSGEVGVSSVRSESMVEVKPVLCDVMSEEVGVSSVEVEPNVCVEMSANGGDEPAVKDSEPVVSENSRSMEGETEPVVVSDASVACPTMDLDESGLKKTDEGLACSIEVGLEKVSLAVDDDEKSDEAKGEMDSAESESETSSSSASSSDSSSSEEEESDEDESDKEENKKEEKFEHMVVGKEDDLAGELEEGEIENLDEENGDDDIEDEDDDDDDDDDDDDDVNEMVAWSNDEDDDLGLQTKEPIRSKNELKELPPVPPVDVTLEPHHATLPVGVVLSVMSAQVIVEGMEKHSPLTEGSILWITEKRTPLGLVDEIFGPVKCPYYIVRFNSESEVPEGVCQGTPVSFVADFAQHILNIKELQKKGYDASGDNDEEIPDELEFSDDEKEAEYRRMQKLEKRGMMSDQKTGNTRNKKKKNRDPGRPTSSYSGEWTKNQGSSSLSSNRSDPQMGGPRPQMDGFPPNNAAWRPQSNQQNPYQLPPIPNQMGMQIPFMAMQNQNQMMFQPQFNGGQMPMPGGPGGLNFFPGQASAPWPAMVGQNCFNQQFGMGRGIQQQPLPNELSFNMFSQGLQMHPPQSQMHRPQSQMNPQFQMPPQFQPHQQSPMNPQYQMMHRPQSPANPQFQMQAQSDVRPLQSQIPQSPSDLQSPMEPQSQGFSSGQSSERGRGFHGRGRGRGRGRFGRGRGRGRQQSG

SEQ ID NO: 21215 - protein, 430 aa, Escherichia coli
  unsure (1)..(430): unsure at all Xaa locations
MKARQQKYCDKIANFWCHPTGKIIMSLAGKKIVLGVSGGIAAYKTPELVRRLRDRGADVRVAMTEAAKAFITPLSLQAVSGYPVSDSLLDPAAEAAMGHIELGKWADLVILAPATADLIARVAAGMANDLVSTICLATPAPVAVLPAMNQQMYRAAATQHNLEVLASRGLLIWGPDSGSQACGDIGPGRXXDPLTIVDMAVAHFSPVNDLKHLNIMITAGPTREPLDPVRYISNHSSGKMGFAIAAAAARRGANVTLVSGPVSLPTPPFVKRVDVMTALEMEAAVNASVQQQNIFIGCAAVADYRAATVAPEKIKKQATQGDELTIKMVKNPDIVAGVAALKDHRPYVVGFAAETNNVEEYARQKRIRKNLDLICANDVSQPTQGFNSDNNALHLFWQDGDKVLPLERKELLGQLLLDEIVTRYDEKNRR

SEQ ID NO: 21216 - protein, 1377 aa, Candida albicans
MRRLKIGIRPQLIIIVCFASLFSLLILGIVTGIYFSANLKNLRLERLLVISQLKRTQVQQAIQYIAYQVMTVSEVDSLTVPLSNYRAGNNSKAVFSEAQNYLQQYVLTTDSFTAARLYDLDLQVVASSFDNMTLISESAQDVVYPLQPNRSMPPVLGTPSGLYFTGPIANNSDNFNSRYFMGITVPVLSNSSIILSQPSISGYLTIVAAAESIRSALNSTSEDDYQAMAVQPVYGDPQKGIDNLSQNAYNGDNEVIGFKLVFPVENSLLEAGTIYNINSSSSMKTALASNSGTATGVKSFFGKKVAIGFSRISVQDNLNWSIVIVQSNSVFNGPANKLRKITIGVVIGIGAFMCFVTFPLAVWFIRPITKLKEATEAITKYKKEKLNSVNSNSPTSGSGSGSGSGSGSGSGSRANSDSSADQSLSLDTGKRNSINSSSFSSSYSTGIRLPARIPRSKKIFKDELTELSEAFNIMTEELDKQYTHLEDRVKLRTKELEASKIQAEAANEAKTVFIANISHELRTPLNGILGMTSIAMEEEDPNVIHDSLKLIHRSGELLLHILTELLTYSKNTLNRSKLEKSNFQILEIVYQVRSIFNKLAHDQRVNFKILVKPNIFRKLIIYGDSNRIIQIVMNLVSNSLKFTPVDGSVSVSFKLLGEYDHERSKKLDYKKVCILNDSSSSTVAVPPPTPPSDTKPNPKPKSTPTPKPDPTRSHLVDHNNRSANTTSPLTPVRKPTNQTKNKSITNNVTKQNMKIRKKKKTNKNLHNNNNNNKNDNSDFLMNRRLSGSHKFNNTNDEELSPTAIEKNIDKYLTSSADSDNISVTTLSTVQYETTIFESQFKSKPLPALPVDAKPQVSGKIDENDVNDEDPSGGSIKDDDSEDTINEKQGISSSPSSSSSSNEKQENSPRSNDSTTVTVTRPRHNMMPSAQDFKSYPTFDKKPEYDSNMSNNEIVKNNRVYRIRNMYQPKVWVIQIEVTDTGPGIEPALQEKVFEPFVQGDQTLSRSYGGTGLGLSICRQLATMMHGTLTLKSTIGKGSTFTLTLPLPQTGEIMVPPEDMAEFCEDEFNPAAKINRKVAFEDGDIDTESQQQENPSSEEDTQGDRNVQSSTSSSPPNSSSTDSALPASDSSDIGGTNKSKTTSHGNNKDINAKKRIITNSSASSTKGTKRPTNNDGGGGVNGNHSDDNKDLTLTIDKPSLFTRGSTGTANSGTTSSHSDKKILYPTPTTTTTTTTTTDHTTVLDDISHLRVLVAEDNSVNQEVISRMLKQEGITNLTMACNGAKAIDFVKESIENNENFDLIFMDVQMPEVDGLKATKMIRKNLQYNKPIIALTAFADESNVKECLNSGMSGFITKPISKTNIKKVLVEFLSNEVVTS

SEQ ID NO: 21217 - protein, 414 aa, Petunia x hybrida
MASTSKDTTTASTSTMDTRPENSEVDELPKELHEMKIKDERTDSHEDNLKDMEPAVVSGNGAETGQIIVTTVSGRNGQQKQTLSYMAERVVGTGSFGVVFQAKCLETGESVAIKKVLQDRRYKNRELQIMRTLDHPNVVKLRHCFYSTTEKNEVYLNLVLEYVSETVYRVSRHYSRMNQHMPIIYVQLYTYQICRALNYMHSVLHVCHRDIKPQNLLVNPHTHQLKLCDFGSAKMLVPGEPNISYICSRYYRAPELIFGATEYTTAIDMWSAGCVMAELLLGQPLFPGESGVDQLVEIIKILGTPTREEIRCMNPNYTEFKFPEIKAHPWHKIFQKKMPPEAVDLVSRLLQYSPTLRCTALEACAHPFFDALREPNACLPNGRPLPHLFNFTAQELSGAPADLRKRLMPEHMRK

SEQ ID NO: 21218 - protein, 189 aa, Gossypium hirsutum
NTTAAIGKGFAIGSAALVSLALFGAFVSRAAITTVDVLTPKVFIGLIVGAMLPYWFSAMTMKSVGSAALKMVEEVRRQFNTIPGLMEGTAKPDYATCVKISTDASIKEMIPPGALVMLTPFIVGIFFGVETLSGVLAGSLVSGVQVAISASNTGGAWDNAKKYIEAGASEHAKTLGPKGSDPHKAAVIG

SEQ ID NO: 21219 - protein, 819 aa, Paramecium tetraurelia
MGCGSSQPAAEPDKKSKSLKSASTSEIEDLIGKKIPKLLIQAEMKHRFTADEEAIKSDLISLQPPQENDNVVARAQKKMQKKYRGGEDVEGQIIENVKRVEREMQQSDVDLIIKSFKSHFVFFSLPQDSLQKLIENMFYCTIKAGEFVFKQGNQASAYFVIERGQVEIIINENPIRVLKQGDQFGEIALLYNATRSASTKALTNCGFWSLERATFKKTIEEITLKEYDENRKFIDQVQFFSFMTSEQRDMIGNALITTKFNPGQNIVNEGDQADSFYVIKSGQVQILKGDKLIRKMGAKDSFGEQALYEKSVRGATVKAETEVRCVALGRENLTKILGDKIQLIIFNNIMRWSFEKSEILKQLTKIQLEKISQKAKIENFKKGQVIFEAKKPCDKLVVVLEGVLINSKQESVTKGSCFGDQFLQKERYGSPLECAFTMVGDGVLATITFQALFKIFGGDLETALKKNENSHEKKIQQIGKREDASHIVLEDLIYIKKLGEGQFGIVYLVKHKETKKVFALKSVSKASIIEQNLEKHITQEKTVLEQINFPFIMGFVRTFKDDMSIYFLVDFIRGMELFDVIRDIGLLQKPETQFYIGTMILCIEYLHSKSIVYRDLKPENIMVNAQGFMYLIDLGTAKPLLKTKACRTYTIIGTPHYMAPEIIAGKGYTFSVDLWSIGICMYEFMCGGVPFGEELEDPYQIYEEIMNTQIKYPTFLKDRHAKKFMEQLMNRQPETRLGASYSALKAHQWFDDFDFDKLFSRELKPPYLPKPENMVSEQDIQKRFNQNKLVLQEIKNEQDSHKIKYNKHLAKDPNWDKDF

SEQ ID NO: 21220 - protein, 537 aa, Gossypium hirsutum
MKRDHQEISGSGSNPAESSSIKGKLWEEDPDAGGMDDELLAVLGYKVRSSDMADVAQKLEMLEKVMGTAQEDGISQLGDTVHFNPSDLSGWVQNLLIEFNGSTTTPDPNFNDDSEYDLRAIPGVAAYPPVKSDPGLEITRKRAKTESSSSSSSTTTRPVVLIDSQEAGVRLVHTLMACAEAVQQDNLKLADALVKHIGLLASSQTGAMRKVATYFAEALARRIYRIFPPDSLDPSYNDKLQIPFYETCPYLKFAHFTANQAILEAFSMASRVHVIDFGLKQGMQWPALMQALALRPGGPPAFRLTGIGPPQPDNTDALQQVGWKLAQLAERIGIEFEFRGFVANSLADLEPEMLDIRPPEIEVVAVNAVFELHPLLARPGGIEKVVSSIKAMKPKIVTVVEQEANHNGPVFLDRFTEALHYYSTLFDSLEGSGVAPASQDLAMSELYLGRQICNVVACEGMDRVERHEPLTQWRTRMETAGVSPVHLGSNAYKQASMLLALFASGDGYRVEENNGCLMLGWHTRPLIAHLGLATRWY

SEQ ID NO: 21221 - protein, 506 aa, Ammi majus
MMDFVLLEKALLGLFIATIVAITISKLRGKKLKLPPGPIPVPVFGNWLQVGDDLNQRNLVEYAKKFGDLFLLRMGQRNLVVVSSPDLAKDVLHTQGVEFGSRTRNVVFDIFTGKGQDMVFTVYSEHWRKMRRIMTVPFFTNKVVQQYRFGWEDEAARVVEDVKANPEAATNGIVLRNRLQLLMYNNMYRIMFDRRFESVDDPLFLKLKALNGERSRLAQSFEYNFGDFIPILRPFLRGYLKLCQEIKDKRLKLFKDYFVDERKKLESIKSVGNNSLKCAIDHIIEAQEKGEINEDNVLYIVENINVAAIETTLWSIEWGIAELVNNPEIQKKLRHELDTVLGAGVQICEPDVQKLPYLQAVIKETLRYRMAIPLLVPHMNLHEAKLAGYDIPAESKILVNAWWLANNPAHWNKPDEFRPERFLEEESKVEANGNDFKYIPFGVGRRSCPGIILALPILGIVIGRLVQNFELLPPPGQSKIDTAEKGGQFSLQILKHSTIVCKPRSS

SEQ ID NO: 21222 - protein, 335 aa, Allium cepa
MEVERVQAIATLTANLGTIPPEFIRSDHERPDLTTYHGPVPELPVIDLANSSQENVVKQISEAAREYGIFQLVNHGIPNEVINELQRVGKEFFQPPQEEKEVYATVPDSGSFEGYGTKLQKDLEGKKAWVDYLFHNVWPEHKINYKFWPRNPPAYRKANEEYTKHLQVVVDKMHSYLSLGLGLESHVLKEAVGGDDLEYLLKINYYPPCPRPNLALGVVAHTDMSSLTILVPNEVPGLQVFKDDHWFDAKYIPNALICHIGDQLEILSNGKYKSVLHRTTVNKEKSRMSWPVFCSPPGDTMIGPLPQLVNDENPPKFKTKKYKDYAYCKINKLPQ

SEQ ID NO: 21223 - protein, 352 aa, Allium cepa
MPIESVIIAPPAPRVETLSKSNLHSIPLEYIRPEHERACLGDALEQLHNSNSGPQIPITDLDSRDCIEKVTKAAKEWGVMHIVNHGISSELMEKVRAAGKAFFNLPLEAKEEYANDQSKGKIQGYGSKLANNASGQLEWEDYFFHLIFPDDKVDLSVWPKQPSDYIEIMQEFGSQLRILASKMLSILSLGLQLPTKDRLEQELKGPEDLLLQLKINYYPKCPQPHLALGVEAHTDVSALSFILHNNVPGLQVLYEGEWVTAKLVPDSLIVHVGDSLEILSNGIYKSVLHRGLVNKEKVRISWAVFCEPPKDAVVLKPLDEVVTDDAPARYTPRTFAQHLERKLFKKKGWRFG

SEQ ID NO: 21224 - protein, 434 aa, Oryza sativa (japonica cultivar-group)
MLLDLNVESPERSGTSSSSVLNSGDAGGGGGGGGGGGLFRFDLLASSPDDDECSGEQHQLPAASGIVTRQLLPPPPPAAPSPAPAWQPPRRAAEDAALAQRPVVAKKTRRGPRSRSSQYRGVTFYRRTGRWESHIWDCGKQVYLGGFDTAHAAARAYDRAAIKFRGLEADINFNLSDYEDDLKQMRNWTKEEFVHILRRQSTGFARGSSKFRGVTLHKCGRWEARMGQLLGKKYIYLGLFDTEVEAARAYDRAAIRFNGREAVTNFEPASYNVDALPDAGNEAIVDGDLDLDLRISQPNARDSKSDVATTGLQLTCDSPESSNITVHQPMGSSPQWTVHHQSTPLPPQHQRLYPSHCLGFLPNLQERPMDRRPELGPMPFPTQAWQMQAPSHLPLLHAAASSGFSAGAGAGVAAATRRQPPFPADHPFYFPPTA

SEQ ID NO: 21225 - protein, 186 aa, Oryza sativa (japonica cultivar-group)
MKRLTFGAEPEMVDSASIAQEVMLLLARSGGGGAGYVVGHGGEAPRVFECKTCRRRFPSFQALGGHRASHKRPRGGGGGGAAAAVAAAAGEGEAGVALSLAAGTPAVKASRAHGCAVCGVEFALGQALGGHMRRHRIAGAEADEAVSARGGEPAPERNPREARGVVGLDLNAAPADDTGLLLVDCL

SEQ ID NO: 21226 - protein, 574 aa, Homo sapiens
MRRLSSWRKLATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRKSDVPGVVKTGSTKELDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRATIKDIREHEWFKQDLPKYLFPEDPSYSSTMIDDEALKEVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTYSKMSLQLYQVDSRTYLLDFRSIDDEITEAKSGTATPQRSGSVSNYRSCQRSDSDAEAQGKSSEVSLTSSVTSLDSSPVDLTPRPGSHTIEFFEMCANLIKILAQ

SEQ ID NO: 21227 - protein, 297 aa, Danio rerio
MGFVKVVKNKSYFRRYQVKFRRRREGKTDYFARKRLVIQDKNKYNTPKYRMIIRFSNRDIVCQIAYAKIEGDAIVCAAYSHELPKYGIACGLTNYAAAYCTGLLCARRLLNKFGLDKVYEGQVEVTGDEFNVESIDGQPGAFSCYLDAGLTRTTTGNKVFGALKGAVDGGLSIPHSTKRFPGYDSESKEFNAEVHRKHILGLNVSEYMSLLMEEDEELYKKQFSRFIKNGVTPESIEEMYKKAHASIRENPVHERKPKREVKKKRWNRAKLTLAQRKDRVAQKKASFLRAQEAAADD

SEQ ID NO: 21228 - protein, 517 aa, Xenopus laevis
MATPQTCTRFTDEYQLYEELGKGAFSVVRRCVKKSSSQEYAAKIINTKKLSARDHQKLEREARICRLLKHPNIVRLHDSISEEGFHYLLFDLVTGGELFEDIVAREYYSEADASHCIHQILESVNHIHQHDIVHRDLKPENLLLASKCKGAAVKLADFGLAIEVQGDQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKTDGVKPQTNNKNSIVSPAKENPPLQASMEPQTTVVHNATDGIKGSTESCNTTTEDEDLKVRKQEIIKITEQLIEAINNGDFEAYTKICDPGLTSFEPEALGNLVEGMDFHKFYFDNLLSKHTKPIHTTILNPHVHVIGEDAACIAYIRLTQYIDAQGRPRTTQSEETRVWYRRDGKWLNVHYHCSGAPAAPLQ

SEQ ID NO: 21229 - protein, 127 aa, Danio rerio
MAMVGLRASYHRILDRMEHMLPAKLRPFYNHPAGPKTVFFWAPMFKWGLVLAGLADMARPAEKLSTSQSAVLTATGLIWSRYSLVIIPKNWNLFAVNFFVGSPGGSQLYRIWMHNREQKAKEKEAQA

SEQ ID NO: 21230 - protein, 584 aa, Oryza sativa (japonica cultivar-group)
MEPKNAIALDEHVLDSTIRKRKRVGATQCAEANDAPNLSQNGPKQNLALFPDSTGHKKSKMMCSADDILERYNNFKISGMPVRVMSHQHGGWRDFPEDVVNSVQQSFQLKRPITSAVFQNRHILLDFMQMVCLDSVMAISKPIAWIDDHGKCFSPDSCAGVIPSEPLQHGKNEFLKSFHDLSSSYEAHEHDGMSAAESSSSASFDAVLSDVQEVNNVVEDKQKVLNESGEVSGENKKGHLSHMNETADGAMQAPRNNQSVQRADSAVRNLLFQGSGHLFTEKDIIGIYRTPMLDQLGRSRYSLFQKEVQVTKNQRGNANERYAWLACTKGTMEEMMMNGALEIAKPLQGPMYGVGAHLAPANSSNICVGLSDIDENGIIRMMLCRVIMGNVEVVFPGSNQCQPTSESFDSGVDDLQRPKHYIIWDANVHKHIYAEYAVIIKVPYMNNGDTASNISEIRNSGALDNPTKDDSLQTIASSGDEQQACMLGRAPSPRSPSSPWMPFSMLFAAISAKVPRSDMDLVHKYYEEFKRRKISRPDLVKQLRQIVGDKLLVSTVVRLQQKLPPMAATEQAPRAPGRGGGASP

SEQ ID NO: 21231 - protein, 481 aa, Oryza sativa (japonica cultivar-group)
MEPKNAIALDEHVLDSTIRKRKRVGATQCAEANDAPNLSQNGPKQNLALFPDSTGHKKSKMMCSADDILERYNNFKISGMPVRVMSHQHGGWRDFPEDVVNSVQQSFQLKRPITSAVFQNRHILLDFMQMVCLDSVMAISKPIAWIDDHGKCFSPDSCAGVIPSEPLQHGKNEFLKSFHDLSSSYEAHEHDGMSAAESSSSASFDAVLSDVQEVNNVVEDKQKVLNESGEVSGENKKGHLSHMNETADGAMQAPRNNQSVQRADSAVRNLLFQGSGHLFTEKDIIGIYRTPMLDQLGRSRYSLFQKEVQVTKNQRGNANERYAWLACTKGTMEEMMMNGALEIAKPLQGPMYGVGAHLAPANSSNICVGLSDIDENGIIRMMLCRVIMGNVEVVFPGSNQCQPTSESFDSGVDDLQRPKHYIIWDANVHKHIYAEYAVIIKVPYMNNGDTASNISEIRNSGALDNPTKVCILWFSWCAVVH

SEQ ID NO: 21232 - protein, 387 aa, Oryza sativa (japonica cultivar-group)
MDMMEEEAANAATAQAAAAGDLADVVARANARAFLVSTPHHHPSPLHPLPPPPMPQAPHQYYPAPQITIPYHHHHHGELRRPTTIAYTDAPVPFETAGPPSTVVDSYHHLTPGDAGYGMPRPLALQISQHALCGGGDVVMGGGGAGAADDGEEAIRISPLTPSAHHQMMKRKNEVKKVVCIPAPPATSSRGGGGEVIPSDLWAWRKYGQKPIKGSPYPRGYYRCSSSKGCMARKQVERSRSDPNMLVITYAAEHNHPWPMQRNVLAGYARSHHSTHATASSSRHKQQQQQQTNQLQPALITSSSSSSSSPFNLYADVVLGGQQANMMMTTEGAGAGLGIQPSAADEVFAELEELEPDNPTMINANMQVYSTTSRPGVSSYDHQWHKF

SEQ ID NO: 21233 - protein, 187 aa, Danio rerio
MPVDINEWTGSLALTEVEEPPAKPLTVKYDSVEIDSLGKVCTPTQVQNRPTSVEWEGCDPSKLYTLAMTDPDAPSRKDPKFREWHHFLAVNVKGNDVSSGCVMSDYVGAGPPKGTGLHRYVWLVYEQSGNISCTERVLTNRSGDSRGKFKIQSFRKKYGLGAPLAGSCFQAEWDNYVPKLYEQLAGK

SEQ ID NO: 21234 - protein, 8625 aa, Procambarus clarkii
MGDNFAPSFTQKPKLRQEDDGNKLIFDCKLSASPQPSIEWFREDTPVKESSRVKITVKPGKGGNIHDVQLILDDVEEEDAGLYKVKAKNKYGEVSASINLNFSPNEQPVDIKQIDGLAPTFAQKPVIKQEEGGKHIKFECRILADPRPTITWFRDGLKVQESARCKVTTEKDEKSYFVTMAFTNVTVEDAGKYKVTAKNELGESNATISLNFDSSFMMLTADEVPSPKEGVRPTFTERPSIKQSEDGTSVIFSCRCVANPQPTIVWEFKGKKLREGARHRMKLEPDGKLYYMVILEVNKVTNADEGEYRAVASNKLGEGVATINLHFEGKTASDKPKIPDGKAPRFPKKPEIRQEGDKLVMECILEANPEPEVTWFKGTEIIQEQGRISMYKKICGKDQFIVSVTIMKPEASDGGQWRCNAFNPFGDSNANIALNFEKGKAIPEGFAPTFLDKPSIIPNESGTMITMKVRCKAKPQPTVEWFKDGKKLEAAKRLVIKGHKVTAEMFEYSCIVKDPCGADAGKYKCVAMNQFGEATANVNLNIESDPEPTGQAPVFVEKPTIKFEEKAGRVLMEALVRADPKPTSRWTKDGKELDVARVTATVTKEKDDLYRIRMELRKPQPTDGGVYKCNIKNEFGELNANLNLNIEVAPTIKRPPRIVSVFNRKVVIECVVISTSKPACSWFKDSSKVRLDTRHCVNINEEGEGKYVVQMEMLKAEKMDCGSYKVVAKNEKGETTFAGRGAHHRDMLEEKEEKKKEEVKEEKMEQQEAAQVEEESKKEEKAVKKDKPKRREIKKEEAPVDFTKVQLKKVKPKEEEAADEAQQIELKKIPDKEQQAVLEGEKVKLKKVTAKEELTIEEAQKVQLQKVGAKEQQAVEEGEKVKLKKVRAKEEQATEEAQKVQLKKVGAKEQQAVEEGEKVKLKKVRAKEEQATEEAQKVQLKKVGAKEQQAVEEGEKVKLKKVGAKEEQAVEEGERAKLKKVGARKEEAVEEAEKVQLKKVETVKVEAKKEEARETKMESLQKPKIVEPKPSDAPKIEVIKDKSPERRGSLATGSGPPSRRGSLVPPEEGAGGRRPSLLIADEEQRKTRPGEEAVEFKGGRKLRPGEELVGGKGKLKPGEQATKQRRRPSSDVRRPSVQDDEKMDKPCTPLRAVGKEGPPVIVDVQQKYTAVEDQNGYIDLVVEGIPPPTKIKFFKGITEIIDGGRYKIHTEGETNTITLCIRKTKANDEGHYKVIVGNEHGEDSAEMDFYVSDASGMDFRAMLKKKKYAKWKKDNEDPDWGDLKETEKEVKPQLRKVERKQEMWVKPLLDVTVKEGKDKFAKFEAEFSKKDSKPKWFFKKDELFTGAKYKFKSEGCVHTLVITKPTLDDMGKYTVECMGIACSCILTVQEPDPDFKFVRPLPKKISSYTTKDATLEAQVNSHKAIVHWFKGEEKIEEDEKFETYKDMTGTVRLTIKNASKKDKGKYTAKIFRCEKEFTETLLSIVDQPFKFTKQLKSKTVTENSKVILECDVDEAEAEVEWFYGGQKLTPDSKILKIMKDGKKRQLVFKSISMDDAGNYSCRTNADETTCEIIVQYENKFKKKLQDQMTYERQPATFEVELVDPNAPLQWFINGKEVTEGDNYEFQKKGGVHRLIIKEAATAHEGEIKAVCGNLETACQLSVGEGEKPPSIKPEEPIEGPVTKPLVFEVPYTIPGARISKVDAKLLKDGKPMNVKEVEVNILDKKVIYTFKKPSRDQSGKYTIRMSNKAGESSKEVKINMQDRPSPPTNVEVSEIFSTSCLITFGPPKDDGGLPLTYYIIERQDFSVKASHPRIWERTGGWAQVAEIPADEPLRFKSEDLENKKQYKFKVTVSNKLGPSDPFIHPKVILAKDPWDEPGKILHVEVNDWGPDHADLRWSRPETDGGAPITGYVIEFRTRAMPGAGEVDRFSDWAKGIEIQGDVTEGTIPDLKEGNQYEFRVRAVNKAGPGEPSDPTKPIQAKHRFVKPFVINKDEFKNIVIKKTQLFKLDVKYGGEPEPRVIWKKDDKEVIPDEEQRLPEPYNCRRSPSSSSRGHSLHAEEGRSLRHRQVQASARSTLWASVKEEADVVVLGKPTRPEGPLFPEEIRADHVTLKWKKPLDDGGLPIEGYVIEKMDMDTGAWIPAGEVGPEKQEFTVDGLTPKKKYKFRVKAVNKEGESEPLENDEPILARNPYDEPSRPGKPEIIDYDNTMVVLRWTPPESDGGRPITHYHIEMKDKLSVDWKEVVQTKDTNCEAQVPGLKEGTVYSFRVKAANKAGIGEASEPTDNHLCKHKNRKPRIDRTNFKSVTIKVGRSHKWAVDYVGEPDPDVTWSRGENVLSNTDRIHIENTDHHTEISITDATRKDAGLYTLKIENRNGQDSETVELVVLGKPSKPKGPLEVSNVHDTGCRLKWEKPDDDGGMPIKEYEVEKMDLATGKWVRCGKCPGALAPPYFNVEGLEPGHQYKFRVTAVNDEGDSDPLEADGAILAKNPYDVPTAPGRPEIVDYDNKSVDLKWTVPESDGGAPIMKYIVQKKDKFMPDWEVAAELKQDVIQPLKPGTPVETKVGGLKHRAEYQFRVVAVNKAGNSPESEPTDYHLVKHKALKPRIDRTHLKQTTIKAGRNVKFDINIEGEPPPSVQWVLKEQEVKDSNIEIVNVDYNTKFNMIDAKRKQTGTYKIIATNRDGKDEAAVEIVVLSGPGKPKGPLKVSDVTKKSCKLKWDKPDDDGGKPIQEYLVEKQDPTTGRWVPVGRTKDLAMDVPGLQEGKEYNFRVKAINDEGESEPLETDHSTLAKDPYGPPGKPGIPDIVDWDVDRVDLKWEAPKDTGGAPITKYIIEKKERYGTWETIHESEGPKTECRVPGLKEGNTYQFRVVAVNKAGPGDPSDPTKPHLAKARFLKPLINREKLKKITTRASQKVFLEVDVKGEPPPEIWWTLKNKKVETGPNYVIQAEDYLTKFTLNDAERRHTGIYKIHAKNDSGSDEAELEIIVLDRPGKPEGPLEISDVHKEGCKLKWEKPKDDGGLPITGYVAEKMDVTSGKWVPCGRTDGDATDLEVTGLEPGKKYEFRVKAVNDEGESDPLDGDRAIIAKDPFDKPGPPGLPEIVDFDENSVKLKWDPPIRDGGAEITGYVLEMKPKNADNFVEVGKVKGNVCQGPITGLKEGEKYEFRVRAVNKAGLGEPSDSTLPHTARAKFRKPRIDRTNVKDVVIKVGQQYLYDIDVIGDPKPTNTWTLKDKPLLSILGQEVVTKDQLRVDSSGNNTKLLIMKAQRKMSGKYVLTATNEHGEDSVKIDITILGPPSKPKGPLEVSDVKANGCKLKWDKPEDDGGLPVDHYEIEKLDPITGQWMPCGESKTPEFDVTGLQEGKKYKFRVKAVNPEGESEPLEADKAIIAKNPFDPPSKPGKPKATNWDRDFVELEWAKPKDDGGAEITKYIVEKRDVTGRGWTPCGSGPGNRTSIRITDVEPDHEYLFRVVAENKAGPSEPSDASDSVICKPRFLAPRIDRKSVGRKTIRSGITFKNESKVEGEPDPKVTWSLQGAPIKNERVTITSEDHLTTIVIRKAKRSDTGVYKIFAKNDSGTDEAELDLIVIGKPGKPKGPLKVSDVTAESAKLKWEPPEDDGGEPIDHYVVERMDTETGRWVPVKETKTPEAEVPGLTEGKDYHFRVRAVNSEGESEPLETDTATRAKNPYDPPSKPGKPEVKDFDRTWCELKWKAPESDGGAPISHYVIERKDKYAAKWVKHCDTKSDKPEFKVNDLTEGETYQFRVKAVNKAGQSKPSDASDNFTAKAKFLAPVIDRTNLENITVRAGQMIKFDCNVTGEPIPKKTWFINKARQDNDQPGIKIDEEDHRTKIVIASCTRAHNGTFVIKADNTAGHDEVTIEVIVLDKPGKPEGPLKVSDIHKEGCTLKWKEPLDDGGAPIEQYIVEKMDTETGRWVPVGRSREPTMAVENLEPMHEYKFRVSAINSEGESEPLEGLDTIVAKNPFDPPDPPGKPEATDWDKDFVELKWTKPAKDNGAPSLATSLRSVTNSLASGSRLREVKGDTPKGRVNDLDEGETYEFRVRAVNEAGPSDPSEASLPITCKPRKLAPKIDRRNLRDLTVREGEPILLDVKVIGEPPPEVEWFHGKKPIKETKDLRVENVPYNTKYINDEPLRKHSGVTKIVATNQHGRDEAEITITVISKPGKPEGPIEVKDVHKEGCKLKWKPPKDDGGSPVEGYVVEKFDPDMGLWLPVGKTSTPDMEVTDLTPGHEYEFRVKAVNKEGESEPLVTLSPILAKDPFTVPGKPGAPEATDWDSNHIDLKWSMPLEDGGAAISHYIIEKRDKYTNLWEKACETPTPECKGTATNLIEGMEYQFRITAVNRAGAGEPSDPSKTIIAKPRFLPPKIDRKNLRDVTISAGSMLKYDCDISGEPPPTASWTYEGRKLEASRHVTIANIDYNSKLVIRDTVRADSGEYVITATNSSGKDQVTVRVTVTDKPSPPEGPIKVSDVRGTGCKLKWKRPKDDGGTPIEYYQVEKLDPNTGLWVPAGRSAGPEPSVELNNLSPGTEYQFRVRAVNAEGESDPLNAEESVLAKDPYEEPGKPENLKVADYDQNKVDLKWEPPKSDGGAPIQKYIVEKKDKYGGWDKACEVPANKTSCSVPDLIEGETYEFRVRAVNPAGPGLPSDATHPVTVKPKNMPPKIDRTNLIPVRSKAGQSFVFDVNVSGEPVPEKKWLLNKKDIKPSSVTNIRYNDYNTKLRVTGATREQSGTYTIVAENANGKDSADVEVIVLDKPGTPQGPLKVSEVYAEGCKLDWKPPADDGGCPIDHYVVEQLDEATGRWVPAGETAGKETTFDVEGLTPGHKYKFRVKAVNRLGTSDPLVTQQAIEAKNPFDPPSSPKDVNIADFDCDFVDLEWKKPETDGGAPITGYIIEKRDRYNPLWDKCATVDGDQCKAHVPDLLEGNVYEFRVVAINKAGPGEPSEPTKPHVARPKNLPPRIDRNAMMDVKVKAGDNLNLPVPVVGEPPATKQWRVRDNDLYPSDRLSIINEDYMTTIKITDCKRSDSGAFTLNARNKNGEDTCTVNITVLDVPGAPEGPVKFSNINRNGCSIAWKPPKDDGGSEITSYVVEKMDMETYRWVPCGEVKDTHFQVDNLIEGHDYKFRVSAVNRQGQGPPCTGVDTITAKDPYSKPTKPGTPEVMDWDKDRVDLQWTEPRSDGGAPITGWIVEKKKRFGPWEKALELPAKHGPKASVPDLTEGEEYQFRVIAVNKAGNSDPSDSSQPVVCKARFEKPGIDTKDLEDLIIKVNTRLNYTVPIRGAPRPKVSWTVNGSPVVESERVDLQTYGKQTILDIPFAQRTDSGRYTLTLENDLGKVSASGTVTSLTSLTAEGPLNVYDVTRESCKVSFKTPIDDGGSPILHYLVEKMDVSRGTWTEAAEVAGLVAEVHGLVHMKEYHFRVKAVNAIGESEPLCTDKSIIAKNAQDEPSPPGRPNVVDWDSDHVDMEWTPPAHDGGAPITGYLIQKKERGSPYWQTAARVSGPETKGTVPNLTEGQEYEFRIIAVNKAGNSEPSEPSDAVICRPRHLAPKILGPLYDVRIKAGQVLHVDVDYIGEPQPDVFWFNDDKELQIDMRTTITAINNHSVLHTVNTMRNDSGEYRIRVKNESGQDEATFQVIVLDTPGAPEGPLVYEEVQANSVVMSWKPPVDDGGSPITGYVIEKRDISHGGGWVPAVNWVDPKQNHATVPRLLEGTQYDSRVRAENMQGRGEPLESDRPVTAKSSADVPGAPGRPSCTDSDKDFIKIAWAPPRSTGGSPITGYDVERCGIHSGRWKKVNRDPVRTTEFVDDSVNEGEQYQYRVVANNKMGPSNPSDPSQAITAKPMREAPKLYLDGLLGKKLKVRAGEPIDIKIPLSGAPQPVCEWSKKGKKLEPSKRTSMETTSDHCRLFVDKARREDSGTFTITAENPYGKDSADIEVIVVDKPGPPIGPLTPTEVTAHTVSLSWKPPQDNGGAEVTGYVVERPTPTTTYERSCQGTAKPNFTVKGLEEGKKYRFRVRAENMYGVSEPLEGKPVEAKNPFDPPEAPDRPDIVDYSPSTCSLEWKPPTDTGGRPITGYIIEKRERGGDWIRVNHYPTPNTQYTVQGLSEGNRYEFRIIALNEAGPGKPSKPSNSIVAKVPKYLPGPPDAPRPDRIGRNCVTLSWRPPSQDGGAKIRGYLVEYRQKDEDEWQPANSLPHPDTNYTVLGLTELEEYYFRVIAVNEVGPSAPSRPSALIKIEEQANKPRIDLSAVRDPPVRAGEDFSIHVPYTGFPKPTSTWYHDDEDINIGADPRIHEKLTDDYCAMIVTNAQRSDTGPYKLRLQNPSGFDSVSLNVRVLDRPAPPENLRADEFNGDALTLFWNPPKDNGGAEITNYVVEKREGRGNWTKVSSYVTAPFLRIRNLVVNNEYDFRVMAENQYGQSDPCTSANPIRARHPFDPPGAPGAPRGLESTEDSITIQWSKPRHDGGSHIQGYVVEKRIVGDNTWTKASHAMVKDTTYRVINLTEHQEYEFRVAAINAAGQGPWSDPSENIKCISFRAPKITSDLSIRDMTVIAGEEFTITVPFIASPQPKVQWWIGPNEVIPDNRVQFHMDSSNNSTVFVNKSAKRSDIGKYTIKLTNSEGADSGSCKVNVVDRPSPPQGPLEVSDITPDTCSLAWRPPLDDGGSPITNYQVERLEPVTGMWVKVSAFVRSCHYDVMGLEPNRSYMFRVRAENQYGLSDPLETLDPITAKFPFTVPDPPGRPNILDHDINSVVLTWDRPASDGGSKIQGYKVEYRDVTDTNWAAANDFLVKETTYTVHSLLINHEYEFRVKAKNAAGFSKYSPPSKKIKMKGKYSVPSPPGTPVVTKIGKNYVDLKWSVPESDGGSRITGYMIEKRELGSIWMKCNDYNIVDTQYTVLNLTEGSEVEFRVYAINAAGKSDPSQSAQPVKIREAAPGEKPFFVKNLQNTAVALHKSVTLECEAEGKPTPTARWLRNGREVTLGGRITSEESKGKFKLFISDMWEVDEGDYACVAANDAGQATSIAHVKIGNPPRITQMQDALYLPEGDNTKIKIYFTGDLPLDVTLSQNGLPVEESQRLKFTVFDEFIIIFIREVVKQDAGQYTLTVKNDSGSVTGNFIVYITGVPGAPTAPLDVTDISRHMCNLAWRPPVYDGGLPVTHYVVERKDITYANWITINSFCKDCSFTVQGLTEGQEYLFRVMAVNENGMGPPLTGVNPIKAKAPYDPPSPPGTPNVTEVGGDFVHLEWDKPAHDGGSRIKGYWVEKREIGSNIWTMVNQYICLPTQINVSNLIEDRQYEFRVFAENDAGMSEPSTCSTSVRIKDPNAATPPEIITPLRNVMALQHRSATLTCQIAGKPRPNISWFKGMRELCNSAKYAMNRDGDTYTLTVHDVYGEDEDEYMCRAQNSGGIRSTKADISIKLAPKINVPPRFRDTAFFDKGENAVIKIPFIGNPRPRITWQREGETIESGGHYSVETQQRHAILHLRDVTNLDTGNYRLTAENELGSDSVIIKIQISDRPDPPRLPKVESILGTECVLTWQIPLWDGGANINNYIIEKRELPMESWIRCSNTRLTTAQIKGLSPGHKYQFRVYAENVYGRSDPSAVTSVVETPAPLTKKPKKKVYEVDETGKKIRGRKESVDDYDQFVFDVYSKYVPQPVDIKHDSVYEYYDILEEIGTGAFGVVHRCRERKTGNIFAAKFIPVASAMEKELIRKEIDIMNHLHHPKLINLHDAFEDDDEMVLIFEFLSGGELFERITAEGYVMSEAEVINYMRQICEGVKHMHEKNIIHLDVKPENIMCQTKTSTNVKLIDFGLATKLDPNEVVKISTGTAEFAAPEIVEREPVGFYTDMWAVGVLAYVLLSGLSPFAGENDIDTLKNVKACDWDFDEEAFSNVSNEAKDFIRRLLIKNKEKRMTAHECLMHAWLRGDYSPRLEPIDMMRYIPIRDKIRAKYKEWAKFLLPIGRLAEYSSLRKLHLDKYRIHDTHFDRRQCAPRFVIRPQNAFTYEGQSVKFSCRIVAVAAPTVCWFHNNMELRQSVKYMKRYSGEDYSFVINRVKLEDRGEYIIRAENHYGAREEPVFLNVQPLPPEAPPYRPQEQIIRRRQPLTYKLWQEEGEGAPSFTFLLRPRVIQCHQTCKLLCCLAGKPVPTVKWYKGSQELSKFDYSQSHADGVVTIEIVNCKPADSGKYRCVATNSLGTDETSCVVIVEDRRYIETTIKDLPPPPTPAIRVDDTSSSSYFTSTHKDGRSSTSTKVEAASSSSTSSAAASGAKRTLKPYGKRQDSTGSTSRSRSATKELELPPDDSLMGPPGFSGELPKTLAIKDGEALCLKCTVKGDPEPQVSWFKDGEPLSSSDIIDLKYRQGLASLTINEVFPEDEGLYVCKATSSLGSAETKCKLSISPMEQQINGKSGRGDKLPRITQHLLSQEVPDGTAHTLSCKIGGATKFDVVWLHNEKEIKPSKDFLYVTEGDTYLLKIAEVFPEDAGTYTCEAFNDVGETFSTCTLTVIIPGEEKKQPAFKKFPRSQTVMEGKSATFSVKFEKDPLKVSWIKDGKPVDESSPRFKFQQEGKKEFSYEIPSCLPTDVGQYVVKATSKKGDTTAAFSLNVHTSDDL

SEQ ID NO: 21235 - protein, 253 aa, Salmonella enterica subsp. enterica serovar Typhi Ty2
MTKVAIVTASDSGIGKACALLLAQNGFDIGITWHSDERGAQETAKKAAQFGVRAETIHLDLSQLPEGAQAIEHLIQRLGRVDVLVNNAGAMTKSAFIDMPFTQWRQIFTVDVDGAFLCAQIAARHMIKQGEGGRIINITSVHEHTPLPQASAYTAAKHALGGLTKSMALELIEHHILVNAVAPGAIATPMNDMDDSDIEPGSEPSIPIARPGSTHEIASLVAWLCSEGASYTTGQSLIVDGGFMLVNPQFNAK

SEQ ID NO: 21236 - protein, 920 aa, Salmonella enterica subsp. enterica serovar Typhi Ty2
MNLLNLKNTLQTSLVIRLTFLFLLTTIIIWLLSVITAAYISMVQKRQHIIEDLSALSEMNIVLSNQRFEEAERDAKNLMYQCSLATEIHHNDIFPEVSRHLSVGPSNCTPTLNGEKHRLFLQSSDIDEKSFRRDSFILNHKNEISLLSTDNPSDYSTLQLLTRKSFPLYPTHAGFYWSEPEYINGKGWHASVAVADQQGVFFGVMVKLPDLISKSHLPLDDSIRVWLDQNNHLLPFSYIPQKIRTQLENVTLHDGWQQIPGFLILRTTLHGPGWSLVTLYPYGNLHNRILKTILQQIPFTLTALVLMTSAFCWLLHRSLAKPLWRFVDIINKTATAPLSTRLPAQRLDELDSIAGAFNQLLDTLQVQYDNLENKVAERTQALNEAKKRAEQANKRKSIHLTVISHELRTPMNGVLGAIELLQTTPLNIEQQGLADTARNCTLSLLAIINNLLDFSRIESGHFTLHMEETALLPLLDQAMQTIQGPAQSKKLSLRTFVGQHVPLYFHTDSIRLRQILVNLLGNAVKFTETGGIRLTVKRHEEQLIFLVSDSGKGIEIQQQSQIFTAFYQADTNSQGTGIGLTIASSLAKMMGGNLTLKSVPGVGTCVSLVLPLQEYQPPQQIKGTLSAPFCLHRQLACWGIRGEPPHQQNALLNAELLYFPGKLYDLAQQLILCTPNIPIINNLLPPWQLQILLVDDADINRDIIGKMLVSLGQHVTIAASSNEALTLSQQQRFDLVLIDIRMPEIDGIECVQLWHDEPNNLDPDCMFVALSASVATEDIHRCKKNGIHHYITKPVTLATLARYISIAAEYQLLRNIELQEQDPSRCSALLATDDMVINSKIFQSLDLLLADIENAVSAGKKIDQLIHTLKGCLGQIGQTELVCYVIDIENRVKMGKIIALEELTDLRQKIRMIFKNYTIT

SEQ ID NO: 21237 - protein, 462 aa, Salmonella enterica subsp. enterica serovar Typhi Ty2
MTMMTATQALSVNPATGQTLAAMPWANAQEIEHALSLAASGFKKWKMTSVAQRAQTLRDIGQALRAHAEEMAQCITREMGKPIKQARAEVTKSAALCDWYAEHGPAMLNPEPTLVENQQAVIEYRPLGVILAIMPWNFPLWQVLRGAVPILLAGNSYLLKHAPNVTGCAQMIARILTEAGTPAGVYGWVNANNEGVSQMINDPRIAAVTVTGSVRAGAAIGAQAGAALKKCVLELGGSDPFIVLNDADLELAVKAAVAGRYQNTGQVCAAAKRFIVEEGIAQAFNDRFVAAAAALKMGDPLVEENDLGPMARFDLRDELHQQVQASVAEGARLLLGGEKIAGEGNYYAATVLADVTPDMTAFRQELFGPVAAITVAKDAEHALALANDSEFGLSATIFTADDTLAAEMAARLECGGVFINGYSASDARVAFGGVKKSGFGRELSHFGLHEFCNVQTVWKNRV

SEQ ID NO: 21238 - protein, 384 aa, Salmonella enterica subsp. enterica serovar Typhi Ty2
MSQNTLKVHDLNEDAEFDENGVEAFDEKALSEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKENGPEDTTQDDDMKQSIVKWLFELNAKQREVLARRFGLLGYEAATLEDVGREIGLTRERVRQIQVEGLRPSARNSADAGAEYRSAVPRVSTLVKKRPVDRLAFFLPFVFCQQRRDTRHHWRVINIFLRHAKRLWIVFAAGTA

SEQ ID NO: 21239 - protein, 233 aa, Oryza sativa (japonica cultivar-group)
MAANVGESTSSGTNGDAAGGSFECNICFELPQEPIVTLCGHLFCWPCIYRWLHIHAHSPECPVCKAVVEEDKLVPLYGRGKDRVDPRSKNIPEADIPNRPTGQRPATAPQADPNNNFAHANPNANANPWFMGTGVPLANARWGNYAFSAAFGGLFPMLSFQVHGFPDANPYAQPAGFHYGYGHGHGFHGGHMGHAAHGVPRQGPLEQPQQADIYLKALLIMVGFLVVASLLAF

SEQ ID NO: 21240 - protein, 401 aa, Acacia mangium
MDPETFTTSIFKWDPRTILSTSAFNRPPLLEYTMAPPALPSAAVVKGSSREVTGLDELFQAYGIRYYTASKIAELGFTVSTLVNMKDDELDEMMNSLSQIFRWDLLVGERYGIKAAVRAERRRIDEEDLRRRNLLSTDTTTTIALDALSQEGLSEEPVVQQEKEAGGSTWEVIAATERRKQQRRRTKTARTMKTNQHHNDNENEDAEDDGEAEDIEEGMNNGGCERQREHPFIVTEPGEVARGKKNGLDYLFHLYEQCREFLIQVQNMAKERGEKCPTKVTNQVFRYAKKAGASYINKPKMRHYVHCYALHCLDEEASNELRMRYKERGENVGAWRQASYKPLVAIAARQGWDIDAIFNAHPRLSIWYVPTKLRQLCHAERNSAAAGASSSVSVGGGHLTF

SEQ ID NO: 21241 - protein, 402 aa, Acacia auriculiformis
MDPETFTTSIFKWDPRTILSTSGFNRPPLLEYTMAPPALPSAAVVKGSNREVTGLDELFQAYGIRYYTASKIAELGFTVSTLVNMKDDELDEMMNSLSQIFRWDLLVGERYGIKAAVRAERRRIDEEDLRRRNLLSTDTTTTIALDALSQEGLSEEPVVQQEKEAGGSTWEVIAATERRKQQRRRTKTARMMKTNQHHNDNENEDAEDDGEAEDIIEEGMNNGGCERQREHPFIVTEPGEVARGKKNGLDYLFHLYEQCREFLIQVQNMAKERGEKCPTKVTNQVFRYAKKAGASYINKPKMRHYVHCYALHCLDEEASNELRMRYKERGENVGAWRQASYKPLVAIAARQGWDIDAIFNAHPRLSIWYVPTKLRQLCHAERNSAAAGASSSVSVGGGHLTF

SEQ ID NO: 21242 - protein, 493 aa, Xenopus laevis
MESRKGQVTCSLVFSVCVAAIGSLQFGYNTGVINAPEKIIRSFYNATYEHRYGKIIPESLLTSLWSLSVAIFSVGGMMGSLSVGLFANRFGRRNSMLLVNVAAIVGGAFMGFSKLAWSPEMLIIGRFIIGIFCGLCTGLVPMYIGELAPTSLRGALGTLNQLGIVIGILVAQIFGLDFILGSETLWPLLLAFTIFLSIIQCALLPFCPESPRYLLITKGEDEKAEMILRKLRGTTDVASDVQEMKDESARMAQEKSVSIIEIFRSSQYRQPITIAIILQLSQQLSGINAVFYYSTSIFEDANVPNPVYATIGAGVVNTVFTIVSLLIVERAGRRTLHLTGLGGMAVGALIMTIALKLKDQDQAWSYVSIVAIYGFVALFEIGPGPIPWFIVAELFSQGPRPAAMAISGCSNWTANFLVGMLFPYAAIACGPYVFLIFMVLLILFFIYTFFKVPETRGRTFEDISQEFQKKGAESRTKSDSVELTGIQGLDKKV

SEQ ID NO: 21243 - protein, 258 aa, Sinorhizobium sp. NGR234
MTKTAVITGSTSGIGLAIAKAFAKTGANIVLNGFGSADEIRTVTDEVAGLGAGTVLHHPADMTKPAEIADLMATAVARFGGADILVNNAGVQFVEKIEDFPVEQWDRIIAINLSSSFHTIRAAIPAMKQKGWGRIVNIASAHGLVASPFKSAYVAAKHGIMGLTKTVALEVAENGITVNSICPGYVLTPLVEKQIPDQARTRGITEEQVINEVMLKGQPTKKFITVEQVASLALYLASDEAAQITGTHVSMDGGWTAQ

SEQ ID NO: 21244 - protein, 380 aa, Photobacterium phosphoreum
MTLSIENQNKLDEFWAYCVKNQYFNIGYPESADFDYTILERFMRFSINNCGDWAEYCNYLLNSFDFEKEVMEYFADLFKIPFEDSWGYVTNGGTESNMFGCYLGRELFPDGTLYYSKDTHYSVAKIVKLLRIKSQLVESLPNGEIDYDDLIAKIKQDDEKHPIIFANIGTTVRGAIDDISKIQAMIGELGIKREDYYIHADAALSGMILPFVDEPQGFNFADGIDSIGVSGHKMIGSPIPCGIVVAKKRNVDAISVEIDYISAHDKTITGSRNGHTPLMMWCAVKSHTHEDFKRRINRSLDLAQHAVQRLQSAGINAWCNKNSITVVFPCPSEAVWKKHCLATSGGQAHLITTAHHLDASKVDALIDDVIKDANGETIAA

SEQ ID NO: 21245 - protein, 428 aa, Danio rerio
MAGRDVNESSPLLENSVTSTRSESVFNGRRLACAAILLAESLERMAFYGITSNLVLFLNSSPFYWEGTLASQGPLIFMGVTYLISPFGGWLLFPFVASDNTRNYLCGEEMAFPVQPAECFPENGTVPANVTCVNRPSYCRPAIYSGLVLVALGVGAVKSNITPFGADQVKDRGPEATRRFFNWFYWCINLGAIFSLGGIAYIQQNISFSIGYIIPAVCLGVSLIIFFLGKAVFITKPADGSAFSDMFRILGSALCGRGPKEPSLLRPKPTVLDGAKVTYGGRFSDEKVEEVKSLVKILPVFLALIPYWTVYFQMQTTYYLQSLHLTIPGADPNSTDSHPNTFRFPAAWLTMFDAVLILMLIPLVSEENRCGHVLCHVLGGGGWHFRDEEAGHCPHTGSHPAVAGWSYILCSRSTYMVASASVCPHRCQ

SEQ ID NO: 21246 - protein, 436 aa, Danio rerio
MGRKKKKQLKPWCWYCNRDFDDEKILIQHQKAKHFKCHICHKKLYTGPGLAIHCMQVHKDTIDGVPNAIPGRTDIELEIYGMEGIPEKDIQDRRRVLEQKSQESQKRKQNQDDSDEDDDDDEDEAGPSSFQQPTAQPQAAYMAPMTQTGIHLGPQAQGMPSAGYAGMPPMLTGVPPMIPGMPPVMPVMPPGMMPMRGMMPPGPAMPPMMPGMLPGMPHHVGRPGMPSMAPAAPVTVPGLASRPAVPITQSAASKPLFPSAVQAQQTVSGPSSTSSDSPKVTFPAYTQPPSTSSVVPASSSTVAKPPATVTSKPATLTTLSATSKLMHPDEDISLEERRAQLPRYQRLIPRPGQTAATAASAPPSGAVGGMMPPQQSGMRHPIHGQYGGPPQAMSGFMAVGMPPYGQNAPMVPSYQAGPVGPPMGIRPSVMSPGSRY

SEQ ID NO: 21247 - protein, 582 aa, Danio rerio
MGGLQKKKYESGSATNYITRNKARKKLSLSLADFRRLCILKGIYPHEPRHKKKVNKGSTAARTYYLLKDIRFLLHEPIVGKFREYKIFVRKLRKAYGKAEWSAVERLKENKPGYKLDHIIKERYPTFIDALRDVDDALSMCFLFSTFARTGKCHVQTIQLCRRLSVEWMNYIISSRSLRKVFLSIKGIYYQAEVLGQTITWIVPYQFAHNHPTDVDYRVMATFTELYTTLLGFVNFRLYQTLNLVYPPKLDGQGEISLKAEFEEDYALESESYTEKLSALSASLARMVASVEEEEAELDHFPTEGEDQEKMEVREKMEQQQSKQKKLFEGLKFFLNREVPRESLAFVIRCFGGEVSWDKSLCIGSTYEATDETITHHIVDRPSMDKQYINRYYIQPQWVYDSVNAKIQLPVEEYFLGVTLPPHLSPFVEETEGDYVPPEKLKLMALQRGEKPQAEEDEEEEGEEEEDDEEDEEDDEQSEDEEEAEEEANLAEMEEKRSQGKSLSVKVTPGKAKAENRARAAEEEKAEEKRLAIMMMKKKEKYLYDKIMFGKKRKVREANKLAAKRKAHDDASKEDKKKKKKC

SEQ ID NO: 21248 - protein, 302 aa, Mus musculus
QDIKNNLKEAIETIVAAMSNLVPPVELANPENQFRVDYILSVMNVPNFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 21249 - protein, 298 aa, Rhizobium tropici
MKEAYAAISREKAKPLVLECIGIDQPRPDEILVRIVASGVCHTDMVVRDQGYDVPQPVVLGHEGSGVVEVVGADVKGLSPGDHVALSYAYCGKCEKCRGGTPYYCEDFFGRNFRGTRPDGSCPLHDSHGTQISGCFFEQSSFATYAIASERNAVKVSKDVPLELMGPLGCGLQTGAGAVLNCLKPQPGSSIAVFGAGAVGMAAVMAAKIAGCSTIIVIDLNDERLELAIELGATHIINARNGDSVKAIREIIPEGADFSLECTSSPKVFRQAVDCLGTPGTCGLVGSSALGTEGIVDI

SEQ ID NO: 21250 - protein, 236 aa, Rhizobium tropici
MQEKSMVKITAAVAVKPKAPLEFRELELADPEGNEILVRTVATGICHTDLLLRDGIFGPPAPVIPGHEGVGIVEAIGADVQGLRVGDHVALSQSSCGFCGDCRRSHPMNCQNYTQYNLTGLRPNGKKALLCDEVGIGSNFVGQSSFATHILATENNAAQLPKDFDLTNAAPLGCGMATGAGTVINAMKPEIGQTIAVFGAGAVGMAAVMAAKVRRCSKIIIIDLNEQRLAMAKTVW

SEQ ID NO: 21251 - protein, 259 aa, Fritillaria agrestis
MSPAEPSREENVYMAKLAEQAERYEEMVEFMEKVARTVDTEELTVEERNLLSVAYKNVIGARRASWRIISSIEQKEESRGNEDHVALIKDYRGKIEAELSKICDGILKLLDSHLVPSSTAAESKVFYLKMKGDYHRYLAEFKSGAERKEAAESTLLAYKSAQDIALAELAPTHPIRLGLALNFSVFYYEILNSPDRACNLAKQAFDEAISELDTLGEESYKDSTLIMQLLRDNLTLWTSDINEEAGDEIKEASKAGEGQ

SEQ ID NO: 21252 - protein, 229 aa, Arabidopsis thaliana
MMGSVELNLRETELCLGLPGGDTVAPVTGNKRGFSETVDLKLNLNNEPANKEGSTTHDVVTFDSKEKSACPKDPAKPPAKAQVVGWPLVRSYRKNVMVSCQKSSGGPEAAAFVKVSMDGAPYLRKIDLRMYKSYDELSNALSNMFSSFTMGKHGGEEGMIDFMNERKLMDLVNSWDYVPSYEDKDGDWMLVGDVPWPMFVDTCKRLRLMKGSDAIGLAPRAMEKCKSRA

SEQ ID NO: 21253 - protein, 340 aa, Paulownia kawakamii
MNDGPEVCRKVRTRRPIQTGQSSLGPDARHTDPPGPPPPGPLGDLLPFPYARRHPPRRRPSWPQPRPPPNPSFPPSQWAAAVGPAQQDQRDQACVPFKDPAGRRGLFRWAWIGRPAAGFDGGGSSPGPRHGHSNSVDEYSSAMSSELDSIAKRAMAADRLAELSLIDPKRAKRILANRQSAARSKERKTRYTSELERKVQTLQTEATTLSAQITLLQRDTTGLTTENKELKMKLQAMEQQAHLRDALNEALKDELQWLKIAAGQVPGVNGNNRGSFSQFSSQPPTIRYFGNHLAQQQQQQQQQQQQQQQQQPLHMPHSSANNPRLGGQSQLSFQDFNHRV

SEQ ID NO: 21254 - protein, 54 aa, Homo sapiens
IAGIQHSCQDIGAKSLTQVRAMMYSGELKFEKRTSSAQVEGGVHSLHSYEKRLF

SEQ ID NO: 21255 - protein, 478 aa, Klebsiella pneumoniae
MTAPVQHPMYIDGQFVSGRGDGWIDVLNPATEALLSRIPDGTAEEARLAIDAAERAQPGWEALPAIERAGWLRKIAAGIRQRADEIAGLIVAEGGKIQQLAAVEVAFTADYLDYMAEWARRYEGEIVQSDRPGENILVFKRALGVTTGILPWNFPFFLIARKLAPALITGNTIVIKPSEFTPNNAIAFAEIVHQVGLPKGVFNLVLGRGETVGQELAGNPKVAMVSMTGSVAAGEKIMAAAAKNITKVCLELGGKAPAIVMDDADLELAVKAVVDSRVINTGQVCNCVERVYVQQGIYDRFVNRLGEAMKAVQFGDPATRDDIAMGPLINAAARDQVAGKVRSGGAGGAGGAGGQPLEGKGYFYPPTLLLDVRQEMDIIHEETFGPVLPVVAFSTLDEALATANDSDYGLTSSIYTRDLNVAMKAIKGLKFGETYINRENFEAMQGFHAGWRKSGIGGADGRHGLNEYLQTQVVYLQA

SEQ ID NO: 21256 - protein, 288 aa, Oryza sativa (japonica cultivar-group)
MYKQGGGGGGGGGGGGGAGLDRKRISDALDKHLEKAVAAAAAAASPSTSRGSAGGRGGGDHQRLVVPSSASSMPKGRCSEGESESDSEASDVSGSDGEDHSWISWYCSLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKPSQRYVPRVFGFKLHKP

SEQ ID NO: 21257 - protein, 549 aa, Mus musculus
MCAAEVDRHVAQRYLIKRRLGKGAYGIVWKAMDRRTGEVVAIKKIFDAFRDQIDAQRTFREIMLLKEFGGHPNIIRLLDVIPAKNDRDIYLVFESMDTDLNAVIQKGRLLKDIHKRCIFYQLLRATKFIHSGRVIHRDQKPANVLLDSACRVKLCDFGLARSLGDLPEGPGGQALTEYVATRWYRAPEVLLSSRWYTPGVDMWSLGCILGEMLRGQPLFPGTSTFHQLELILKTIPLPSMEELQDLGSDYSALILQNLGSRPQQTLDALLPPDTPPEALDLLKRLLAFAPDKRLSAEQALQHPYVQRFHCPDREWARESDVRLPVHEGDQLSAPEYRKRLYQIILEQSGNSRSPREEGLGVVASRAELRASPARTQSLKSGVLPQVPAETPARKRGPKPPRSPGHDPEHVEVRRQSSDPLFQLPPPGRGERPPGATGQPPSAPSGVKTQVRAMAPSLTSQAEAQAANQALIRSDPARGGGPRAVGARRVPSRLPREAPEPRPGRRMFGISVSQGAQGAARAALGGYSQAYGTVCRSALGRLPLLPGPRA

SEQ ID NO: 21258 - protein, 223 aa, Giardia lamblia ATCC 50803
MPFGTRYCETCRLICGMGREGRPSFHCARCGTCRQGLPGYSEHCERCGTCHTVALGQVHACAPDPGNCVYCLDGLRDNIYPYIVLPCGRHSCHRHCYEAVFRLGGANYKCPVCRRLVLFGQDRELYEARLEELRGSLAVPPEYRGVFVDCACHECGGLFVARRHHLYRCPGCGSHNAAERGLFRGAAADARRAIALQARSGAFTRTGRQGPPPAGPGIEYDDK

SEQ ID NO: 21259 - protein, 477 aa, Giardia lamblia ATCC 50803
MPKDKHRSTLSQSEKAFLKIEKNCPMNSQVANIPVDPREHKTALANFPPSFSFYDSIPCLYGSQERYEIGRKLGHGKYSDVFEGYCVDTDSSVVIKILKPVRRKKIYREIKILTNLLAGPNCINLLDVVSVRDSDYPALILEHGGLSLAHSVQMLNDEQIRIVLFQTLRALEWFHIHGIVHRDTKPGNIAYDPTSHRLKLLDYGLAEFYSYGTPLHHRVASRHYKSPEILVNYQLYDYSLDIWSLGTLAAGLIFKRHPFFRGTNNINQLDKIVEVLGSADFFAMINKYNIKLSSSRTYDLQGYERMQFDAFTNHDNHYLVTDQALDFLNKTLVYDPEKRLTVREALLHPYFDCIREKITDMAIEEVNDAKKIMELEEIEQQLKPAKAEKVEDPAGSGSCSQRPPQMHSILGLSPSALPTWKTDLKTQHFPVPMLPSELSKNPSKYSQFDKMWEEYWKTQQMKLVESGMQVYGSQITS

SEQ ID NO: 21260 - protein, 482 aa, Giardia lamblia ATCC 50803
MDNDRKQLCERLIKKVFQFAELKASRIQRAERLEQKIASINATPAVEEELKADLRKREREYLRLMRRKINVNLFEKIKMLGKGAFGSVWLVREKSTQKYFAMKQLCKDEMIRRGQVEHCITEKEIMASSVSDWIIRLYYSFQDDLYLYLVMEFAIGGDLMGLLIRVDLFPEPVARFYMSQCCACINEIHKNNSFYRDAKPDNFLISESGHVKLSDFSLAKDFKSRPGTMEVTTMSDEHLGTGSINPLASPTLSPGLSGTASSLRSEATGSITAPSMTVPDNVGIMHNRAYSTVGTLDYSAVEIVRKDPGGYGHKVDWWSMGAILYECVFGYPPFGSDNPRDSVKKIVKYKQYLKFPADPKVSPECIDLIKHLICEPEERYDFEQIKAHPWFANVDWNDLHSYNPPFKPNVSSEVDLKYFDFVNEAKDGGPVEALPECKEQVKWFSPPTFGNYTYRAFPGTVDLRTNANNRTNVKDLFKPPGN

SEQ ID NO: 21261 - protein, 930 aa, Giardia lamblia ATCC 50803
MPVSLSWVQVTTPGAPTPRYGCSMVPTADGIQIFGGYSTHYLNESLSFQSQSEPKKWRLRRRSRPYPAGRRGHIMVGLDECQLLFGGDLGSACVNDLWICTGSEWRQIFGHSDTGSSPSGRYGHAGCVQNSCLYVFGGADRYQQTSMFGDLWVLDLTTLRWNRGPEGPSPRYGHSMVTVGKDIFVIGGMTQSGLAGDVWRLCVNESHALSWVQLDPVSKTQIFPPRTEFFATELSPSSVLLFGGSSAQAPLNDMWILNLNTQQHLYTPVCLQIPSTLPVPRHAFGAITTSTGTISSAHGSEIAAEFGGRDQSLIWLTDLGSVYTPDHTSSSSYTLFNGSFIKLYIFGGRGADSSLNDLWECTVCLLEETAMTYGIQETKLTDRNRLANLGTSFSNINYPPNSDIDLYRSGDSFGEYNSRTLGAPSTDIYISHLTEERSFLYDKPSIQLPTDSFKPNVPRFPEAQEEKEKSSITKRMSSAKDNDVHKASFMEHASINDPSLLSNNISREDHDANESITPFIHKPQQALVRETLKQQSRPSSGGTGSPYRMTTSNPDQPVQPTDEVQKYLLTQMVTINENLLKMEAAFEAAELARKFSEDLAEQSSAVDDLALAVSEFKNDVMHAIEGLSQKLSGYAITQQGHEEDIVELNGKLNELDNLIIERASDTTRDELFMEMQVRIASLTKENKALTARLTNVESLLIATTLANNPTDEILALLNAVVNQSATLPLDITTQPVTGVSKESLKPDTATTSASSQVTGATLQGVFDELQEMGKKLNALSNSIGTKSQLSMLPSDIGDEKVTIQFDQPRQRGQPQQARQFQTPYRNEQMAPHFDSQQRMQQRVEPRTRQGAVISPRSAVTRTSAMSRSSGSLSTYVAGEDQRDTGRPTSAFLSAQGRPRSFSASTSRKPSNESLAMIAKVLNAPDELSDD

SEQ ID NO: 21262 - protein, 308 aa, Giardia lamblia ATCC 50803
MSVSAAPSATSIDRYRRITKLGEGTYGEVYKAIDTVTNETVAIKRIRLEHEEEGVPGTAIREVSLLKELQHRNIIELKSVIHHNHRLHLIFEYAENDLKKYMDKNPDVSMRVIKSFLYQLINGVNFCHSRRCLHRDLKPQNLLLSVSDASETPVLKIGDFGLARAFGIPIRQFTHEIITLWYRPPEILLGSRHYSTSVDIWSIACIWAEMLMKTPLFPGDSEIDQLFKIFEVLGLPDDTTWPGVTALPDWKQSFPKFRGKTLKRVLGALLDDEGLDLLTAMLEMDPVKRISAKNALEHPYFSHNDFDP

SEQ ID NO: 21263 - protein, 581 aa, Giardia lamblia ATCC 50803
MPLVRRKDPNSMEMRFMPRNKACRKLQLTLGEFRRVCIIKGIYPQVPPKKFAGDTSYFLRKDIVHLFHDPIIPKIREIAAQLKRIKRMKARANVLEAKLLQAQMPIISLDHVVLERYPTFKDALSDFDDALCLLFMFSRLSSEHAPQKIIDNCKRLCREWDAFIAATGCLVRAFVSTKGYYYQAVVQGVKVTWLVPHRFQLDVPDVVDFKVLKSFVEFYQTFAGFVLYRLYSVLLNGYQYPPAVQEEADYILRLVGNIRAHATASEVDLSLIYGPNGCDEPCDKNGGVRNLNPASVKPFIGQKHAISREVPREPLELVLLSGGADVFTYSSPPHGATHIIVDRPPHNIEGVVGARIDGCAYLQPQWCFDSLNWGTTLPHAEYAPGAVLPPHVSPFYDDSADADGYVPDRVKELDQLVREKNNMVDITTLSVAAVKGLQEHGLLEAKDEAAAKVSSVDSLATQLAKAHATSLREELNLGCDEQEASESESSEINPDDFYRKDTRTLDAERLSEETRMRRAMLNATKARIYDRMVKENEEIARRRQELERRRDELRHTIELEKAKVAMGVDLRPPALPNEDEQ

SEQ ID NO: 21264 - protein, 466 aa, Giardia lamblia ATCC 50803
MPSEAFLTDTLNLGVDDIPAEYRTSFLLATLFRVKPGGIWTNEDDRITLRAFPEAVLGDVCADAIVELDASIQPVFPLSFYNPTHTCLQMQNAFNLKSNSLDERVKVLSTCRDDELVFKCYTKQYGLGCKHYLCKCQVYCVACDRFYFCRQCHNEAHRNHDLEYIDSSHTTPQIKCVLCGAVSPPTSICPSCGVNFAEYYCPMCLLYCDAGQEMHPRGHCSTCGVCVLYNNTLPGVEDRCQLHVSNDAVDEDLCQFCMGSVDNQRNSFLMPCGAHYAHTQCYTRSIAECSYQCPSCKKLILYSTMRAEFEVRMRELFEITKRPPEILTNLASYICYECGESFVDQPHIVPLRCWNPACLSFNTAPIDDKMTSNMRRQIFEAQNQVFRRMKLVPLEFNLERALIRMVYNLTERYGAEIRAHFNLDAKMPLGERYVVSYLSELHPDLFRGVASRDDLLERLQTFLNRK

SEQ ID NO: 21265 - protein, 403 aa, Giardia lamblia ATCC 50803
MSSFPFGIRVWREGKVMLNFVCTTLQRVHVNHARRSTFSKTKRRCTPLMLSFCFIIRNAVRRAKNMSRKKIGPYEVTGVLGRGTYATVKLATDSRTKEEVAIKIITKSGQLTKKQLKHIRTEIVVLRLVSHPNIVKLKEILASKNKIYIVMEYLEGGDILTALRENDFTIEQVRRYFIQICSALEYCQKLHISHRDIKAENLLLRKGRQSVVITDFGLSALTEDAEDDDGQGGGEQKAPGTRGSKLLTTACGSPHYVSPEVVSKTNVGYFGEKADIWSVGVLLYLMLGRTLPFQANTLEALFERIRTGQFSFPEDRVKKGYFTKESMGLIISMLNIDPAKRPSFTQILESDYVMQDKEYLDSYREECKQIYGEKQDEIFKKAQRIMSGEEKIEENNEFNEEVE

SEQ ID NO: 21266 - protein, 1104 aa, Giardia lamblia ATCC 50803
MSTDAITSSRFYPYLADLKSIDPNIYTRAAMAIRMQVEKDSRQMLADPRTLFISDLMSFIRNLATSSSYEDRLASLWVMRELIQSRPTISMIPLTYFEEIALELVNDPSEVIILTNCVFIGRLINAEGHGIDFVPKLFVISIDKIKSGDSTKVYTGMLLFNDLTEVETSFAIDISSEEFLEPIWHVITETRNSNIKEVGFKAINKFISYQKKATKHDVLVRLITMIRAALDGKNISEQLIALHLLLNMLNLSVKDKSIADYFQENYSSFFSLVANIFRSKTSEGRMLVASIISLFAKLDPERFCTTERLQMILTFYKKMIPTQQELFIPLGEFVIVIGEKHVKPIFNDLINLITSSFKSQNFTKAGSILPPEPLKCIQYITKGAPNLVQKHVTSILECIFSVGLCESLTSALQDLSANLHNRLLDIQGLLLYLVANELGGINLFLSNAYGVIDGSEDYYLVLTENQSQAVADGHDSGVLDSQTSIIPGTRPSTTQATTHVEDTRTNEDAIELAHDLSITGLKEESEQCDFKNSLSVYQTVTTSAGITALYKLSDRIATALGTSKLRPRRHSTSEAILLAFQALYDFDFSLFDLTIFAADYLTRYLRNDSSTLRIKAAQTILKLMSEDHFEKIRRGKHSQYKSMTIKAEDCHSWAGSTLGEAPTPSGGATIIPPAVVSNQSFATTISPKTRHIRTHSSSHLDDMSSTSFCINQDCILSQDILKSSDLGTDGFFNSGPYRHMLISDTLRQIIIIGTTDIDPEVRMSIIQALTTTNRYDIYLVHESSLRTLFIALYDDNIEIRILAVKLIGRLCSLNPALVTPEIRHLILVLLTELRLTTENNKRATSNELIVKIFKFCGSIVLPYVPMVYSAVMGLISKDCDDEYLLITSLTTLAELFTIGSTSMVHCLAEVIPLLITCIKEETSKTLRLTTTRCFVRIVEATSFVVFPWFIYHDLFTIVFGILKNDTSQEIRLEAAKLITTIGAIDPIFYQNGKPDLSALVPPTNLTCKCQSTDVFSLDYIMDESNIWVCHKGEGGAAQEASIKSHGKAVVSPITGHVVENVYIMKLDSGSEVSANVSDFELTLNVIMSTLYSILSESTLEHVPL

SEQ ID NO: 21267 - protein, 1525 aa, Giardia lamblia ATCC 50803
MMQREGGLEPGAAVNCSAESTLERIINKVVSKIVTKALTEAKKISNLNQSIPQQLVSYGSIGGIFVEGRPVMSGPEGSVLQVDYNEIGIYLSALARRMLKSKLTYQYPTFLMYEENLFQSVLKTLRYKAQGHMQDLYGPSPKWFENVCLWDKALSGYNRQIDQLKLSLKSNTSEARTLLPMLVNLTKDKIRCLFALADYSAVQEEADQLLNYLSSESKEEAGLTTVKHTLIKGFQADIATYAAWSLLEQDQEDVEIWLRVLPEDNIDGTIIRATSYIKANKMLEAHKLLCKLRLRIDPDLIGLSAESYTRAYNLCILLQTITELQNIISYKLALNGLKLDAPSTLIKEGGNPYENIFETTLISFNPPPGFADTEKERLRLMWSRKISMIRWDCESWEALLRVRRLIIFPIEDQEVWIRFSVLCLQSGRVQLARKTLETFINSSSVHHIKVSKSRGLYTLLGLTSFGTPRRYLKHGSGDVSTGGSVTPIGSALGAEMGVVQDLSAVGSSLAKYLLKDGVVKDAFTAQQHVALPTSDVLSIASHSVAKPTLQMIANASTHQGQSIEKETPLSIVGQQCDDAKRNAQRDLFNALIPPLNHVYPHVLYAYCKHLWVSSNENVLEKLVAFTHLIRLCNDVSIQKTEPKLVCRMLIRLGAWYSDLLTPLDHKSCSMIGTISPSEGYVNIPVQDTVTSCSAIWNSIVNNCDADASVCSTTYEATEHSAERLELSSASTLDKAVAKLVDNILLAYDELSNVSLEECNQYNTVGMSRIGLIALEWFQVAADRDETSNHIWKCISHTTYAIVNSFAAYIDKLNDRPGVDGGLQIVTRRSSVDATSDAVGSTSEALSQSVQDSDRPLVCPEHLGFVQNRQVLLEKAKLEYLVESIIAHFKCIETGRSIEALPTTLRLMTLWFRYGSYDEVETEIINGLAAVPINIWLDVIPQLIARLHSPQHKIRLLVHQLLVLIGTEHPQALIYPLVVASKSTILNRRVESLSIVDQIRRTNEAMILESLNINKELQRVAILWPEIAYDLITQASTAFCEEPRDLVKFFNYACQLQLLASRTPETQSESVFIQMFSSQLQAAWDSCRQFPVTNDLVCLNIVMKHYKEIYDRIHSELPFLNTIDLLQTSPLLYNISNTNLCVPGSYHPARAITTIVKFYQKVFVIRSKQRPRKVGLVASDGEYYAFLLKGHEDLRQDERVMQLFTLINNLLMNDSYCSRRGLMVMKYPITPLSQNSGLLYWVPGCDTIISLIKEFRQLKRIHLETEMQQIKYRAPAFMNMALHYKVDAFKYMLTTSDAIDLCRSLWNKASSAEDWLLKRMNYTRSIAVSSIVGYILGLGDRHPANLMIERTTGMVLHIDYGDCFEVAMHREQLPEKVPFRLTSIMMKAFESCGTEGSFRMTGEATMSILRSNKDSLVSVLETFIYDPLMSMKVLSGENTMGGKENIDGNTEFYGTRRPVQESYLEGNERNPKAVKIVQRIYDKLTGYDIKYIDRSLSVSEQIQSLIHSATNAENLCQLYIGWCPYW

SEQ ID NO: 21268 - protein, 360 aa, Giardia lamblia ATCC 50803
MSDDESIDRHVLRKYEIIHRVGKGAYGVVWKAVNRKTNETVALKKIFQAFQNDTDAQRTFREIMFLQELDHDNIIRLFNVLKAENDKDIYLVFEFLDSDLHQVIKSNILEDIHKRYIIYQCVKALKYLHSAEILHRDLKPSNLLLNSECHMKMADFGLARSIAALSEPSSATNPILTDYVATRWYRSPEILLGCTRYTKGVDMWAIGCILGEMLGGSPMFPGSSTMNQLDKIMEVTGRPTPEDIEATESPFASMMLDSLQPKTGKALSEIYPNAPADALDLLKKLLQFNPNKRLTAEQALEHPYLSKFHDPATEPSAPGPIKISIDDDDKRSVSEYRDLLYSEILRKKKEIRSKSLKEDE

SEQ ID NO: 21269 - protein, 394 aa, Giardia lamblia ATCC 50803
MLYSASDVERVPTDSRICVLLTTLFTVPPGGDPAEPSQRCPRKTFISAILEGSGRGLQGSWEEVAEPVCLLEAYDPALPYAIRVAAGAGRVARDPTLPASHYLYAAHKQGLSVGCPHYVRGCLLYCAVCGERSPCRFCHDASHDDHEFPRTRTAEVFCLFCRATGPIGLRCTHCQMPFGTRYCETCRLICGMGREGRPSFHCARCGTCRQGLPGYSEHCERCGTCHTVALGQVHACAPDPGNCVYCLDGLRDNIYPYIVLPCGRHSCHRHCYEAVFRLGGANYKCPVCRRLVLFGQDRELYEARLEELRGSLAVPPEYRGVFVDCACHECGGLFVARRHHLYRCPGCGSHNAAERGLFRGAAADARRAIALQARSGAFTRTGRQGPPPAGPQTG

SEQ ID NO: 21270 - protein, 377 aa, Giardia lamblia ATCC 50803
MPNFSVMLLSSSTSLYALKISASSESIHSERVLNACPQLKKNQAPQMSGRCFTFSAHGPLYGLSWSCRTDMPMRLAISTISDACPNEFSIISLQKERRDFRVVASASVVYPLSKIQFLPSKDVSNPDLIATVSDSLRIFEIDNLKDDGRAELCSRGRLLVNETRPVPILSMDWCAHSLNIIMTANLDTTVSLWDIYKQEVDIRFVAQERAVTDCCFSLKDPNRFLTCGAEGNLRLYDRRRMHVANEIYTGNEAILRAQFKPTDSNFITCFGEKSTDIILLDARSTVKPLARLKGHTDYINGISWGRDSHGGYFVSVANDGRALIWDGGSGTYTPFMEYVATSASGEPLGPINSVDWNQSNHDWVALTVDDEVQILHV

SEQ ID NO: 21271 - protein, 326 aa, Giardia lamblia ATCC 50803
MSAAPLTAKQARRQAYVAKLERCLTEYKKIVLVSVDNVRSFQIAQIRRLLRGKAELLAGKNTIIKRVINQLDDDKLKNLLPYIKLNVAFVFTNGDTSAILKAFKKTKRKAAAKAGIVAPADVVIEPMLTQSGPDQHGFYAALGIDTKINKGKIEIVNPVNLIKKGDIVTPSHATLLQRLEIDPFFYAMSALNLYDDGEIYDAAVLEIDDSVMEAKWNAGLEAFVSLALGANFPCLPAIPHIFMDTAKSFIGAGVEADVTEIPLVKRVKEILADPSKFAVAAPAAATAAAAAPEEAKKEESDDDEIVGAGGMFGGDSSSSEEESSSD

SEQ ID NO: 21272 - protein, 412 aa, Giardia lamblia ATCC 50803
MGDQHKGVPKVDLKDLMDGDIVSEEFIDDYKKVSSCSGNCSSCQDKCKQFFKPKQRFKVSLQEQNVVITAKLMRFDHIIFILSGKGGAGKSTLAIQLAYALAEHYDYKVNLFDADICGPSIPTLTFTQMADTNIFVENLGWDPIPLTDRIHLMSAGYLVGDKDTPIIVDGDGKEEFLREMLFNTNFEFCSSREREEGCKNVLIIDFPPGSSEEHLVMTALVRRCLMSDSMVRLSSSGVLSAGHVNSQDQSSIFGDIGGRLDGAINTHERHEAAKSLLAASAAAGTKRHLPTIYSLIISTPDEVCLSDVRREVLFCRTIGLAVRGLVQNMSGFVCPHCGTNTEIFVPLTGGCERLSAETGIPLLGSLPIDLSLCEAAEEGGSWQDYVSTHGRVGYDKFLEVVRLMLESNEKSV

SEQ ID NO: 21273 - protein, 313 aa, Giardia lamblia ATCC 50803
MQYPPRLGFGTWQAPPEAVQTAVETALMTGYRHIDCAYVYQNEEAIGRAFGKIFKDASSGIKREDVWITSKLWNYNHRPELVREQCKKTMSDLQVDYLDLFLVHWPLAFVRNDVGDLFPKDAEGRAMLEKVPLADTWRAMEQLVEEGLVKHIGVSNYTVPLLADLLNYAKIKPLVNQIEIHPWHPNDATVKFCLDNGIGVTAYSPMGGSYADPRDPSGTQKNVILECKTLKAIADAKGTSPHCVALAWHVKKWNTSMYSVIPKSQTPARIEANFKCTEVQLSDDDMDAINNIHLNKRIRFCDPAIFWKVPLFD

SEQ ID NO: 21274 - protein, 301 aa, Giardia lamblia ATCC 50803
MVVEPPTLIECFKGSSKPVRTCSFEAESRQLSSAGDDRTIMIWNLTPPIRAFKFVGHNDTVVGSAYCPTQSLLATASFDKSVRLWTPNIHGNSIFRKVHTARIRDVSFSIDGRTIVTCSDDKSIKLFDTTNVQFRVCLSGHTNWVYSARLSPDGRLIASVSDDLSLRIWDTRTLSCVQAITNDNGLSLNPRVIRWSPDGTTVATGCTQDVQLWDVRSSTLLQHYSCHTNQVTCLDFHPNGKYMISTGSDGTARILDLVQGRSLYTVRGHEGGVNCISFCPDGSVFATGGDDGRVMLFELGV

SEQ ID NO: 21275 - protein, 228 aa, Giardia lamblia ATCC 50803
MSLGVKDVRDLLDGVRAIIFDLDGTLLDSTGAWDTVNRSTFLTRGMDYPDDFMDKISGKTAIDAATYCVKEYNFNDVTPEELADKWKDIYIELFRTQVSYTPGAIEFARVAKSRGMLLAIGTACPHGAIDAFFSGRPEDRDLFDAIISCDDVSASKPDPAIYLECFKRLSISASEALIFEDSIHGLEAARRSGARAVAMLTGPRPPTDRPDLSIHVASTFTELLSVNQ

SEQ ID NO: 21276 - protein, 123 aa, Giardia lamblia ATCC 50803
MFLAGKFGMCPREGCKDCPLLPVGASNVPGVSPLGGYCVYCKDVYLPLSHDVLKGELVDGSFYGSSFPQVFLSRYPKLESKLIASLDASTNSDSPTYYKDIDAKLSKENMHLFGFKINWGLVE

SEQ ID NO: 21277 - protein, 238 aa, Giardia lamblia ATCC 50803
MEEGGSSGSYSDEQEDWLTAFLSQGGFRRLLVEVPEYYLEDNLALYGLEPEIKHFSEALKLIRNEPQTTDVDEMAVSKAAALLYAHIHARYILTPQGLEDVRQKYERCEYGKCPRYLCSGQRLLPYSAVEKPGKDVLRCFCPACHKLYKLYNTDPEFFIDGCFYGPSLVPMFILTYPNIMPPPSQQYIPTLYGFKLFNKQSRGKNIHPAITFLKSKDPHFAKLMNRKYIECNETESKQ

SEQ ID NO: 21278 - protein, 467 aa, Giardia lamblia ATCC 50803
MFSYVCYCYYRVNKEDRVLLRHYVVRPANSSFTPSSTPIMLFSDWRDDLTFEDLNGLSLQNDQEVAEDIVYLDVIQETVNGCMHYPLNCRVICPKCNKDYSCRLCHNDDFESQCDELDRFAITSMRCLLCDKVGPIGLRCTHCKGEVAKSFCPKCNYISLISPEVKPFFHCESCTFCRVGKQGEHKHCDICRQCYKKQFFDTHKCDATDYVCCICQEELKTSIYDHTEIGCENRHYIHIKCLNSLIRAGNYTCPLCRKLFLKGKSLEEVTSQCSIFFMLCLLIRGYVTPISVAATDPSALETVDTSKASSSSDQSEEEDETDSESVHQDQEQSSQENNDTTEELFYISRELSNKVENLFTMKTAMFVLNIDLFTRTERGCGRCRQCSKCFWFPNLNISDIPCVYCGLFNVDVISPTEASSLQTESDFSSTWHEYIEGYRLNVAKHTAYIRNTLAYLTNHFAQFLQAG

SEQ ID NO: 21279 - protein, 776 aa, Giardia lamblia ATCC 50803
MFSETIGRLYKNHVVIGNGSFGKVFSAQRVSDSKTVAVKEVDTTGAGLAERMIILAEYTYYPHIVDPNVVTCYTTHFDKESGQLYLEMEYCPGGSLSDLIKSQRVRKQPLPERTIWQIFKGLASALVYLHSPEKKPTVGAIIHRDIKPTNIVFTKDGIAKICDFGLSRGLHELSMASSRVGTDAYMAPEVNDGEYNEKVDVWSLGCVILELCSLHKPKPRDPIILEAYSPQLASILRNCLTVSPDDRISSARLLHLLSTQESEALSRKPSTYYGLDDNDEDTEEDAGDLELREQKEKIRAQEQMQQECNAEAVVEENENARTEADAEMESLVFFDQNITLPTTHSTEAEDDNEHCSQLDATSVIHEVPELTATSILKQLDFASKDPELVRSLLLQYASALETRDNEIAQLKGLLSFQNQRLPLSTARPSIETPICMSTDTHAESIDFTVKEPTQFGTITEKESICPSPRSFDCSMGIVLDDLVANQHRLKTNIEIDILQRSIKAKDAIIDSMKKQSEADAKGTKVFIDALYKDINTLESEVREKNIIIDELCEAIEKNSTLLDSAKRRGSLGMSTDGSFTDRSKSATPEGRRPRRNSLYSSDMADKEQEIQHLKDELIKQQAESAALREQKFIKQECIIQDLTASLRAATAEIDSLRQKVALQSPVQSSLSSSTLTVVKMPSLELSQYVFQINELEQIKETLSEELEAKDSTIQQLREAILHQEISFTKLREASEATQAENRKLHDTIRMQAGTISALVRKRSPQLSSNASPPGKQ

SEQ ID NO: 21280 - protein, 89 aa, Giardia lamblia ATCC 50803
MEDIEKPSITIKNWYAVVEWSYNIDEANCSICKSPLSELCPECADLLTPVCRSVRGRCGHEYHTHCIQQWVDSNKTCPLCMADWVVSEC

SEQ ID NO: 21281 - protein, 291 aa, Giardia lamblia ATCC 50803
MTDPLNRYERIQGLGEGTYGVVFKAKDKETGQIVALKRIRLENADEGIPATAIREIAILKEMKHKNVVDLLSVIHTEAKLTLVFEYLDMDLKKYIDSKQGKLTPKEVKSFMGQLMTGLTYIHNKRVLHRDLKPQNLLVTSSGLLKLADFGLARGSGIPVRSYTHEVVTLWYRCPSVLLGCRKYGGALDIWSCGCIFYECVTGKPLFPAKTEKDELIKIFKTLGTPDKQSWPDVDTLPQWQKDFPVYPGINVAELLPTLDEAGRDLFSKMMALDPSKRPSARDCLKHPYFAK

SEQ ID NO: 21282 - protein, 432 aa, Giardia lamblia ATCC 50803
MSSTTTGSSTVRVRVKRVSNYITGKSLGVGTFGDVRLATHLITGERVALKVLDKSRIQCEDDFKRIVREIQVLKLLDHSNIVRLLEVIDTPRHIYLVTEYVDNGELFNYVVQKQKLSEEEACKYFHQIVSALSYCHSRKVCHRDMKLENVLLDSSYNIKLIDFGLSNILMSDEAKFKTACGSPSYASPEMLSGKKYHGPSIDVWAIGIILFAMICGHLPFDHDNTETLYKKIISGVFHIPDHVSPEAADLISKILVVDPDKRITLDEITKHPWYIQCYTGPEEPNPELKMSKVVDFRIIYTMVTKISDWSATKIIRSLNNNRHNQMTATYFLLCERDIQVNGYKWNFDEQRKYAEALNFELEEDGRLIKKSDSGAKVEDTNADVAEAIEDSHSDPNLENILKIQREDTQSDRSLNDLASEQGYGPGRSRLQK

SEQ ID NO: 21283 - protein, 1401 aa, Giardia lamblia ATCC 50803
MLAKNVSSLYTDCKKLAEGGFASLFLVRRAQDRVLVVVKEASASQDDDAKAIKSARNEFNIVMRLSSPYIVNYYAVRTHDNGSIYHIEMEYCSGGSVQQLIQRIRSARSKLPESAVWEIVAQVLKALQYLHSWCQKGYLGIVHRDIKPENLLIDTRGLIRLCDFGLSMALQAGNPPAAAKRSGTTSYMAPEIQALGAVTTISDIWSLGCTIWAICTLKHPRFSRRDLLEGPVVDFLGYTTPLRKFVRLLLQPDPKARPTAEQLLSDENVVNALKRIDDGEYYDIYPPQDLIALYEEGTVNHCGPYSPAKESILASSFRRATSTLQECSVVLSTHTDQCQTPLMAAVSKGDHVSAQNLLMHAKKVDSEGFSALLYAIEVDSLPCVQLLAALEFYINHPNGDSPLIYALKSGKIELLSELAQHCAGSLDASGNTALCIAIRCNDLPAIELLLPYELLLKSDNTLMALDVAWSCLLLHNTMPWQMLTDYLLKHHKCYPRAVSLSGSPKYVDQKTKTMLLVEGNIGTAASEHTEITEEDLYAVLPCGRTALMLAAQKNSAQYVQFLLPEAGMSTPVGETALLLGMQAQSMRAVEILWKYESFLSKATELMRICLLAEQPNKLHEHDICCRATDGSTALMYAAVSNNHAAIRMLIMREMRMHTRNGFTALMMAARHNSLDAAKELLPYEARLTDQAGMSALMHASQCGHVQLVSLLATYEDGMQDTMGRTAFLHAVANRHSGCVHALSSELLFPGIGGNSPLIHVLLKYGVEHCQEIFTTDMIIASAGLHNDNGQTVTMIAASLSATDIVKLLAPIEAGMQDGLGRTALMYATEVCSLDVMTILLDKEEKLQNTNGETALMLAVRSGYSRCIHILAPREASLRNNQYMTALGLAVELDLPEVVTILAPYEASISVRKNESVIDLAVSLGHANCVAALANYMSENCISIPLTQRSPVISGRTPLLAAVLSNRIDDVVTNLGFMGYGYSLSKTALGKDVICTALQLSVRLNHLDCTKLLLSEIGVYVPGSETALMQAAHMGLLESARLLLPEAGAQTKEGYTALMLAAIGGHSEVVKLLLPFETKMKTTAGRTALMLASAYAKEDCIALLVEQEARLCDHRGVSALMCLGRISNAQQISTLIAEELYLQDCNGYSALMYAVIDNNMVLVRELLAELPLKTHLGETALSLAAVYERSAIYDLLVEYIVDNNIALQIPKRAISTSARTELISAVLANDRSRVVQHLDQVFKAYQGYTALMYAATYGYVEIVEILAPHESCIRTRKGCTALMLAAKDGHVDCLLHLRPYEQQMAMLDGTSSLMFAALAGQSDCVAQLLSEVYMRKVNGDDVISLCENELEHEDLPEEHLYAIRRRCLPLIYARLTEDQADATAKDCPGILDTNDQDGNNLH

SEQ ID NO: 21284 - protein, 372 aa, Giardia lamblia ATCC 50803
MLRNLIHGLSVYNHRENKMPCCGGGSNGPCACRSGTRDVEGDSAVGLRMSGPNDPTPEQISLKGECAPEKCSGCPARGACSSRGADNSTSVAISERIQHVGRILLVLSGKGGVGKSTLATQLAFFLADIMGKYVGLLDLDICGPSIPTMTFTKTEQVQNLPTGWEPVSVSHTLQALSVGHLVTQEDAPVILRGPKKHGMVKQMLTETNWEFDPRFPKSNIIIVDTPPGTSDEHLSIIDMYQSTIRYMQSNGFPNVPVLEAVVISTPQEVALADVRKEINFCKQLNLRIRGVIENMSGFVCPFCEAETPVIEATTGGVKKMCEDMNVPYIGSMPLDPQLMKAGEDGVAWSTICDIETSPGYDAFANICGKIIE

SEQ ID NO: 21285 - protein, 339 aa, Giardia lamblia ATCC 50803
MTADHKCNCRSRATFLKMADQPVSASNCQPDKCAGCPSKGSCGSSTESPDNRAIAEKLKNIGTIILVLSGKGGVGKSTVSTQLGFYLAENMEKNVGLMDVDICGPSIPTMTSSQGSEVHQSALGWEPISVLPNMAIISIGFMLEKLDDPVILRGPKKHGIISNFLKDVHWHFDSEKIEDNYLIIDTPPGTSDEHLSVINMLSAAMRVLNKEKETDPSVHTPTFFAVVVSTPQEVALADVRKEINFCKQIKVDVKGVIENMSGFVCPCCNKETQIFNPSSGGVKQLCADYKVKFLGRVPLDPQLTKASESGQAWKKAVEEGTVSKGMEMFYEVVKGILSE

SEQ ID NO: 21286 - protein, 297 aa, Giardia lamblia ATCC 50803
MGWVKVQKTRSYFKRFQVQFRRRREGKTDYQARKALIIQDKNKYATPRYRFVVRRTNKDIICQVTAAELTKDRVVCAAYSHELPRYGIPVGLTNYAAAYATGLLCGRRLLEKLSVGIKENALAQLYPGLDKATGEEYHPDENENEEVHAFKAFLDIGLARASTGARVFAAMKGAVDAGLNIPHSMKRFPGYSKDGFDSSALRDRIMGKHVGDYMAELKAEDEETYRKRFSKYIAAKVEPLRLEAMYTKAHAAIRANPQAVKAKFEIKKPVRQARLTLKERKERIDAKKLEALKQLTK

SEQ ID NO: 21287 - protein, 240 aa, Giardia lamblia ATCC 50803
MTQNGASQIPENVLKCAYTRITDDLRQALLKCIDSTKKARTFGSVFAEPVDYVALGIPDYIEVIKRPMDLSTLKSNLLVGEYIFLHEFLKDAELIFSNCRTYNGMSNDGYFWKAAEEVEKFFINTISRIDGLNLTLDIYKKIVQSPIPVIPEYSELPMTVSELQIMIKRMSELPKPALTACIQYYLQRKGASAEEMAGKEFTLHFVSTDSAILRDLDKLIRKKAMEAKENKTQRAKKLKH

SEQ ID NO: 21288 - protein, 711 aa, Giardia lamblia ATCC 50803
MEQVFEYHPVQMAFMTFNVKEKDPNQLAAKEIAKVMVGSRVVVLGFQEIDMSISANIKKSKRITKWEDLLDAEFVRGGTKSSNSLKYMKLASHFMMGIVILMYIDVQLLPQMHDIEATTVSMGVGKIFGNKGGVAVSFCINSTSYLILNCHLLHGETEEDLEKRDKQLISLFHHSSVTLCTVKKQDGSTDEQNFMAADQFNEARDLRFASFLPMDRSALHRRNQENLPIFECYDYIILLGDLNYRIDKATKEDQLKIRMDSDAFILNSNSFEEEKIVFPPSYKYGKGGSLVLDREPSWTDRILISRKYNQGDNLKLNYIKYSSLQDLMLSDHKAVYQVAELCYRAVVDERIGDCLKQYCGTWDQRTREMNPQLRYLDQPQTVHRVLPSKSKLNRITLNFELVCSKSLIKHLVFEVSGLDDFLFTNKVVSKTHASVTEIVSYLDADHQMPDIKRSPTGIILSTYALTLDIDLDIPALLPYAQRVYSSPRLRDLLDKQLSIPLLVTVTPNSDAICLYKDTTIPFFVKIADHVGLYRDDLMGLMNLSLSSINASTLEIVGESSSAATTMADSSIESVENKDPSVLPLLVKLCRTNPDINDLRLLVDFLSYGIFALDCKDGVVNLLASKDPDADPASLQSSILSHLSQRLKAIQTGSERDVIMYRNIRFTLSYMRFLRDRNDQLYRAAAPAVLSSLFTLERGTLAWTDALESLLQ

SEQ ID NO: 21289 - protein, 584 aa, Giardia lamblia ATCC 50803
MVISDSAKIKMLSSDYNGSIETCLVKGRLFKLRDTSLGFEPSNREYLRDFPAYVSGEENYQKELSSLKAVQSIFPLRCYSPSKSVFAMIHSKENSLLMKNTSAGFHIPYIRPEVLSTDPRTMLSIFQKQKQYPALKVMNVGSEIDAAFTGGLLEQESSSNIGSSFTSSSNMYVSSSSQINMTPSTSSSSHQTQDTFDQTDLDEKFLAPLNDNDPDSGYIFLAGPFLLSVSERRRKEAEDPYVWVQYDVEKVTGCPHYWTGAFIVCPDCAQIYPCRICHDNLVPGHTLDRRRVKEMFCLTCNKVGRIGFRCEYCGVVVSRTFCNICNTLCMLGPEMKPTYHCQHCNSCHVGLQEMVRHCSTCRTCISREDYDTHVCDCDNMCPVCMIPFADNVMSEIVLPCNSAHKMHRRCFNDMIMSENITCPLDHKIILDRYRYGIIRCENLRRYSETQLSLNQSELVKIRVYLCHDCQRVSADLSFHFISLQCHFCYSCNCRFLYVLDFMPSELTSEIEDLALDDLEGICITAQEKCTAGEREKVRQHLLLYRKLYSDIVPTLVYLNSAMFGQSSDMVQIILNLIQAHAPAH

SEQ ID NO: 21290 - protein, 266 aa, Giardia lamblia ATCC 50803
MGSSASLAKAFKINSGGYNTYEQFISAVRDAKIECARFVVAVDFSRSNISRGQKDPKRGASLHSSKDIYGNVIPNDYRYALEKLIEVIQLFDSETEIKFLTFGMKKKLTAEQISVDDLVKHYDVMTAEFFSRIEANAEAESSTIAPVIYETIKDTVKNKDYQILIILTDGDLTDIGRDAQAIIDASNFSISIIALGIGIGPFTSYSEFDNVLFQRRFDNFNFVNLSELLRTKERADEPPLNARDFARIILSECPAQYRDIRELNIV

SEQ ID NO: 21291 - protein, 884 aa, Giardia lamblia ATCC 50803
MSTRRVYFFGETPENQPANSELCRKVLGGKGISLAAMIKLGMPVPLGFTITCQTCVEYQKTASWPEGLKEEVASNLKLLEEKMGKTFGDNTNPLLVSVRSGAAVSMPGMMDTILNLGLNDESVKGLAAVTGNARFAYDSYRRFMQMFGDVCLGIDHDKFEHALDAVKTRYGRKTDPELTADELEEVCEAYRKICVAATGKTFPQCPHEQLELAINAVFRSWTNPRAQAYRTLNKLDHNMGTAVNVQSMVFGNTGDDSGTGVGFTRCPKTGEKFSYLYGEFLQNAQGEDVVAGIRTPVNLKEMPTINASWKACYDELSLIYAKLEGYYNDMVDLEFTVENGKLWMLQARAGKRTGFAMVRIAIDMCKEGMLTEEEALLRIDANKINEFLFKRFDPSVKPVVLGKGIPASPGAAVGVICFCPMRTCELAEQGKKVILTRIETSPEDILGMDRAVGILTARGGQTSHAAVVARGMGKCCVAGADCCQINYATKTLVIGDRKFKEGDFISINGTTGEIYNGAVQTIEPGITDDLQTIMDWSDKYRVLKIRTNADTPHDAAVARKFGAEGIGLCRTEHMFFAADRIMAMREMILSDDEGARRTALNKLLPFQREDFIGIFKAMDGKGVNIRLLDPPLHEFLPHTRDLQKKLAEDMNKKHRHIHERVEDLHEVNPMLGFRGVRLGIVYPEISEMQVRAILEAACIVSREGVTVKPEIMIPVLFSENEMEIMHALVNRVAASVFKEHGTTVDYEVGTMIELPRACVMADKIAQTAQYFSFGTNDLTQTTFGISRDDAGKFIPKYIDRGIFKVDPFVTLDQQGVGALMKMAIEGGRSTRTDMKIGICGEQTDPASILFLHKIGLNYVSCSPYRVPVARVAAAIAAIKARTNQ

SEQ ID NO: 21292 - protein, 643 aa, Giardia lamblia ATCC 50803
MPKTDKVADRAVDDACPPDASREDQDTKKIRVKRVGNYIIGKTIGEGSFSKVRLGTHVLTNERIALKIIEKSKITEAADIERITREIQILKLLNHPNVIKLYEIVDTPRHVYIVQEYMNNGELFDYIVAKGRLSEKEACRFLCQLLNGLHFLHSRRIVHRDLKPENLLLTANNDIKIIDFGLSNIFHDTFMKTCCGSPAYAPPEMIQGKLYSGPSADLWSTGIILYAMLCGCLPFEGSTTQSLYIKILSGEFSTPSYLSQGAKDVLKALLTVNPDDRVTIEELITYPWIQKNWALNHDGRSEPILTELPEISSDLNFGILLQMHRMNLDAVECIRGLFLGKHNASTATYTLLAEKAEATKKSNPKMSMAAIIGINGYEKADFDNLEVKKKICEEIGIEIDSENNILHAENNTMVTIGKLKLEVSGDKVGKHLHSNTSDASTKDAVAQDPASDRGSQEKVTMKINEKDVELKRETAELAATVPVIPVGQAKIPGLGLGLNLPAGPVAGGGAVTTRNHKTEKLVDTPTVKTSSEAPEMTVEYDDGGLRICKDDITKENGVVTTVQYEDLVVRLKQVFKELRIKADSEREGSFKCERMNVQFSIDIYRIGSAISPQLGILMRRISGDGAIYKEIGQIVFKGLKLKG

SEQ ID NO: 21293 - protein, 450 aa, Giardia lamblia ATCC 50803
MSYQDLLSARLKELAAGGYMSATEVAGARDLFIRHHQGAPAPVEWCRVQALSDSGYRAYDTLPELDGPSLTKAMQKVAVLKLNGGLGTSMGCTGPKTLIPVKNQMSFLEIIVRQVSSINTKYGISMPLLLMNSFNTEKDTKAALAQIHLDKPVDITCFNQAHFPRLDAETLLPCTHITPDNQAYWYPPGHGDVLRSLISESLVDKLIARGVEWIFISSGDNLGAVVDPRIVGYLATLKGVDFVSEQTAKTIRDVKGGVLINYDGTTRLLETAQVPQEHMGEFCDITKFKSFNVNSIWVRLEALKRLADAGTPIDLDIIVNPKVVEGKRVIQLEQAVGAGITFFKSEGLLVSRDRFIPVKKTCDLLTVQSDVYDLDSEYVLRACCSIPTVELCAPLEKMDAYCAAFQCLPSLRGADTVKILSQCTIGPNVEFRGTCTIDNTSHLENCTLGQ

SEQ ID NO: 21294 - protein, 330 aa, Giardia lamblia ATCC 50803
MHCDTPCRCSRKFVLAVVLGQICAIGNSASGVFNDLLSGINVSVPFLQSMLFYGLLLFLWVLPSVHKLFVHRARDVGFFLLSGILDITANSLAIMSFVYTSVGAVLLILCLSTPFSMILSLIITKARFSWMQVMFSCFATGFAILFVILDTMGDESKHRVLGDLLAVASAFIYGLTSVINEFVIGSYTPVQFLARLSIGAFSLALILFLCFEADNIQILATLRPWWYIIGYLVSLVVMYSVLPLVIKYGGAVVFNISLISCNVYGMFASLIIFKYKYIPWIAIPVLGIIGSLTGYFLSPSSSTCCRITPISVEAAPEGTQQSQVDISLSV

SEQ ID NO: 21295 - protein, 169 aa, Giardia lamblia ATCC 50803
MEECFKEASLALAEREVPVGCAIVDSAGRILATGRNATNKTRNSTHHAEIMALAQLPSGTDLSDCVLYVTIEPCIMCAAALSIVGLTNIIYFARNSKFGGCGSVLDVNNHTARPWTKLNAKYVPDERAIHLLQEFFERKNPVTAASDHGIDELDYCLDREPRLKNQSTI

SEQ ID NO: 21296 - protein, 261 aa, Giardia lamblia ATCC 50803
MAFKSCVNRGGFKQIKEVYRSFPELTLALREASMESSQIILAFDFSKSNEWSGEKTYRRSLHDITQETPYEKVCRLLIPVITSFDSDSIIPAIRFGCSVSKDQIVCPLNPYSKSPECQGFAEVLHNYREAVRMVKLSGPTSLSPVVRYAINIVKKTREYHILIILTDGDPVSSVADADAIAEASNYPLSIVAVGLGDGPFKILQSFDTQYYNRRFDNFHFVNFTELETKFINSNRPDLLLATELFVEIPKQYRIIRKLGLL

SEQ ID NO: 21297 - protein, 915 aa, Giardia lamblia ATCC 50803
MKEGSLHDLGEPIELSVVSQYADKHEPLPGAIGAGGHQNASGVHHQMDVSVHTLTSISADLYNHNSFGRERINPVPTLSYGERLPAASSVSDKYLRQITGFDASQAMDLPALSGNLPAVSYLPSSTLPCLPLSAANMGVSQIVERAAFIAPSNLQANSDLGQNYSNGISVQSIPHIPISGLLPTKAHDFPRDGTLSPASSDDSGIGSSSFLCSMDQSSCPITSTSSAFQSSRSQSVSLAAPGPIPPSTPSLISRSFSGASRPNISAKDLQTSVSLSSQTRSATKSFTLLGDSLGGAPSQDGSSTLVASATVSEPRSLRKATTRRVECSIRKTTTERVTIRELPADGYCWRKYGSKRLPNNSHPKSYFRCSVPGCQAKRYVTETDNRVLKTEYIGEHNHGKSSSTTHEATSLADVCRLAALGQNFLIKSDLSLSVLSKTFLDLAVLLRPSIFNNDYLILNGFGSIVLDDSDKRYRDPINGHEIIEISDSIYPLSALTSMVMTFFAKGVELSNAVNLAITQLNKSFREKAMYAIRKQDSRGRNHSDDSSLVAIPGEDPSTKGSSAHAPRGRKLIISCKLPSYDQIESSIDFFRWKKYGHKPQTDTRLDSKSYYRCAFFNCPARRTITFFYSLSSDGTETVESVIVQYENQHTHPPDRTRIPYKDCLKLLKAPDHLPIQPIRSPDHPIFANPTSYLGVTGVTVAQRPVFTSLTPHMTAPIGDPAGHHPIAMQHGMPAQASHGISDINTVTHGAQLVSSMQRSDSFERTSCLLFPRVDSMALQEGLSGLHTDQSLYGCASGSPGYGASYPLATQPDCSSYSLVRSNSFLFLNQLGQAQSQLDQVIDAGHSSTVGSFGSTSKIPSITPHSIHSSNMEKDLLSYCSTIVRGDENINLTNAENESISRMHDTLLGPMVNVYS

SEQ ID NO: 21298 - protein, 264 aa, Giardia lamblia ATCC 50803
MGKAKLARDIKSLIKNYYKTYEELEAGLRKAGVESMQMVVGIDFSKSNEWTGEKSYRRALHDARGGETPYSKAMRIMSRVISRFDDDDIYPVYRFGCINTKDKSVLPLLYPDQEDPHFEGFDAVKRAYEHIAPQIEMSGPTTFAPMIRQAIEISKESNGQYMILVLLTDGDVSDMVEDMKALQEASNYPLSIVAVGLGDGPFDKMHIFDDDVRGRKFDNFQFVNFTEVEMKAGKCENPELVLATAMMQEIPSQFAFIKKLGYLN

SEQ ID NO: 21299 - protein, 230 aa, Giardia lamblia ATCC 50803
MSRQLGDLLENIKAAVFDFDGTLVDSHKIWAKIDQDLFDQLGLVQPPNYEKDIAGKRLPEIAKYIIEHFQLTNVSQERILSCWEESYMKYFSSSAQFIDGAAEFLTYLASKNIAIGIATASTHKLVELFFSNHPEIRALISCVVTSEDVVHSKPAPDVFLKCLESLGAHPSEGIIFEDSLVGLSAATKTGSKVVCILSHPDDHLEKKELSQLQINSYSEYLYQSRTLEES

SEQ ID NO: 21300 - protein, 469 aa, Giardia lamblia ATCC 50803
MSDEQPVQLGQYEVSELLGSGAFAKVRLATRKDTGKKYAVKIIKKVGLSQRAADRLNLEIAVTKGISHPNVIKMHEVIGTSSKFWLVMDYHANGELLKHMKTKLSDDQAFDYFIQIACALRYCHRFGICHRDLKFENVLVANDGHLVITDFGLGAISYNPDKTFYSQATFCGSTHYIAPEVSSGSRYDGRKSDIWSLGIMLYAMLIGKLPFPSDNYEVLVESMLNRRYDPIPSFVNDQAKNLLEALLEPDPRTRPDWREIFNYPWIASRVALVDEAGHTVDKFPSEITDTGVLCRVMRKKKVHMEIPLHPNKKSYSVLSNIHAALMQTNSAPSTAQPVSDEGFTCPSCGNIVVPPKTADIASYSVKKAIMISDISISDALILAAYGVRKVTKKPVVVYPHEFRASSDVQLMEARVFGTQKLVILIGTNDAEMYTTVSTVLTNLAADKAKLSAITLGRINDVSVVCEDAR

SEQ ID NO: 21301 - protein, 303 aa, Giardia lamblia ATCC 50803
MLDRPPCVGFGTYLVEDPEAIRSAVKLGYRHFDCAYRYGNERMIGEVFKEIFNDDSYGVKREDLWIVSKLWPNFHEPEKVAYQISETLRDLQLEYLDVFLMHWPLAIKHLADRDYASSDGKGGTLLGTTPIRKTWEAMEACVDKKQTRFIGVSNMGTAMLVDLLSYCRIKPFTNQFESQPYFPNDRLIEFCNSNGIYVTAYRPLGGRCRVDAKAPLTDPALEELAKKANLTVSELILAWHWTRWGTSGTYSVIPKSSDRERQKQNLESVKLRLTPDQMDAFARLGCVHQRTCFTSFASVPLFD

SEQ ID NO: 21302 - protein, 341 aa, Giardia lamblia ATCC 50803
MPLDDESQSVHTFEQPVDNVEEMPQALINFRHANPDKETDILDIDLIDKDDIQACAEYVREIYEYLLQSEGKYMLGSDFLSNQIDFDAEDRTLLVDWISRCHTRFNLANESFFHCIAIFDSYLSRVVVPKASNRLVGICCLFIAAKYEQSYIPSLRHFVEALTQVDPEFLVNCKCEGNRSGPCYRCSREAIIDTEESILHTLDFQLAMPTILTFLRRYARISEMKNRDRYIAFYISELSCLTTSIFKFKPSEIAAGCIAMSRRLTRKPTWDETLEKYSGYTESDTKKVMAEISTIMKKYACNPKARYIRRKYSQEDRFYGVSLMIETVVTQALTLNTKEAK

SEQ ID NO: 21303 - protein, 448 aa, Giardia lamblia ATCC 50803
MSVLTRASLVEYNLLPIGKGADISKVIVDAYAKSGREAVCVLNVSEIERHYNIWKTHLPEVQVRYAVKCNMHPLLLRSLHLLGAGFDCASPAEVRAALSAGCPPSKIIYANPQKPKRSIEEAFRLNCNTFTFDSEHELLSMLESTPPGKVGRFVLRLLPPDESSSICRFGVKFGASPSECYRLIRLCKHLGANLVGFSFHVGSGCGSVDSFRLAVQYMGEAAKFAKEQGFTLTVLNIGGGYMSKGAERHYDEPNRHAHITPPSFEEIASALREEINRIKVYFTNKSEDLEIMAEPGRFFAGDIMTLGTRIYGRRIIFDKIEDNSCLTEKEIMESGKASINEVKYYVGDGVYGYYNAILFDHVVPHLRFTDKHGNRKELSGAHAGSSLNTSSIFGPTCDSLDCILKERKLPLLDVGDWVITDAFGAYTYAAATEFNGIPHVSVVCCIEE

SEQ ID NO: 21304 - protein, 248 aa, Giardia lamblia ATCC 50803
MAEAFTREDYVFMAQLNENAERYDEMVETMRKISGMEGELSDKERNLLSVAYKNVIGPRRAAWRIVSSIEAKEKGRQKPNAKRIEQIRVYRQKIEKELSDICNDILKLLQEQFVPRSTNADAKVFYYKMQGDYYRYLAEYSSGEDKEKIAGSALNAYNSAFEISQQLPPTHPIRLGLALNFSVFYYEILASPDRACELARKAFDAAITDLDKLTEESYKDSTLIMQLLRDNLNLWVTDSAGDDNAEEK

SEQ ID NO: 21305 - protein, 486 aa, Giardia lamblia ATCC 50803
MGVGASSVPGNATSEHIDGSLLPVPQLERDKLGLEAAVDQSGISLLAAGDNYDNYDNEDDNEDKRPDREFSPPKPRQRHLKYSLGRIIGHGSFGQVYLALEHLTGKLLAVKEMVVKNCSREVLEAIDAETRILINLRHPNIVNIYDIEVSDDGNKLLIVMDFIAGGSLASLSKSFKGIPEILCRRYARQILEAIKHMHRQNVAHLDLKCSNIMIGGDGLVKLVDFGTATRLARDDIINELQRRKETEADPKKPGLPSEAAKKFNLGIKGSPYWIAPECVRSTLYDIFKADIWSIGCLFIEMFTTYPPFFQFKQVPALLYHIATITEPPGLPETMSDEGRDFLSKCLQINPEARASVDDLLAHPWVAMVNLTFGIHPLVPDKPAVSGREAHLQQSIDAPPSLATSKADKLLGLFTKTKDTDVTQSTIAKNWFGKSKANLSQSIRNLQASAKIDLNEDELDSLFELALPKEDLSFIVLQHDKILDAGI

SEQ ID NO: 21306 - protein, 629 aa, Giardia lamblia ATCC 50803
MSDQEIIGDYLLGRQLGTGTFGKVRVATHIPTNCTVAIKILSKSKITQMNMWSKVEREIMIMKMARHPHIINLYEVIYREDDIYLVMEYAEGGELFSYIVKHKRLDSTTARKFFQQIISALSYLHIKVSVTHRDLKPENILLTKNKLIKLSDFGLSNVMSEGEFLKTSCGSPNYASPEVVAGTLYIGPATDIWSAGCVLYTLLVGRLPFDDHYMPALFRKIKTGEYVIPDYVDSGAADMLRGMMTVDVDKRFTIDIIRAHPWFTVNLPKHLLISFDSDPSDREEELRTTDQGQRIVDMYNALNRQSTIDDIKRKFKAGQTDSDTVCYQLIHDHIFDEIIARSFGIIGEPESNPAGANRSIFDSSSLSALGNVASGGSGDHEEDAMDPSGPVISQNPFAPPEAVAPAKGPLLPSQEHEFSGLVFNTYVRTLPPTLNPEASLSPNARKVDGAEAVSSNTDDGCYNDQTKVASGGLTLAQFRDGLNGSLRSEKVDKKSMFYFGVTGCNIAVMPPPDMMCLILETMRELGFKWRIGGLNASKYYDSNIGRDTVVLKTDTSKKRNNFCVAFKLVNPASAIQNDLIIGLTLYIAIDQSNHANYVVDLRMITGELNLFLHYAQRIGQAITEHFRAG

SEQ ID NO: 21307 - protein, 1837 aa, Giardia lamblia ATCC 50803
MQTDNPLTIRGRYTLHCLIGKGAFAKVWKAADEVTGGFVALKQLEPKGKKKAVDQGFIKEVMSEINLLSKLNHSNIVKYRGCFLEQNYLYIILELVDFGSLQTLIKQYDDLGENVVACYIYQILLGLKYLHEQGIIHKDIKAANILMTSSGLCKLTDFGLSQRLQDVDPTVVEGSPYWLAPEVINEEGVSTKSDVWSLGATMIELLTKKPPFHNLTGFAAMYNIATLTEMPLPPNISPECADFLSCCFKIDPHERHSCAELLNHPWLIKNANSLMRQKQLVGPRESAKLTLTNNMLPPPKGFSLPGSPKESSRRSSRESSTGKDVQALPPTKEPNSSTLDMHTLQNPSYPKSTSPKVSEKPLSKSSVRHNAGSSAPQFSSLTHDTLATRLETVRTRRLERDFERSESLFGADPLINIQTDSILSINSDSDDLTLFPDIQDLSDDNKYNSLIGTMSNDILDVSCKEPPGQDSVIIDGVMRHTFMSNILMTPKINKKAIKQHLRILEKNVFASYSIIDAHKLLKAISTSQKRKKLSCIFRGHMFPQKQQEAIADGSGGHQNPTNGEEDPSPFLPYELDLESLQPTETAGVLISNIMEKRGFLSVIQHIDNILINIENSSLASSMDHFNEVCVNLNNLYNTHPIETSVLKNKLKALRERQQNYQGLPLTTPRDQESTHRTKALYSSNPDADSNQSSTASGYDSIQMSFSTLKVHNTASLHSPAKPSSRGRHMPSSYAAGMQKTSMVRPQYHSLTNTLQSNLHSSSLEPLVLKKFGELGSFPESNHSLLDEALPSKSTNVPFLGAAQEFFGKEFDEKYYLNADLRDRNNKSKRGDPKAAMSLATRRAIFWNAALTLYMYEYCIELCKILYVLCQYSPRLIMNLTALGLPPLMKRLIDFKISNSITFVESISDFFRAIKSQTCEAVNSESRGFKFMRHSQDAQTTLQNDTISTARSGRVNGQFDSGTTTNQKSQIQHDTIRSLDCHLTTHLFLTYTTLKNQNTDDKYALKSFLGEFKATADRTLLAFRSFTYSSLPINVGADRVSEKDKERPKYSARKGTKDYYEIIHSTTVPARSYAHLLQLPNVPRFSCTSKTLENDHAGLSHYPSMLTGRETPSIVPTNIPTVVPIVDKDTGHTNSSIYGEDSCVGFQIDPSAADSSQKLVSYPCDKDALINVLQGETRTVVSDLLQVFIDGNFASAEFISIDYCLILHSQILQLCDCLLSTKDARFVIQVIGIIYKLVFKDKTSKARKVGILNSKFLTDEREVLDHVVKLYQLDSVLPSEKAVSTKNSRVGSTSAIQPAKSIMEIPTISTQSYATILITENAYEYIAKSLNILLFWKLLPPILEGSPYNYPTCEVQVIGQRVDWNNPFDLDLSGETSDRLRSIFFADKGKDYNETKLKYYLSILAMNEKRIQALEQGIEVYTKLVDLDYAHIIFSKDVLKTYINFISCVLMSCLPASYTASPLSNYSSTSLPYRIHTIVTTFFASLRKFVLTPDFVQSLTSQTIDILVDLLINIQNYRTDDILDSATYLCHSIIQFPEIHAIALNKGLIPVCYRIIYGSLTPVIEGDASRPHSQRSSPRKPSKKMTSQAPEASSSYSPSPITEFSGNVVELAMEIILRTSALRPTKRFPNQQKRQNRLMVPYQSLLEKIFKEFSTVEDGREQWLSKIFNLAATYPNKVLCLLSWFFDCSKYSHIQQSWRRIINVIVSPANLAKLSVLLSTEKIASEVIGDLTRFIKQHESIPQFLSSDQQFLQRLFVNLRASKQNTTRKGCMDIFEHIYLHSSHPRQLITRYNIRKLMIVLSYERPATENGTDGHARTALAMKAQTFLTYIQSFELMQ

SEQ ID NO: 21308 - protein, 508 aa, Giardia lamblia ATCC 50803
MPERRGVLQQNCPGNWNGATIAIASLFRLKDPSHGFLEANRIYLREVPILAVSDAEKEAYEDSLSTIEPMIPFNLYDSSKSYAEMRMELRATRHQFFDPLQNFLPFMAYDLFDMMPEKTLSYFERVEQINAATLSSEPCLVEIAGLSDDYNAKYSVTRDYGYKNRCCGDVLAAREREHPFVYGQYRLEAAPGCQHYWRACSSVCSTCKSNGAKKFAFPCHFCHDLEVDHHTLSSKDVKEVICWTCQQYGPIGEVCVNCGAALTTRYCATCKILSLMPLDYETFVHCDHCDRCVSVHEHENHYCARAGDAEDCPICLLPLNTDLSTVKLSCSAGHFLHASCYDRVNEEVESGEKCPLDGMIVGERDSYYCITAYAHAYFREHVFSWTSYKTIVIVSCVDCGKLAFNLYLGADDMQFSHCCFGCNTIELKRITMPSDLVETLVASIPWWLNQSSCTAMSASSFSLYTRADYPNYSESTLVMQFVAETEWLVYTHPILFTSISPHNPPAST

SEQ ID NO: 21309 - protein, 97 aa, Giardia lamblia ATCC 50803
MTDERTTDPFLPIANIGSIMKECLPANTKLTRGAKELVQEAVTELICFVALQAQTYAVSHRRKTVNGNDIITALHDLGFVRFHAILHKYYSSMLRKN

SEQ ID NO: 21310 - protein, 254 aa, Giardia lamblia ATCC 50803
MPRRIPDRYKTYDELIAAIRKAGIESMQMIVGIDFSKSNEWTGEKSYHCSLHDASRGETPYIRALRIMSHIVKNFDDDDIYPVYRFGCLNTKDQSVLPLLYPEQDDPHFEGFADVCQAYNRIASQIEMSGPTTFAPMIEQAIEICKADPKQFYILVILTDGDVSDVELDMKALIKASNYPLEIIAIGFGDGPFKTMKIFDDKARNRKFDNFQFVNFTEIEKKSAKCENPELILATAMMQELPDAYKCIKKLKYL

SEQ ID NO: 21311 - protein, 504 aa, Physcomitrella patens
MSDPYGRRLLVDDFHVGPVLGTGGFSVVRAGVRKQDNLQVAIKTLKKFGYGRGDHGRPGAQMSQAEALVKNEIMVMMRIVDEVSPHPNVIHLIDVYEDDGAVHLVLELCRGGELFDRIVQHERYSERDAAKVVRQIASGLAALHQAQIVHRDLKPENCLYVNPLAEAPLKIMDFGLSYIHHNTNSIVGIFGSIDYMAPEQLSLSGIMPANDMWSLGVILYILLCGYPPFRARSSRDKQMQILTGSYSMEEESWRGISHEAKQLIRRLLSVDPFARPTARELLSHPWVSGDIANRDLLHKDVFMRLQHFNARRKFRATAYASIVRTKFLLRTRYLKELLGDRVLTDSELEALRVNFMRISSNGQTATLKEFEEVLRSINLHCFVPLAPRIFELFDYNHDGGIDLREVVCGFSLLRTSHLDDALQMCFKIYDRDDSGYISKGELARVLGALPEDYLPADISQVQMDDIFEHVDTDSDGRISYQEFRRALSLQDAVMNHFRMEGQVQ

SEQ ID NO: 21312 - protein, 811 aa, Solanum tuberosum
MSNPKFTRVPSMRERVEDTLSAHRNQLVALLSRYVAQGKGILQPHHLIDEFNSAVCDDTACEKLKEGPFCEILKSTQEAIVLPPFVAIAVRPRPGVWEYVRVNVYDLSVEQLTIPEYLRFKEELVDGEDNNLFVLELDFEPFNASVPRPSRSSSIGNGVQFLNRHLSSNMFRSKESLDPLLDFLRGHNHKGNVLMLNERIQRISRLESSLNKADDYLSKLPPDTPYTEFEYALQEMGFEKGWGDTAKRVLETMHLLSDILQAPDPSTLETFLGRLPMVFNVVILSPHGYFGQANVLGLPDTGGQVVYILDQVRALEAEMLLRIKQQGLNFKPKILVVTRLIPDAKGTTCNQRLERISGTEYSHILRVPFRTENGILHKWISRFDVWPYLEKFTEDVAGEMSAELQGVPDLIIGNYSDGNLVASLLAYKMGVTQCTIAHALEKTKYPDSDIYWKKFEEKYHFSCQFTADLLSMNHSDFIITSTYQEIAGTKNTVGQYESHTAFTLPGLYRVVHGIDVFDPKFNIVSPGADMTIYFPYSDKEKRLTSLHPSIEKLLFDPEQNEVHIGNLNDQSKPIIFSMARLDRVKNITGLVECYAKNATLRELANLVVVAGYNDVKKSNDREEIAEIEKMHALMKEHNLDGQFRWISAQMNRARNGELYRYIADKRGIFVQPAFYEAFGLTVVEAMTCGLPTFATCHGGPMEIIQDGVSGYHIDPYHPNKAAELMVEFFQRCEQNPTHWENISASGLQRILDRYTWKIYSERLMTLAGVYGFWKLVSKLERRETRRYLEMFYILKFRELVKSVPLAIDDKH

SEQ ID NO: 21313 - protein, 371 aa, Schistosoma mansoni
MNNSITEVNMSVPSRATNSNNTILSEERTCHRSQMASSDAVGRTMALLPINHNHALHHGIKLMPHINMPHREVGATTPLVTNSGTASTCSMSLPGSMSSASDTVCNILPHNTSDSSSIDLASLFECPVCMDYALPPIMQCQSGHIVCASCRSKLSSCPTCRGNLDNIRNLAMEKLASSVLFPCKYSTSGCPETFHYTSKSEHEAACEYRPYDCPCPGASCKWLGELEQVMPHLVHHHKSITTLQGEDIVFLATDISLPGAVDWVMMQSCFGHSFMLVLEKQERVPDQIFFALVQLIGTRKQADQFVYRLELNGHRRRLTWEACPRSIHDGVQSAIAVSDCLVFDSNTAHSFAENGNLGINVTISQVSPSIS

SEQ ID NO: 21314 - protein, 436 aa, Mus musculus
APEPGPRAAAAAAAGGTMSGAARAGPARLAALALLTCSLWPTRADNASQEYYTALINVTVQEPGRGTPLTFRIDRGRYGLDSPKAEVRGQVLAPLPIHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRVLPCKHVFHKSCVDPWLSEHCTCPMCKLNILKALGIVPNLPCTDNVAFDMERLTRTQAVNRRAALGDLAGDSSLGLEPLRTSGISPLPQDGELTPRTGEINIAVTKEWFIIASFGLLSALTLCYMIIRATASLNANEVEWF

SEQ ID NO: 21315 - protein, 267 aa, Leifsonia aquatica
MTATSSPTTRFTDRVVLITGGGSGLGRATAVRLAAEGAKLSLVDVSSEGLEASKAAVLETAPDAEVLTTVADVSDEAQVEAYVTATTERFGRIDGFFNNAGIEGKQNPTESFTAAEFDKVVSINLRGVFLGLEKVLKIMREQGSGMVVNTASVGGIRGIGNQSGYAAAKHGVVGLTRNSAVEYGRYGIRINAIAPGAIWTPMVENSMKQLDPENPRKAAEEFIQVNPSKRYGEAPEIAAVVAFLLSDDASYVNATVVPIDGGQSAAY

SEQ ID NO: 21316 - protein, 244 aa, Echinococcus multilocularis
MSRLAECTISDTVDELVQRAKLAEQAERYDDMAGACKTMAEMGNELNNEERNLLSVAYKNVLGARRSSWRIMSSIAKKQAGTPLADQTDIYLKKVEEELIPICNDVLALPVLPITEKIGAEAKIFYYKMMGDYYRYLAEVQEGEQNDKSTEAAEEANQKATSLAEAELSVTHPIRLGLALNFSVFYYEIKNMPEKACSLAKAAFDAAITEVDSIKDETYKDSTLIMQLLRDNLTLWNSECETDS

SEQ ID NO: 21317 - protein, 248 aa, Echinococcus multilocularis
MAAITSWITDSGCKDHASLVSIAKLAEQAERYEDMAVAMKTIAEMGNELNNEERNLLSVAYKNVVGARRSSWRIMSSIAKKQAGTPLADQTDIYLKKVEEELTKICNDVLALLSKNLITEKIGAEAKIFYYKMMGDYYRYLAEVQEGEQNDKSTEAAEEAYQKATSLAEAELSVTHPIRLGLALNFSVFYYEIKNMPEKACSLAKAAFDAAITEVDSIKDETYKDSTLIMQLLRDNLTLWNSECETDS

SEQ ID NO: 21318 - protein, 248 aa, Echinococcus granulosus
MAAITSWITDSGCKDHASLVSIAKLAEQAERYEDMAVAMKTIAEMGNELNNEERNLLSVAYKNVVGARRSSWRIMSSIAKKQAGTPLADQTDIYLKKVEEELTKICNDVLALLSKNLITEKIGAEAKIFYYKMMGDYYRYLAEVQEGEQNDKSTEAAEEAYQKATSLAEAELSVTHPIRLGLALNFSVFYYEIKNMPEKACSLAKAAFDAAITEVDSIKDETYKDSTLIMQLLRDNLTLWSSECETDS

SEQ ID NO: 21319 - protein, 474 aa, Corynebacterium glutamicum
MDFKVADLSLAEAGRHQIRLAEYEMPGLMQLRKEFADEQPLKGARIAGSIHMTVQTAVLIETLTALGAEVRWASCNIFSTQDEAAAAIVVGSGTVEEPAGVPVFAWKGESLEEYWWCINQIFSWGDELPNMILDDGGDATMAVIRGREYEQAGLVPPAEANDSDEYIAFLGMLREVLAAEPGKWGKIAEAVKGVTEETTTGVHRLYHFAEEGVLPFPAMNVNDAVTKSKFDNKYGTRHSLIDGINRATDMLMGGKNVLVCGYGDVGKGCAEAFDGQGARVKVTEADPINALQALMDGYSVVTVDEAIEDADIVITATGNKDIISFEQMLKMKDHALLGNIGHFDNEIDMHSLLHRDDVTRTTIKPQVDEFTFSTGRSIIVLSEGRLLNLGNATGHPSFVMSNSFADQTIAQIELFQNEGQYENEVYRLPKVLDEKVARIHVEALGGQLTELTKEQAEYIGVDVAGPFKPEHYRY

SEQ ID NO: 21320 - protein, 244 aa, Echinococcus granulosus
MSRLAECTISDTVDELVQRAKLAEQAERYDDMAGACKTMAKMRNELNNEEANLLSVAYKNVVGARRSSWRIMSSIAKKQAGTPLAHQHDIYLKKVEEELIQICNDVLALPVLPITEKIGAEAKIFYYKMMGDYYRYSAEVQEGEQNDKSTEAAEEANQKATSLAEAELSVTHPIRLGLALNFSVFYYEIKNMPEKACSLAKAAFDAAITEVDSIKDETYKDSTLIMQLLRDNLTLWNSECETDS

SEQ ID NO: 21321 - protein, 776 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQGCQAGQTIKVQVSFDLLSLMFTFIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRNMSFRFIKRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 21322 - protein, 845 aa, Bacteroides thetaiotaomicron VPI-5482
MKKISIANAITVLAASAFLIACNAYDQDLSPGGNTVIEAVCPAPALEEPATRTAVDPTAYTSGEIGINWLPADRIGVYSATTANACFTNQSDQETDKTSFAGNLQNGETPLYAYYPYTETAGTAPTAFKGTLPLTQHYSTATRELEGDWKVGTPQGSSASRFTFEHIFAFLKFDINAGGTDVAGERLLSVSLTVPDKQLGGGFTCDLSTRAVTFTPATDASTVTMEWTDTPELSASTFHGYMNVAPVTGIAGTEISIQIKTNLHIITFTETMKADAFKSNTYYTVPLTLSRFKDKWTMEENPDAKEENAAWVTGLQSRLACANTVFAIAGQPFMHKIRVPQSTSQQYHAVVPVKNGVKRVYNLPEGLTWNAGRCLVEGKAPAAGDYVYSVEFTVGGATYKEGIKLHVAVRAADLQSPTPMMGWQTWNVFKDKIGYDILASQLVGMKEKGLIDAGYRYFGVDDCWQVKSENDNGHQIPDASKFPTANGVNGMARMANLIHDYGLKAGIYTDCGTKTCEKYFASYGYEELHAQDYKGWGYDFVKEDWYYDLDMAPVGATPSTFVDGYAGLGSYWNTSEMAQELYTKMGKALNDRGLMLYVCEWGIHDPWKWGAETGATCWRMTYDHRDGWWGKIDSGLFGKKNDGDENANGVGVHNTIVLMRHLWPYVGINRYNDADMICVGIRGSGQSSSDCVYNQAGGLTSTEAETSFAMWCMWSSPILLGFDMTKDMSSADLAHDLALVKNEELIAINQDALGQGAEYIKSADGIDYYQKDLADGDVAIAAVNLSDNSATYTISMADYDALDLSESYSARDLIGQKDAGTLSASSSLTGSLAAHGTFVVRLKKQ

SEQ ID NO: 21323 - protein, 915 aa, Bacteroides thetaiotaomicron VPI-5482
MKKTISQIVSERILILDGAMGTMIQQYNLKEEDFRGERFAHIPGQLKGNNDLLCLTRPDVIQDIHRKYLEAGADIIETNTFSSTTVSMADYHVEEYVREINLAATRLARELADEYTAKSPDKPRFVAGSVGPTNKTCSMSPDVNNPAFRALSYDELAASYQQQMEAMLEGGVDAILIETIFDTLNAKAAIFAAGQAMKVTGIEVPVMLSVTVSDIGGRTLSGQTLEAFLASVQHANIFSVGLNCSFGARQLKPFLEQLASRAPYYISAYPNAGLPNSLGKYDQTPADMAHEVKEYIQEGLVNIIGGCCGTTDAYIAEYQTLIAGAKPHVPAPKPDCMWLSGLELLEVKPEINFVNIGERCNVAGSRKFLRLVNEKKYDEALSIARQQVEDGALVIDVNMDDGLLDARTEMTTFLNLIMSEPEIARVPVMIDSSKWEVIEAGLKCLQGKSIVNSISLKEGEEVFLEHARIIKQYGAATVVMAFDEKGQADTAARKIEVCERAYRLLVDKVGFNPHDIIFDPNVLAVATGIEEHNNYAVDFIEATGWIRKNLPGAHVSGGVSNLSFSFRGNNYIREAMHAVFLYHAIQQGMDMGIVNPGTSVLYSDIPADTLEKIEDVVLNRRPDAAERLIELAEALKETMGGTSGQAAVKQDAWREESVQERLKYALMKGIGDYLEQDLAEALPLYDKAVDVIEGPLMDGMNYVGELFGAGKMFLPQVVKTARTMKKAVAILQPIIESEKVEGSSSAGKVLLATVKGDVHDIGKNIVAVVMACNGYDIVDLGVMVPAETIVQRAIEEKVDMIGLSGLITPSLEEMTHVAAELEKAGLDIPLLIGGATTSKMHTALKIAPVYHAPVVHLKDASQNASVASRLLNSQMKAELINELDAEYQALREKSGLLRRETVSLEEAQKNKLNLF

SEQ ID NO: 21324 - protein, 1420 aa, Bacteroides thetaiotaomicron VPI-5482
MKKHLLIYLIIYSICSLAGQVRAQERFADRYNITYVTMNEGLPHNFIDDLYKDSRGFMWISTAGGGLSRYDGYEFVNYTPNNHQCKLKSNFIRNVCEDAFQRLWIVSEGGTDIIDLSTLKPIIPHDPKGILPKILELPATRIMKDTQGCIWLHCDNALHRIEFNDKGEVQILSTLSPVYLNGPDIALKDIDEDGKIWMGNNGEIRKVALSPQKRLVTTPIADCLKFEAGTYISDFLSKENEVWISSDRGLFRYNKTGNVIKRYEHDSGNPYSLSQNYLTNLAITDDKQLIVATLRGINIYNPMTDNFERIACDLPNGGTNLLNSNFINCILTDGEHIWFGTETGGINLLNPRQLSIRSYRHDKENPSSLSYNPVNAIYEDVYGTLWVGTVEGGLNRKERNSEDFTHYTREHGGLSHNSVSALTADTDNHLWIGTWGGGLNLLDLKAPRQILEVISSQTGGGFPINFIGVLNYDPINEGIWIGANQGLYFYDPVKKEITAPLPDKAAENIHGCIGSIIDKEGKLWVGCLEGVYIIDLHSRSSKGEFQYRHLNYKLDDPSSRLIEKITCFYQGKDGTLWLGSNGYGIYQRKIDAQGKEQFISYSTAQGLPNNSVRGILEDNNGNLWISTNNGLSCYHQAENRFINYTIQDGLIDTQFYWNASCGSSHDLLYFGSVGGLVAIESNRPAMSLPAAKVRFTRLRIGNEEILPGSEYLSEDIAITTELKLHEKEKSFSLEFAALNFESNNTAIYSYRLVGFDDKWVQVPGNRRFASYTNLPPGSYTLQVRYTPDGENEGENITELKITIVPYFYKTVWFILFIIVLLSVSVWQFYQWRIRNLKRQKEYLHRTVEERTHELEQQKHLLENQTDELSRQNQMLIQQNEKITRQKAQLIRMSRKVQELTLDKISFFTNITHEFRTPITLIIGPIERALKLSYNPQVIEQLNFVERNSKYLLSLVNQLMDFRKVESGKLEIVKTRGNFLKFIDSLITPFEVFAQERNIVLKRYYRMEMPEILYDEEAMRKVVTNLLSNAIKFTPNGGTVSLYLSALFAKDSEKETLYICVKDSGSGIPEEDLNRIFNRFYQSQNQVKYPVYGQAGTGIGLYLCKRIVQMHGGEIKAFNNRHAGCSFRILLPLQRNERKDEKTIIIDHNDSSATPVQDSGSPKEKEALSILVVEDNADMRGYIRSILREQYHVLEAANGEEALHILNSNPIDFIISDLMMPVMDGIELSRRVKETFAISHIPFLMLTAKTSQEARLESYRMGVDEYLLKPFDETLLLARIQNILENRKRYQRKFTLDMDVDVLNMEEESGDKKFLNQVMEVIKENYKNSYFEVSDFCEAVGVSKSLLNKKLQNLIGQSAGQFIRNYRLNIARELILKNRETKNMNIAEVAYEVGFNDPKYFTRCFTKHFNVTPSALLNNEE

SEQ ID NO: 21325 - protein, 201 aa, Bacteroides thetaiotaomicron VPI-5482
MNKRKIRDIGRLTFSLLFFGLYIPHIFLYLFKNSLRKSINADLERRKEKNEVRMNKCLMFLYYIHTDRYFRNLFYHRVGAVVGALIGWWRLGDRSFVISKTTKIGEGAYFAHPFACEINAKSIGKNFSCRHLTTLGNKADGDNDNRPVIGDNVTLGVNVTIIGGVIVGNNVIIGAGSVVVKDIPDNSVAVGNPCRVIKTIE

SEQ ID NO: 21326 - protein, 468 aa, Bacteroides thetaiotaomicron VPI-5482
MKSTINFGYLIFLSVVAALGGFLFGYDTAVISGTIAQVTQLFQLDTLQQGWYVGCALIGSIVGVLFAGILSDKLGRKMTMIISATLFSTSALGCAISADFTQLVVYRIIGGVGIGVVSIVSPLYISEVAVAQYRGRLVSLYQLAVTVGFLGAYLINYQLLAYAESGNQLSMDWLNKIFVTEVWRGMLGMETLPAVLFFIIIFFIPESPRWLIVRGKEEKAVNILERIYNSVSEAASQLKETKSVLTSETKSEWAMLMKPGIFKAVIIGVCIAILGQFMGVNAVLYYGPSIFENAGLSGGDSLFYQVLVGLVNTLTTVLALVIIDRVGRKQLVYYGVSGMVVSLLLIGVYFLFGDSWGVSSLFLLVFFLFYVFCCAVSICAVVFVLLSEMYPTKVRGLAMSIAGFALWIGTYLIGQLTPWMLQNLTPAGTFFLFAVMCVPYMLIVWKLVPETTGKSLEEIERYWTRSEQ

SEQ ID NO: 21327 - protein, 118 aa, Bacteroides thetaiotaomicron VPI-5482
MKKIEAIIRKTKFEDVKDALLEADIEWFSYYDVRGIGKARQGRIYRGVVYDTSTIERILVSIVVRDKNAEKTVQAIIKAAQTGEIGDGRIFVIPIEDAIRIRTAERGDIALYNAEQER

SEQ ID NO: 21328 - protein, 906 aa, Bacteroides thetaiotaomicron VPI-5482
MDKKRVYTFGNGQAEGKADMKNLLGGKGANLAEMNLIGIPVPPGFTITTEVCTEYNTLGRDKVVELLKDEVVKAIARVEELMKSKFGDIENPLLVSVRSGARASMPGMMDTILNLGLNDEVVEGIIRKTGNARFAWDSYRRFVQMYGDVVLGMKPTNKEDIDPFEAIIEEVKESKGVKLDNELEVADLQELVKKFKAAVKEQTGKDFPTCAYEQLWGAICAVFDSWMNERAILYRKMEGIPDEWGTAVNVQAMVFGNMGDTSATGVCFSRDAGTGEDLFNGEYLINAQGEDVVAGIRTPQQITKVGSQRWAVLAGVTEDIRAAKFPSMEEAMPEIYKELDALQTKLENHYKDMQDMEFTVQEGKLWFLQTRNGKRTGAAMVKIAMDLLRQGMIDEKTALMRVEPNKLDELLHPVFDKSALKQAKVLTRGLPASPGAATGQIVFFADDAAEWHAAGKKVVMVRIETSPEDLAGMAVAEGILTARGGMTSHAAVVARGMGKCCVSGAGALNIDYKTRTVEIDGIVLKEGDYISLNGSTGEVYNGKVETQAAELSGDFADLMKLSDKYTRLQVRTNADTPHDAEVARNFGAVGIGLCRTEHMFFEGEKIKAMREMILAENAEGRRKALAKILPYQQADFKGIFKAMVGCPVTVRLLDPPLHEFVPHDTKGQQEMADTMGVSLQYIQQRVESLCEHNPMLGHRGCRLGNTYPEITQMQTRAILGAALELKKEGVETHPEIMVPLTGILYEFKEQEKVIREEAAKLFEEVGDSIDFKVGTMIEIPRAALTADRIASSAEFFSFGTNDLTQMTFGYSRDDIASFLPVYLEKKILKVDPFQVLDQNGVGQLVRMATEKGRAIRPDLKCGICGEHGGEPSSVKFCHRVGLNYVSCSPFRVPIARLAAAQAAIEG

SEQ ID NO: 21329 - protein, 660 aa, Bacteroides thetaiotaomicron VPI-5482
MTLQLKNKKWRIVYVISFLLFSFTGNAAIPEEPEEEILFVTSYNSDTKYTYDNINTFVETYRQLGGKYSTIVENMNVTDLNQSRKWKKRLTNILDKHPNAKLVILLGGEAWSSFLHLEDEKYRQLPVFCAMASRNGIRIPEDSIDIRTYEPQSIDLTERMNKYNIIYCNTYEYDIDKDIEMMRSFYPDMEHLVFISDNTYNGLAEQAWVKKNMKRYPEISTTYIDGRIHTLDAAAKQLRDVPKNSVALLGIWRIDNRGITYMNNSVYAFSKANPELPVFSLTATAIGYWAIGGYIPQYDGIGRSMGEQAYQFLDKGKNNVGHIHLLPNRYKFDANKLHEWGFQDKKLPFNSLIINQQVPFFQAYRTEVQFILFTFLVLIGGLFISLYYYYRTKILKNHLEKTTAQLREDKKKLELSEIALRHAKERAEEANQLKSAFVSNMSHEIRTPLNAIVGFSSLLIDTVETTDEQKEYADIIQTNSELLLQLISDVLDVSRLESGKLLFKYEWCELVNHCQNMITLTRKNRTRDIDVRLQMPKEPYMLYTDPLRLQQVIINLLNNALKFTPDGGSITLDYEIDEEDQCMLFSVTDTGAGIPEDKQELVFQRFEKLNEFVQGTGLGLAICKLTIQRMGGDIWIDKNYKNGARFVFSHPIKKRESEEK

SEQ ID NO: 21330 - protein, 484 aa, Bacteroides thetaiotaomicron VPI-5482
MNNTTNEGSKLYLYSITSVAILGGLLFGYDTAVISGAEKGLEAFFLSASDFQYNKVMHGITSSSALIGCVLGGALSGVFASRLGRRNSLRLAAVLFFLSALGSYYPEVLFFEYGKPNMDLLIAFNLYRVLGGIGVGLASAVCPMYIAEIAPSNIRGTLVSCNQFAIIFGMLVVYFVNYLIMGDHQNPIILKDAAGVLSVSAESDMWTVQEGWRYMFGSEAFPAAFFGLLLFFVPKTPRYLVLVQQEEKAYTILEKINGKKKAQEILNDIKATAQEKTEKLFTYGVTVIVIGILLSVFQQAIGINAVLYYAPRIFENAGAEGGGMMQTVIMGIVNIIFTLVAIFTVDRFGRKPLLIIGSIGMAVGAFAVAMCDSMAIKGVLPVLSIIVYAAFFMMSWGPICWVLISEIFPNTIRGKAVAIAVAFQWIFNYIVSSTFPALYDFSPMFAYSLYGIICVAAAIFVWRWVPETKGKTLEDMSKLWKKNK

SEQ ID NO: 21331 - protein, 908 aa, Bacteroides thetaiotaomicron VPI-5482
MNPSETEPTQNVMSSSAPETFPLIKDQLLFAESIYACLPMSIEIYDTNGILRSINEHALQMYGVTDKTTVVNIVNLFNSPYVDETLKNRIQRGEDIVLEFEYDFDRIKDNAYFSTQNKNTIIYEAKVVPLRSKEGEIIGHILLSNDVTAIKEAEFRTDESKKNLEMAMEAASMSSWVYDVYKKTFNPLHGDPIAKKNTTLDQILNILHPQDHEPLIQLLSQLTNKEILQGNITLRFYNEEEKQYRYYESMMRLSFEHFGKLLIIGTQLDITERMQMVKKTQELIAKRELAMKVSNIIHWDFDVRTQEFEAYNDPINDYASDKLVSIQRYMDVIHPEDRSSSYDAIQSMLSGKELTINFTCRMQTKYDESWQYCNIIGVPFEKDEYGNNVRYTGFRQNISKLHQLNEELEERNYKMQLTFKTVGMSYWDFEVKSKQFKAFNDPVNDFHSENVITPEDYLHVTHPEDIELVRNHINYMIGGTTKDLNFKFRSKTKWDKEWQTLIVTGIPVERDKKGNVIRYTGIKVNNTKWEKMAQQLKELKDKAELSDRLKSAFLANMSHEIRTPLNAIVGFSELMVYSEDPAEKEEYMSIIQSNNELLLRLINDILDLSKIESGILERKRETFNLAKVCNELYTMIQPKITNPDVEFQMDNSGPDCWIFLDRSRLKQVWMNYLTNAVKCTKSGYIKMGYSIEREGIRIYVEDSGVGIPEELQERVFGRFQKLNEFAQGTGLGLAISRAIIEGAGGEVGFTSTPGIGSTFWAWIPCEISTQKEHTPTISLPLQHQLSLNEIDKKELKILIAEDNESNYSLVQHILKSYHLTHVQNGAEAVNKVREEEFDLVLMDMKMPVMGGLEATRKIREFNNRIPIIALTANAFDADRISALDAGCNEFLAKPLKKSQLLELFSKKW

SEQ ID NO: 21332 - protein, 499 aa, Bacteroides thetaiotaomicron VPI-5482
MEENKQTLYNDELLDILPDGVIIFNISGEVIQLNRQALTELHVHSSVNAMMPLPTNILFKLLNNKEDILSVILEKIRQGEQTYSLSEHTFMQEQVDYTQFPIRGDFATIKEDGNLKKILFFFRNITVELTQEYILNTALQRTRIYPWYYDINRSEFTLDNRYFEHLGISAGENNTLTMEEYVNMIHPDDRQAMADAFIVQLSGMETFDKSVPFRLHRGDGTWEWFEGQSTYIANISGHPYRLVGICMSIQEYKDIENTLIEARKKAEESDRLKMAFLANMSHEIRTPLNAIVGFSDVIGSTYDELSEEERADFVRLISINSEHLVRLIDDVLDLSKIESNTIKFTFTDCSLRSLMIDVEKEQTMKPISEIEIRALLPNEDVYINTDATRLKQVISNFINNARKFTEKGYIHFGYAVDSVDASSVHVFVEDTGSGIPKECQKEIFDRFYKVDTFKQGTGLGLSICKTIVEHLQGDISVESEMGKGSRFIVTLPFERQTED

SEQ ID NO: 21333 - protein, 810 aa, Bacteroides thetaiotaomicron VPI-5482
MEGQLNLDCERFQQITQMAKMGWWESDVKNQQYICSDFIVDLLGLESHRISFQEFHHRIREDHRTRLRNEFISHSNLETYEQMFPIQAKNGEIWVYSKISFRKPDKEGYRDIFGYLQYVDKPAENRCGNIDFFHVNSLLYQQNSISYSLLAFLQSDNIAEIINQILGDLLKQFGGDRTYIVEIDRKKRVQNCMYEATAEGVSEERDNLQDILWDESFWWNRQISNRKSIILNTLDDMPQEAQEYRKLLESQNIKSLMAVPLISKDKIWGYMGIDMVKAYRSWSNVDLQWFSSLANIISIYIELRKSELQAKEDRLALDHREKILRNIYKNLPAGIELYDKDGYLIDINDKELEIFGLTDKNEVLGINLFDNPNIPQEIKEKLRARNDVDFSINYDFSKVNKYIETQRKGVINLTTKVTTLYDSQNQFINYLFINIDTTETTNAYTKIQEFENLFLLIGDYANVGFAHFNILTRDGYAQDTWYRNLGEKDGTPMTEVIGVYSHVHPEDQAVLKSFVRGVKEGKATSLRKEVRVSRENGKYTWTSINVMVRDYRPEEGIIEMLCINYDITTLKETEQKLIIARDKAEELDRLKSAFLANMSHEIRTPLNAIVGFSSLLAETESKEECQDYIKIVQDNNDLLLRLISDILDLAKIEAGTFNFVYADLDVNEVCSEIIKSTGMKVKGNIKLLFEKQIPECHIYTDKNRFMQVITNFINNALKFTHEGTIALGYEQISSQKIRFYVRDTGVGIPASKINSVFERFVKLNNFVQGTGLGLSICKSIITQMEGEIGVDSTEGAGSCFWFTLPYHTNE

SEQ ID NO: 21334 - protein, 1336 aa, Bacteroides thetaiotaomicron VPI-5482
MNETLILEIIFWSALFMVFYTYLGYGIVLYALVKLKELFVKPVKRVLPPDSDLPEVTLFITAFNEEDVVDEKMENSLALDYPADKLRIVWVTDGSDDGTNDRLQTRWNGKATVYFQPKRQGKTAAMTRGMTLVRTPLVVFTDANTMVNSEAIHEIVLAFQNPKVGCVAGEKRIAVQTKDGAAAGGEGIYWKYESTLKALDSRLYSAVGAAGELFAVRRELFEPMEPDTLLDDFILSLRIAMKGYTIAYCTNAYAIESGSADMGEEEKRKVRIAAGGLQSIWRLRPLLNPFHYGILSFQYTSHRVLRWSVTPFLLFALLPLNIVVLLLGESPLFYGTLLGLQILFYGMGYWGYYLSTRQIKNKVLFIPYYFLFMNVNVLKGIGYLKRKKEAAPGKKQNVPKNKNRESNILLSLHETESYKSNRTSMNRTLHEADNAQRILKLTADTMLLVDRNGICIDIDIHSNLWFLQEERLLGKNIFERMPEHTREKVYSTFQTVLREQRSISKNYKLELEDNTYYFKCIMYPYDDMVLCQYRDITQRSNVKRQLEQVNRNLREIQKVAQIGQWMYNTRDNVFHYMGYTGVLCEESSRSISLEKYQEFIVEEDRLSFTSWCRKNEEGLNEESISYRVRVAGEIYYMRLQAYLRDELPNGSCNIEGYIQNITDIQRRRNDINTLTHAINNAKESIFAAKEDGTLIFANRQFLHNHGIPESEEIGKLKIYEIAGDMNTQEDWHERCKDILHGGSRSFVAHHPSKVSKNILAYEGIMYNVTNDSGEESYWSFSHDISERLHYEAQIKRLNLIMDTTIDNLPAGIVVKEINNDFRYIYRNRESYNRNLCIGESIGKNDFDYYPPEVAEKKREEDTLVATTGRGLHWTTEGKDKNGNEIILDKRKIRVDGDELSSPIIVSIEWDITELEKIKRELQTSKEKAEMSDKLKSAFLANMSHEIRTPLNAIVGFSHLIAESENKEERKTFYEIVEANNERLLQLINEILDLSKIESGIIEFTSAPININSLCKEVHDAHVFRTPQGVQLIYEPSENGLVIETDKNRVFQVFSNLIGNAFKFTKAGSISYGYKLVGNQIVFHVTDTGTGIEPEKIGRVFERFAKLNNYAQGTGLGLSICKTIVERLGGEISVSSVVGQGTTFTFTLPYESEQSTENTKEEKRQEGNANENPTGTGSMKIDPASTETPAETSVKEDSEKTSGSTDDDSSGSISANASPSQRTILIAEDEDSNFDLLKAILGRKYRLIRARDGMEAVTSYDEAKPDLILMDIKMPNLDGLEATKIIRELSHTVPIIAQSAYAYQQDQIAAMDAGCSDFIAKPISQAKLKDMINKWLP

SEQ ID NO: 21335 - protein, 641 aa, Bacteroides thetaiotaomicron VPI-5482
MMRYIGCLFICLLWLFRATELFAVSNDQKPILIICSYNPAAHQTSVTISDYMEEYNKLGGKRDIIIENMNCKSFSEAPLWSGMMTQILSKYQGEKHPAQIILLGQEAWAAYLSQRDSIQVKVPVMCSLVSSNIVILPEDTVAGLDAWMPESVDLFTDHMNIPELKSGFINQYNIEDNVRMIKAFYPKTEHIAFISDNTYGGVTMQALVRKEMKKFPEIDLILMDGRRHTIYTIVEELRHLPENTVIMVGTWRVDMNEGYFMRNATYAMMEVTPTIPTFTPSSVSLGYWAIGGVLPDYRKLGMDMALASVQIDRYPADEQQHLSVIGSKAVLDSRKVKEWGLDPDILPFDVQIINQTVSFYQQYTYQIWSACALVVILVLGLCISLFYYFRTKRLKDDLLKSEKDLRVAKDRAEESNRLKSAFLANMSHEIRTPLNSIVGFSDVLAVGGNTEEEQQTYYQIIKTNSDLLLRLINDILDLSRLEANRVTLTWEECDVVQLCRQVVASVSVSRQSGNQFLFVSDYESFRMTTDIQRMQQVIINLMSNADKFTRKGQITLEFSVNEETEMAVFSVTDTGCGIPKEKQKLVFERFEKLNEYAQGTGLGLSICKLIVHKWKGDIWIDSEYTGGARFMFSHPLKIEKE

SEQ ID NO: 21336 - protein, 1039 aa, Bacteroides thetaiotaomicron VPI-5482
MNMKKYVLAFFLCFISITPILAQRDHIDISNYILCINSYAESSPWSNRMISTVSEYVQKNPKLALYAEHMNTLMIDNDTILGEFKNMISQKYEHHRPRLLILLGNPSLLLRDEYRELWGDIPIVLCSEEKFIGPKDTYIYKQPVTQAERVPISQLADPYNLVLLYSNLYLRENIQLISHIIPDMKKFIFIGDEREVNQTNNQEIQTKLKTINPNIEYQYITPQKMTTNQLLDSLYHVDPNTTGILFASWFYKTTFAGNTSLVTNAHKLIVTTTAPIFTLNMADITEENGGMIGGYTYDQKHYNQQLIHTISEILTGKPAREIPFYMPSDGAPIINYTILLRKGFSPSMCPPNTHFLNKPLGFWKQNKYFIMGTLSFMILLAIVFFYRIHSLNSIKKAQQKEIDAMTNYKNLVNNMPILYMQEEVLADKNGIPVELIYRNVNAHFEKNFFRKEEVVGKKASEIFPESMPDFLHFTQIALSENKVITFPYYFKKIDTFYDIVLKANRQNNMIDVFCLNSTELHKAQQKLSTINNKLAMSLDVANIVPWKWDLRSKTILCDINKPIELSTQGKDVAEEQLAVPDYHYFSKIFKEDRKRVEQAYQNLIDGHSEKVKEEYRVVSTQKGFHRIEWVEAQAAVETRDENGKPLTLVGSSLVITERKKMEMELINAKNRAEESNRLKSAFLANMSHEIRTPLNAIVGFSGILASTEEEEEKQEYVSIIENNNTLLLQLISDILDLSKIEAGTLDLHYSNVEINDLMKDLENMCQLKLKSDAVKLEFVAPEEPCFAHIEKNRLSQLIINLVTNAIKFTIQGSIRFGYKRQNNELYFYVADTGCGIPQDKQKSIFGRFVKLNSFAQGTGLGLSICQTLVEHMGGKIGVESEEGNGSTFWFTLPYKQAETVKKSLPKDIQPIAIEKDKLVILIAEDNESNYKLFESILKYDYHLLHAWDGQEAVNMFKEHNPQIILMDINMPVLDGYEATKEIRKYSAKVPIIAITAFAYASDEQRVMESGFDGYMPKPINARQLKAQLTDIMQKRIVLL

SEQ ID NO: 21337 - protein, 286 aa, Bacteroides thetaiotaomicron VPI-5482
MRQLKITKSITNRESASLDKYLQEIGREDLITVEEEVELAQRIRKGDRVALEKLTRANLRFVVSVAKQYQNQGLSLPDLINEGNLGLIKAAEKFDETRGFKFISYAVWWIRQSILQALAEQSRIVRLPLNQVGSLNKISKAFSKFEQENERRPSPEELADELEIPVDKISDTLKVSGRHISVDAPFVEGEDNSLLDVLVNDDSPMADRSLVNESLAREIDRALSTLTDREKEIIQMFFGIGQQEMTLEEIGDKFGLTRERVRQIKEKAIRRLRQSNRSKLLKSYLG

SEQ ID NO: 21338 - protein, 386 aa, Bacteroides thetaiotaomicron VPI-5482
MKGIFPIDKFRTLQTPFYYYDTKVLRDTLSAINQEVAKYPSYSVHYAVKANANPKVLTIIRESGMGADCVSGGEIRAAVRAGFPANKIVFAGVGKADWEINLGLEYGIFCFNVESIPELEVINELAAAQNKIANVAFRINPDVGAHTHANITTGLAENKFGISMQDMDRVIDVALEMKNVKFIGLHFHIGSQILDMGDFIALCNRVNELQDKLEARRILVEHINVGGGLGIDYGHPNRQSVPDFKSYFATYAGQLKLRPYQTLHFELGRAVVGQCGSLISKVLYVKQGTKKKFAILDAGMTDLIRPALYQAYHKMENITSEEPVEAYDVVGPICESSDVFGKAIDLNKVKRGDLIALRSAGAYGEIMASGYNCRELPKGYTSDELV

SEQ ID NO: 21339 - protein, 278 aa, Bacteroides thetaiotaomicron VPI-5482
METVRLNNGVEMPILGYGVYQVTPEECERCVLDAISVGYRSIDTAQAYYNEEGVGNAVRKCGVPREELFITTKVWISNGGYEKAKASIDESLRKLQSDYVDLLLIHQPFNDYYGTYRAMEEAYKAGKARAIGVSNFYPDRFIDLAEFCEIKPAVNQVETHVFNQQVKPQEIMKKYDTKVMSWGPFAEGRNNFFSNEVLKAIGEQYGKSVAQVALRFLIQRDIIVIPKSTRKERMIENFDVFDFTLSVKDMEEIAGLDKKESLFFSHYDPEMVNFLINL

SEQ ID NO: 21340 - protein, 585 aa, Bacteroides thetaiotaomicron VPI-5482
MYLENIYSPADVKKLSFQELNDLSHEIRASLLQKLSEHGGHFGPNFGMVEATIALHYVFNSPKDKIVYDVSHQSYVHKMLTGRKDAFLHPAEYDHVSGYSEPQESEHDFFVIGHTSTSISLASGLAKGRDLTGGNENIIAVIGDGSLSGGEAFEGLDYVAELGTNMIIIVNDNQMSIAENHGGLYKNLKDLRDSNGQCECNFFKAMGLDYMYVNDGNHVEALIEAFSKVKDIQHPIVVHINTLKGKGYEPAEQDKETYHWRTPFDLETGESKVNDDAEDYSEVTAQYLLKKMKEDKRVVTITSGTPAVLGFTPDRRQEAGKQFVDVGIAEEHAVALASGIAANGGKPVYGVYSTFIQRSYDQLSQDLCINNNPAVLLVFWGTLSGMNDVTHLCFFDIPLISNIPNMVYLAPTCKEEYLAMLEWSICQNEHPVAIRVPATDVISCGEPVESDYSNLNRYKVAHRGSKVAILALGSFFGLGQSVLSLLKDKANIDATLINPRYITGVDSELMDELKADHELVITLEDGVLDGGFGEKIARYYGATDMKVLNYGAKKEFVDRYDIQELLRANHLTDEQIVEDILSLIG

SEQ ID NO: 21341 - protein, 785 aa, Bacteroides thetaiotaomicron VPI-5482
MNNEQTKEALKEELELLRKENEQLKRQLRSLEQNKQPEESSTSFQERYAVKILNSLPDMLTVFNHDEVGIEVVSNEETNHVGISNKDFEGMHMRQMVPPEAYQNIHANMQKVIATRTVSAAHHDMDFNGSHHYYENRIFPLDEEYVLIMCRDITERVATQQQLEIFKSVLDKVSDSILAVSSDGTLVYANKQFMEEYGVTQQMGTQKIYDLPVSMRTPELWEAKLKDIRDNGGSFSYRAAYVRKGEEKNRVHQVSTYLTQEDDTELIWFFTQDITDVIKKRDELRELNLLLDGILNNIPVYLYVKDPEDDFRYLYWNKAFAEHSKIPASRAIGRTDFEIFPERADAERFRRDDLELIRTHERIDMQETYVAATGETRIVQTLKALVPMEGREPLLIGISWDITNFQNIEQELIKARIKAEQSDRLKTAFLANMSHEIRTPLNAIVGFSNLLPSAETLEEEKLYSSIINQNSEILLQLINDILDLSKIEAGTLEYVRQPMNLGEICRNIYQIHKDRVQEGVTLILDNQDEDLIIEEDRNRIAQVITNFLTNAGKFTLSGEIRFGFKVNNQCIRFYVKDTGIGIAPDKVGHIFDRFVKLNSFAQGTGLGLAICRMIIEKIGGEIGVTSEIGKGSTFYFTIPYKESSDDRIAFSEASETKYISHTIKRMQKIKKILVAEDVDSNFVLIKNMIGKDYTLLWAKDGFEAVEMYKQFQPDLILMDIKMPRMGGLEATRIIRSYSKEIPVIALTAYAFEADKEQALEAGCNDFVTKPVSKAALEEALGKCCG

SEQ ID NO: 21342 - protein, 869 aa, Bacteroides thetaiotaomicron VPI-5482
MNRQYYCLFVVLFFVVFARAAAAEHTYNILFIQSYTSQTPWHNDLNEGLTKGFKENGLKVNITTEYLDADFWSFSSEKVIMQRFCQRARDRKTDMIITASDEAFYTLFSSGDSLPYQVPVVFFGIKYPDKELIASLPNVCGFTANPDFYVILKQAQKVFPQRKEVICVIDNSFLSNKGREDFKQEWQLFQEENPDYKMKLYNTQHESTNHIIAAICYPRNSYARVVVAPKWSPFLSFVGKNSKAPVFSSQNVGLMNGVFAAYDADAYTSAMSAAKKASRVLKGESPLKLGVTETEQGFIYDYKQLDFFHIDPDKVSSSGSVVNQPYWERYKLLFILLYPSILALLIVSIVWLIRVNRREAKRRIHAQTRLLVQNKLVEQRNEFDNIFHSIRDGVITYDTDLHIHFTNRSLLKILHLPSESGGRNYEGMMAGSIFKIYYNGQDILYKILKKVGETGQSVIIPDGAFMKEVHSEHYFPVSGEVVPIHSGGQITGMALSARNVSDEEMQKRFFDMAVEESSIYPWQFDVESNSFIFPQGFLVRFGYDESITSITRDEMDRMVYPEDLKEMRILFDKTLAGKETNTRLNFRQRNANGEYEWWEYRSSVISGLTRDSLYNILGVCQSIQRYKTAEQEMREARDKALQADKLKSAFLANMSHEIRTPLNAIVGFSDLLSDTSGFTEEEIGQFIATINKNCGLLLALINDILDLSRIESGTMEFMFANHNLPLLLKTVHDSQQLNMPPRVELLLRMPDNEKKYLVTDNVRLQQVVNNLINNAAKFTTYGSITFGYEEDEDPEYTRIFVEDTGVGISEEGIRHIFERFYKVDNFTQGAGLGLSICQTIVERLRGTIFVTSEVGRGTRFTVRIPNFCE

SEQ ID NO: 21343 - protein, 539 aa, Bacteroides thetaiotaomicron VPI-5482
MMAVQALITEGNISLAVNNANSMYQQAKAIDYPFGTALALRALADTYQSSGNPQSAIESYEESLKIMQKIPASIPYLKTSMFHLILSKLKYRQMTDIEKDFAYLESLYHKESGLPDDFYLPCSYAYYYIQTNNLPKALEYLKQLDSIYEKYPYPYYSSISNYMYAGYHIESKEYDKALKEYEELLTITKKTALFRHVQLLQERAKVLVLMNQKQEACKIYEEINHLKDSLDAQSYLSQINELHTLYQIDKSELNYINIQKNLYYWSLSVILVIVVLIIIAIFRIKRTNNRLLQSQQEQEKAKKQAEKSIHTKSLFLSNMSHEIRTPLNALSGFSAILTEESIDNETKQQCNDIIQQNSELLLKLINDVIDLSSLEIGKMQFKFNECDIVALCRNVIDMVEKIKQTQAEVRFSTSLSSLKLTTDSARLQQVLINLLINATKFTAQGTITLELVKQTEDTALFSVSDTGCGISKENQNKIFNRFEKLDENAQGTGLGLSICQLIIEQLGGKIWIDPDYDKGARFLFTHPIRHAQIKIHQAR

SEQ ID NO: 21344 - protein, 702 aa, Homo sapiens [sequence omitted]

SEQ ID NO: 21345 - protein, 601 aa, Bacteroides thetaiotaomicron VPI-5482
MGWWEADLKTESYVCSEFISRLLGIDEDGVISFEDFNKRILREDQHHTTSYSFDKLQQSIEEVYLLDTPHGEVWIRSKICFQETDGEGNTKIYGIAETQDGPRMASAYQALQNSERILHNIYKNLPVGIELYNKDGYLLDLNKKELEMFHITHKEKVIGINIFENPALPEEIKLKIRDNEEVEFTFQYDFSKIKGYYESEKTSGFINLTTRITTLYDHDRQPINYLLINVDKTENTIAYNKIQEFKNFFELVGDYAKVGYAHFDALSRNGYALSSWYKNVGEEEGTPLPEIIGIHSHFHPEDRAVMLDFLAKVVKGESTKLCRDVRIRRADGSYTWTRVNVLVRNYRPQDNVIEMLCINFDITQLKETEQMLIKAKEKAEEADRLKSAFLANMSHEIRTPLNAIVGFSSMLEEAEDQEEKHQYITIIEDNNKLLLQLISDILDLSKIEAGTFDIIPERVNAKQLCNDLFQAMQMKTSPQVELRLKDNLPELTFTSDKNRLYQVLLNFVTNALKFTSEGNITIDYQIDGNEVKFSVQDTGMGIEPEKQEAIFTRFVKLNSFIPGTGLGLPICQSIVTQLGGKIGVESEPGRGACFWFTHPIN

SEQ ID NO: 21346 - protein, 616 aa, Bacteroides thetaiotaomicron VPI-5482
MKRNIYILFTIGLFIRILPSHSVNLNTERLSNLKRLIENNIAYDSIAPIDSVIAWGQQLSPILEKENKMELSFSIRQLVVYIYSLRGDIGKAIDEARQMYEKAETMRYDLGIALSSAAIGDAYFCSNMPEEATDSYKEAIRYPASPSENNHYKEMTILKLIQVLILTQRTEEAEKYRKILSESKSIQTHQTLQFLTLATDVSYYIQKNDLRNANNCLLQAEQIYLSDRQPYYRTTYNYMQGRYNEATGNYNLALQYYNEILTGIRQKTRSIIYLQVAYAKANLLIEMGSKVEAAHLYEEISIVTDSVVAPSYAHRINSLRASYEENRMKVENKAEFNRIFMGGILIGVIVLGIMIYLVIHILKQNKKIAESKIRMEQSRLNAENAMQTKSLFLSNMSHEIRTPLSALSGFSSLLTEQALDAETRRQCGDIIQQNSDLLLKLINDVIDLSNLEIGNMKFNFTYCDAIAICNNVIDTVNKVKQTQAELRFNTSLASLKLYTDDSRLQQLLINLLINATKFTPQGSITLEVRQESEEFALFSVTDTGCGIPLEKQSSIFNRFEKLNEGAQGTGLGLSICQLIIERIGGSIWIDPAYTTGCRFYFTHPINPTKEGKEAQS

SEQ ID NO: 21347 - protein, 882 aa, Bacteroides thetaiotaomicron VPI-5482
MEEKEKAWKTVSSKYLFRRPWLTVRCEDMLLPNGNHIPEYYILEYPDWVNTIAITKDGKFVFVRQYRPGLGRTSYELCAGVCDKEDASPLVSAQRELWEETGYGKGNWQEYMVISANPSTHTNLTHCFLATDVEPIDHQHLEDTEDLSVHLLTFEEVKQLLENNEIMQSLNAAPLWKYVAEHAADFEQESVEKVEHEKTETISHRINDLLYYQNSISRSLSRFLKDEEVETGIYEILKDILAFYRAGRAYIFETDEENHFYNCTYEVVAEGVKAEINKLQEIPVDFMPWWTSQILGKKPILFETLKPMPGMGQGEYEVLSRQGIKALMATPLVVNDHVYGFMGVDLVDGSASWSDEDYRWLSSLANVISICLELRRAKEKVIFEQAALARSERLFKNIFANIPAGVEIYDKEGNLVDLNERDMDILGISDKSEVIGLNFFENPNVDAQILESIRKSSITDFRARYSFECARHTGYYRPLKAGVIELYTKVRKLYDNHGNLTGYILINMDNTERIDALKPISDFENLFLLISDYAKVGYAKLNLLNRQGYAIKQWFKNMGEDENTPLSDVVGVYSKMHPDDRSRMLAFFEEAKKGKAKAFKGEMRILRPGTKNEWNWVRTNVVLNLYEPEKGQVELIGVNYDITALKETEAKLIEAKEKAEESDRLKSAFLANMSHEIRTPLNAIVGFSSLMVDTEDMEERRQYMDIVEENNDLLLQLISDILDLSKIEAGTFDFTEREVDVNLLCEDIVLAMRMKARPNVEILFDRHLPECRIMSDRNRLHQVISNFVNNALKFTEEGNIRVGYDQLDEAHLRFYIADTGIGIEPEMQNEIFERFVKLNSFVHGTGLGLSICRSIVEQLGGEIGVDSEPEKGSCFWFTLPIK

SEQ ID NO: 21348 - protein, 100 aa, Bacteroides thetaiotaomicron VPI-5482
MNIYISGLSYGTNDADLTNLFAEYGEVSSAKVIFDRETGRSRGFAFVEMTNDAEGQKAIDELNGVEYDQKVISVSVARPRAEKPSYGGNRGGGYNNSRRY

SEQ ID NO: 21349 - protein, 259 aa, Bacteroides thetaiotaomicron VPI-5482
MKRFENKVVVITGAAGGIGEATTRRIVSEGGKVVIADLSQERADKLAAELTQAGADVRPIYFSATELQSCKELVDFAMKEYGQIDVLINNVGGTDPKRDLNIEKLDIDYFDEVFHLNLCCTMYLSQQVIPIMTTHGGGNIVNVASISGLTADANGTLYGASKAGVINLTKYIATQMGKKNIRCNAVAPGLVLTPAALDNLNEEVRNIFLGQCATPYLGEPEDVAATIAFLASNDARYITGQTIVVDGGLTIHNPTVELS

SEQ ID NO: 21350 - protein, 390 aa, Bacteroides thetaiotaomicron VPI-5482
MDSEKKNKKKQIAILGSTGSIGTQALQVIEEHPDLYEAYALTANNRVELLIAQARKFQPEVVVIANEEKYAQLKEALSDLPIKVYAGIDAVCQIVEAGPVDMVLTAMVGYAGLKPTINAIRAKKAIALANKETLVVAGELINQLAQQYHTPILPVDSEHSAVFQCLAGEVGNPIEKVILTASGGPFRTCTLEQLKSVTKTQALKHPNWEMGAKITIDSASMMNKGFEVIEAKWLFGVQPSQIEVVVHPQSVIHSMVQFEDGAVKAQLGMPDMRLPIQYAFSYPDRICSSFDRLDFTQCTNLTFEQPDTKRFRNLALAYEAMYRGGNMPCIVNAANEVVVAAFLRDGISFLGMSDVIEKTMERAAFVAAPAYDDYVATDAEARRIAAELIP

SEQ ID NO: 21351 - protein, 720 aa, Bacteroides thetaiotaomicron VPI-5482
MEARITRKTAALAIFLISAFQTYIYAGRPSSCQLLIINSYTENCLWSDDFMAPVYKEFRVQNSPVDICAEHMELMATVVPDMRKQVFMSDRRWISAQCRKEAEEVMPFLLIGGYFWTDSEIKKHLLPVIKSRLDGASHPHRVETTAMGTPPSVINYADYVESGLLLGLCPDDTVFGMKPPTFFERNKYYLALFFSLMALAVIYVIWLRRALHERSRLLEIMRSYSSLVENMPVLYARVELIFDPGGRIIDYVYREVNPTFEKYILPKEKILGKKYSELNPDYSPELPDRYSELNDNRQITFQYYLEKTKTHLTVISIHSKTKGCVDVFGVDNTELVLTQQMLKSTNHKLSAALDAADMTPWKWDLRTGLLSCNVSHDLYVTEEEVTHDGNLIIVPTSACFAKICDEDRERVRDAFEHLANGETQKMREEYRVGRQWLPSPQQNEWVEVRAAVDERDANGKPLSLIGTSMTVTQRKEMEEALVQAKVKAEEANTLKSSFLANISHEIRTPLNAIVGFSSLLVSAERGISEEKQEYINIIENNNTLLLQLISDVLDLSKIEAGTMEFDYAPIDVHGLFIELEDTFRLRNKKSGICICYHRRTTECVVKADRNRLVQVMMNLMNNAVKFTGEGSIEFGFDVREDGFLHFYVTDTGCGIPEERLEEIFGNFVKLNSFVQGTGLGLTICRAIVERMGGKIGAVSRLGQGSTFWFTLPYTANEEKI

SEQ ID NO: 21352 - protein, 224 aa, Bacteroides thetaiotaomicron VPI-5482
MRKKLKAVLFDMDGVLFNSMPYHSEAWHQVMKTHGLDLSREEAYMHEGRTGASTINIVFQRELGKEATQEEIESIYHEKSILFNSYPEAERMPGAWELLQKVKSEGLTPMVVTGSGQLSLLERLEHNFPGMFHKELMVTAFDVKYGKPNPEPYLMALKKGGLKADEAVVIENAPLGVEAGHKAGIFTIAVNTGPLDGQVLLDAGADLLFPSMQTLCDSWDTIML

SEQ ID NO: 21353 - protein, 147 aa, Bacteroides thetaiotaomicron VPI-5482
MMTLDDTYFMKQALIEAGKAAERGEVPVGAVVVCKERIIARAHNLTETLNDVTAHAEMQAITAAANVLGGKYLNECTLYVTVEPCVMCAGAIAWAQTGKLVFGAEDDKRGYQRYAAQALHPKTVVVKGILADECATLMKDFFASKRR

SEQ ID NO: 21354 - protein, 391 aa, Bacteroides thetaiotaomicron VPI-5482
MQKRLFRESRKLEHTNHIASAILKNVHAYILLIDNDFKVLKTNYYQLTGTQKGLEEKRVGDLLQCRNALSAEGGCGTHAYCGSCPIRCAIRQAFEQRRGFTDLNATLNVLTSEKKSVECDAVISGSYFLLNEEENMVLTVHDITQLKQAEKQLALAKEKAENADLSKSTFLANMSHEIRTPLNAITGFAEILASANTEEEKAQYQEIIKMNADLLLQLVNDILDMSKIEAGTLEFVYTKVDINLLLSDLRQLFQMKVNDAGGNIQIIAEPSLPSCSIETDRNRVAQVLSNFTTNAIKFTQEGTISIGYEARDTELYFYVTDTGAGIPADKLPEVFGRFVKLNKDKKGTGLGLSISKTIVNKLEGQIGADSVEGKGSTFWFTIPYRTCGRPE

SEQ ID NO: 21355 - protein, 481 aa, Bacteroides thetaiotaomicron VPI-5482
MEDLNFRKGDAKTDVFGSDRMLQPSPVERIPDGPTTPEVAYQMVKDETFAQTQPRLNLATFVTTYMDDYATKLMNEAININYIDETEYPRIAVMNGKCINIVANLWNSPEKDTWKTGALAIGSSEACMLGGVAAWLRWRKKRQAQGKPFDKPNFVISTGFQVVWEKFAQLWQIEMREVPLTLEKTTLDPEEALKMCDENTICVVPIQGVTWTGLNDDVEALDKALDAYNAKTGYDIPIHVDAASGGFILPFLYPDTKWDFRLKWVLSISVSGHKFGLVYPGLGWVCWKGKEYLPEEMSFSVNYLGANITQVGLNFSRPAAQILGQYYQFIRLGFQGYKEVQYNSLQIAKYIHGEIAKMAPFVNYSENVVNPLFIWYLKPEYAKSAKWTLYDLQDKLSQHGWMVPAYTLPSKLEDYVVMRVVVRQGFSRDMADMLLGDIKNAIAELEKLDFPTPTRMAQEKNLPVEAKMFNHGGRRHKTVKK

SEQ ID NO: 21356 - protein, 419 aa, Bacteroides thetaiotaomicron VPI-5482
MALQFVTVVLLAGFIYLLIKYQSVKKKMILETSVMLHESKELTSILQNINVYYLLIDRDLIVHNTNYYTLNHLTPAQGEEKRVGDLLHCRNAIVAGECGKHEQCKLCCIRTSISKAFYEKRSFKKLDASMQLLSEDEKTVIPCDVSVSGTYLKINGEERMVLTVYDVTELRNMQRLLDVERENAISADKLKSAFIANMSHEVRTPLNAIIGFSGLMATATSEEEKKMYTDIISENNERLLRLVNDIFDLSQIDAGVLNFVYSEFDANDLLRELEGLFGMRLNENPLVTLVCEAHLEPIMMHSEKQRIIQVLTNLLHNAMKFTKTGEIRFGCRMEGTDEVYFYVSDTGIGIPKEEQEKIFSRFTKLDREMQGTGLGLTLSQTIVHNLGGRFGVESEVGKGSTFLFILPLVTKKEITNDKI

SEQ ID NO: 21357 - protein, 507 aa, Bacteroides thetaiotaomicron VPI-5482
MGWSSWNAFRVDISEDIIKNQADLMVKKGLKDAGYHYINIDDGFFGERDGNGKMQTNKNRFPNGMKPVADHIHSLGMKAGIYTDAGNNTCGSIWDNDHAGVGAGIYGHEQQDAQLYFSDWGFDFIKIDYCGGDVLGLNEQERYTSIRNSIDKVNKDVSVNICRWAFPGTWAKDVATSWRISGDINAHWGSLKYVVGKNLYLSAYAKDGHYNDMDMMVIGFRDNSKVGGKGLTPTEEEAHFGLWCIMSSPLLIGCNLESLPESSLELLTNKELIALNQDPLGLQAYVAQHENEGYVLVKDIEQKRGNVRAVALYNPSDTVCSFSVPFSALEFGGNVKVRDLAKRSDLGNFSDVFEQTLPAHSAMFLRMEGETRLEPTLYEAEWAYLPMFNDLGKNPKGIIYAADQEASGKMKVGFLGGQPENYAEWPEVYSADGGRYQMTVHYSFGKGRQLEVDVNGIVTKIDSLGEDDKHNQVTIPVDLKAGYNHIRMGNSYNWAPDIDCFTLTKGM

SEQ ID NO: 21358 - protein, 476 aa, Bacteroides thetaiotaomicron VPI-5482
MIYNMSTELFSTLPYKVADITLADFGRKEIDLAEKEMPGLMALREKYGESKPLKGARIMGSLHMTIQTAVLIETLVALGAEVRWCSCNIYSTQDHAAAAIAASGVAVFAWKGENLADYWWCTLQALNFPGGKGPNVIVDDGGDATMMIHVGYDAENDAAVLDKEVHAEDEIELNAILKKVLAEDKTRWHRVAEEMRGVSEETTTGVHRLYQMQEEGKLLFPAFNVNDSVTKSKFDNLYGCRESLADGIKRATDVMIAGKVVVVCGYGDVGKGCSHSMRSYGARVLVTEVDPICALQAAMEGFEVVTMEDACTEGNIFVTTTGNIDIIRIDHMEKMKDQAIVCNIGHFDNEIQVDALKHYSGIKCVNIKPQVDRYYFPDGHSILLLADGRLVNLGCATGHPSFVMSNSFTNQTLAQIELFNKKYEVNVYRLPKHLDEEVARLHLEKIGVKLTKLTPEQAAYIGVSVDGPYKAEHYRY

SEQ ID NO: 21359 - protein, 329 aa, Bacteroides thetaiotaomicron VPI-5482
MDKIIGLGNALIDVLATLKDDTLLDELELPKGSMQLIDDAKLQQINTKFSQMKTHLATGGSAGNAILGLACLGAGTGFIGKVGNDHYGDFFRKNLQKNNIEDNLLTSEQLPSGVASTFISQDGERTFGTYLGAAASLKAEDLTLEMFKGYAYLFIEGYLVQDHEMILHAIELAKEAGLQICLDMASYNIVENDLEFFSLLINKYVDIVFANEEEAKAFTGEEPEEALRVIAKKCSIAIVKVGANGSYIRKGTEEIKVSAIPVEKVLDTTGAGDYFAAGFLYGLTCGYSLEKCAKIGSILSGNVIQVIGTTISPERWDEIKLNINKVLAE

SEQ ID NO: 21360 - protein, 311 aa, Bacteroides thetaiotaomicron VPI-5482
MKVVVIGSSNIDMVAQVNHLPAPGETVGDASFMQSLGGKGANQAVAAARLGGSVTFITSLGNDMYAEILKKHFKKEGITTDYIIDDVNQPTGTALIFVADSGENCIAVAPGANYSLLPGSIIHFSKVIDEADIIVMQAEIPYETIKRIALLAKQKGKKVLFNPAPACLIDEELMKAIDILVVNELEAAFISGIEYTGNNLEEIALSLLQAGARNAVITLGSQGVYMKNDKEIIQLPGYKVNAIDTIAAGDTFCGALAVICAQREIDRDALSFANAAAAIAVTRSGAQPSIPTLDEVKHFMLEKELALSFNF

SEQ ID NO: 21361 - protein, 503 aa, Bacteroides thetaiotaomicron VPI-5482
MNQTRCIVILSILALFVASVSVAGNISLPDASQKVFEGKPCINSPRAIGNYPASPFLFYIPTTGQRPMEWSAEKLPKGLKLDSKTGIITGSVASKGEYTVTLKAKNALGTSTEKLVIRIGDDLLLTPPMGWNSWNTFGRHLTEELVLQTADALVANGMRDLGYSYINIDDFWQLPERGADGHLQINKDKFPRGIKYVADYLHERGFKLGIYSDATDKTCGGVCGSYGYEEVDAKDFASWGVDLLKYDYCNAPVDRVEAMERYAKMGKALRGTGRSIVFSICEWGQREPWKWAKQVGGHLWRVSGDIGDVWNREANKLGGLRGILNILEINAPLSEYGGPSGWNDPDMLVVGIGGKSMSIGYESEGCTHEQYKSHFALWCMMASPLLCGNDVRSMNDSTLQVLLDRDLIAINQDVLGKQAERSIRADHYDIWVKPLADGRKAVACFNRADTPRTIELNSKTVEDLSLEQVYSLDSRSMENAANNIMVDLAPYQCKVYICGKPKK

SEQ ID NO: 21362 - protein, 267 aa, Bacteroides thetaiotaomicron VPI-5482
MNQYLNFSLKGKVALVTGASYGIGFAIASAYAEQGATVCFNDINQELVDKGMAAYAEKGIKAHGYVCDVTDEPAVQAMVATIEKEVGTIDILVNNAGIIRRVPMHEMEAADFRRVIDIDLNAPFIVSKAVLPAMMKKRAGKIINICSMMSELGRETVSAYAAAKGGLKMLTRNICSEYGEYNIQCNGIGPGYIATPQTAPLREKQADGSRHPFDSFICAKTPAGRWLDPEELTGPAVFLASEASNAVNGHVLYVDGGILAYIGKQPK

SEQ ID NO: 21363 - protein, 300 aa, Bacteroides thetaiotaomicron VPI-5482
MSPLNFTHILTQAVDELSESESYKGLFHQHKDGEPLPSAKVLYEIIELSRAILFPGYYGNSTINSRTINYHIGVNIEKLFDLLTEQILAGLCFSTAEGDCNVCSESRREEAARLAANFISKLPAMRRILATDVEAAYNGDPAAKSYGEVIFCYPAIKAISNYRIAHELLELGVPLIPRMITEMAHSETGIDIHPGAKIGSHFTIDHGTGVVIGATSIIGNNVKLYQGVTLGAKSFPLDADGKPIKGIPRHPILEDNVIVYSNATILGRITIGSDATVGGNIWVTENIPAGAKIVQTKAKK

SEQ ID NO: 21364 - protein, 503 aa, Bacteroides thetaiotaomicron VPI-5482
MNITKIISKTFDSRLKQIDLYASQASEIQHRVLSRLVNQAAQTEWGKKYDYASIRSYEDFRNRLPIQTYEEIKPYVERLRAGEQNLLWPSEIRWFAKSSGTTNDKSKFLPVSKEALEDIHYRGGKDAAALYFRINPDSHFFSGKGLILGGSHSPNLNSNHSLVGDLSAILIQNVNPLINFIRVPSKKIALMSEWETKIEAIANSTIPVNVTSLSGVPSWMLVLIKRILEKTGKQTLEEVWPNLEVFFHGGVAFTPYREQYKQVIHSKMMHYVETYNASEGYFGTQNDLSDPAMLLMIDYGIFYEFVPLEEVDKENPRAYCLEEVELNKNYAMVISTSCGLWRYMIGDTVKFTNKNPYKFVITGRTKHFINAFGEELIVDNAEKGLAKACAETGAQVCEYSAAPVFMDEHAKCRHQWLIEFAKMPDSVEKFAAILDATLKEVNSDYEAKRWKDIALQPLEVIVARPGLFHDWLARKGKLGGQHKVPRLSNTREYIESMLVLNNE

SEQ ID NO: 21365 - protein, 734 aa, Bacteroides thetaiotaomicron VPI-5482
MDSILFWLVPVASVLALCFAYYFHKQMMKESEGTPQMIKIAAAVRKGAMSYLKQQYKIVGCVFLGLVILFSIMAYGFHVQNVWVPIAFLTGGFFSGLSGFLGMKTATYASARTANAARNSLNSGLRIAFRSGAVMGLVVVGLGLLDISFWYLLLNAVIPADALTPTHKLCVITTTMLTFGMGASTQALFARVGGGIYTKAADVGADLVGKVEAGIPEDDPRNPATIADNVGDNVGDVAGMGADLYESYCGSILATAALGAAAFIHSADTVMQFKAVIAPMLIAAVGILLSIIGIFSVRTKENATVKDLLGSLAFGTNLSSVLIVAATFLILWLLQLDNWIWISCAVVVGLLVGIVIGRSTEYYTSQSYRPTQKLSESGKTGPATVIISGIGLGMLSTAIPVIAVVVGIIASFLLASGFDFSNVGMGLYGIGIAAVGMLSTLGITLATDAYGPIADNAGGNAEMAGLGAEVRKRTDALDSLGNTTAATGKGFAIGSAALTGLALLASYIEEIRIGLTRLGTVDLSMPNGDVVSTANATFVDFMNYYDVTLMNPKVLSGMFLGSMMAFLFCGLTMNAVGRAAGHMVDEVRRQFREIKGILTGEAEPDYERCVAISTKGAQREMVIPSLIAILAPIATGLIFGVTGVLGLLIGGLSTGFVLAIFMANAGGAWDNAKKYVEEGNFGGKGGEVHKATVVGDTVGDPFKDTSGPSLNILIKLMSMVAIVMAGLTVAWSLF

SEQ ID NO: 21366 - protein, 1345 aa, Bacteroides thetaiotaomicron VPI-5482
MKLTKILILLLAFWLEPLSASPYFSFKKYQVEDGLSHNTVWCAIQDSYGFIWLGTSDGLNRYDGRGNKVYRNVLNDKFSLENNFVEALIEEDQNIWVGTNSGLYIYDRATDRFSYFDKTTQYGVYVSSEIKKIVKTENGLLWIATLGQGLFIYDPKTEVLTQNSIQTSFVWDVCQSYDKKKVYVSSLQEGLLCFDENGKFLQSYRVSSDVNSSDSYKINCVLDVEGEVWLGAGNNLLGRLNRQTGTVENYMAPSLNFGAVRSLLKYTENELLVGTDNGLYLFNRESKTFLRADNPADPRSLSDQTINGMMWDAEGALWVLTNLGGINYMSKQTKRFDYYSPAYLSGIAGAGEVVGPFCENKDGNIWIGTQSGLYFFNTVTRELSEYHIGGVKSQKYDIRSLMLDGDCLWIGTYAEGIRVLNLRTGSIKEYTHSRGIPNTICSNDVLCIYKDRKGEIFVGTSWGLCRYNPDADNFMTITSIGSMISVGDIYEDMYNNLWIATTNSGVFSYNTLSGHWKHFQHEREDSTTITSNSVITVFEDNKGVMWFGTNGGGLCSFDPKTEAFIEFDSALPNKVIYSIEQDQTGDFWISSNAGIFKINPISKAHFRQFTINDGLQGNQFMARSSLKSSEGKLYFGGINGFNVFQPERFVDNSYIPPVYVTDIRLSYLNDEQEVKKLLQLGKPIYMADKITLSYENNSFTIRFVALSYEDPARNRYSYMLKGVDKEWITNSENNSASYTNLPPGEYEFEVRGSNNDHQWNEKTTTLRVVITPPWWRSSFAYFIYILLLMGWIVWIAWRWNLRVKHKYKHRMEKYQIAKEQEVYKSKIGFFINLVHEIRTPLSLIRLPLEKLQEIEHEGKEAKYLSVIDKNVNYLLGITNQLLDFQKMENGALQLNLVSCDIKEIVNDVYSQFTSPAELKGIELVLTLPEQELVSMVDREKLSKILVNLMGNAIKYARTRIDLKLVTTDAGYEIYVSDDGRGVPDAQKGKIFEAFYQMPDDKVATATGTGIGLAFAKSLAEAHQGSLRLEDNEPQGSSFILSLPLSEKKAEEAADIVEVHSENEGSAENIPSEFSGKKFTVLLVEDNVELLNLTRDSLVAWFRVLKAPNGRAALEILEQESVDVIVSDVMMPEMNGLELCSKVKSEIDYSHIPVILLTAKTTLESKVEGLECGADVYIEKPFSIKQLHKQIENLLRLRQSFHKLMVSLSGNANQASAELAMTQRDCEFVAKIQEVIADQLADENFSIDTLAEQMNMSRSNFYRKIKALSGMSPNDYLKALRMNKAAELIQGGTRISEVAAQVGFTSSSYFAKCFKAQYGVLPKEYVNQLSVSDTAVESTPDADSTI

SEQ ID NO: 21367 - protein, 660 aa, Bacteroides thetaiotaomicron VPI-5482
MQYIKQIMLLVILTISWKCQAEEVKEIWLDELGESSYYIQDWGLPRINKAVTMTPLTVKGIVYERGIGTHAISRMLFDIGKKAKTLSGLAGADDNTPFACNLQFKILGDRKELWRSGIMRKGDPAKPFNIDLSGIDKVLLLVEECGDGMMYDRADWLNVKFTTLGDVQPIPVWPKPIAKEKYILTPQSPDAPQINNPLTYGARPGNPFLMPIMVSGKRPMTYKAKGLPKGLKLNRKTGLITGSTNTNGNFKVRLQATNEKGTDEKEITLKIGSEIMLTPPMGWNSWNCWRFAADDQKVRDAARIMHEKLQAYGWTYVNIDDGWEADERTPEGELPANEKFPDFKTLTDYIHSLGLKFGIYSSPGWTTCGRHIGSCQHELTDAKTWEKWGVDYLKYDYCGYAAIEKNSEEKTIQEPFIVMRNALDQIKRDIVYCVGYGAPNVWNWGAEAGGNLWRTTRDINDQWNIVMAIGCFQDVCAYVSAPGKYNDPDMLVVGKLGPGWGAKSHDSDLTADEQYAHISLWSILSAPLLLGCDMTAIDDFTLGLLTNPEVIAVNQDPLVAPATKLTVPNGQIWYKKLYDGSYALGFFQMDPYFILWDQDKAVNIQQQKYNFNFALNQLGIQGKVKIRDLWRQKNLGIFSGSYETSIPYHGVSLIKITPIK

SEQ ID NO: 21368 - protein, 468 aa, Bacteroides thetaiotaomicron VPI-5482
MKTTINLGYIIFLSVVAALGGFLFGYDTAVISGTIAQVTHLFQLDTLQQGWYVGCALIGSIVGVLFSGILSDSIGRKRTMILSAILFSTSAIGCAFCIDFNQLVVYRIIGGIGIGVVSIVSPLYISEVSVAQFRGRMVSLYQLAVTVGFLGAYLVNYQLLAYSESGNHLPIAWLEKIVVTEVWRGMLGMETLPAIIFFIIIFFIPESPRWLIVKGQERKATYILEKIYNSFKEADFQLNETKSVLVSETRSEWSILLKPGILKAVIIGVCIAILGQFMGVNAVLYYGPSIFENAGLSGGDSLFYQVLVGLVNTLTTILALLIIDKVGRKKLIYYGVSGMVVSLILIGSYFLFGNAWNISSLFLLAFFLCYVFCCAISICAVIFVLLSEMYPTKIRGLAMSIAGFALWIGTYLIGQLTPWMLQNLTPAGTFFLFAIMCVPYMLIVWKLVPETTGKSLEEIERYWTRSER

SEQ ID NO: 21369 - protein, 248 aa, Bacteroides thetaiotaomicron VPI-5482
MGLLDGKTAIVTGAARGIGKAIALKFAAEGANIAFTDLVIDENAEKTRVELEAMGVKAKGYASNAANFEDTAKVVEEIHKDFGRIDILVNNAGITRDGLMMRMSEQQWDMVINVNLKSAFNFIHACTPVMMRQKAGSIINMASVVGVHGNAGQANYAASKAGMIALAKSIAQELGSRGIRANAIAPGFILTDMTAALSDEVRAEWAKKIPLRRGGTPEDVANIATFLASDMSSYVSGQVIQVDGGMNM

SEQ ID NO: 21370 - protein, 452 aa, Bacteroides thetaiotaomicron VPI-5482
MRNIYSIYKEHYKALISLGLPIVIGQIGVIVLGFADTLMIGHHSTIELGAASFVNNVFNLVIIFSTGFSYGLTPIVGGLYGTHQYASAGQALRNSLLANLLVAFLLTIGMTVLYFNVGNLGQPEELIPLIKPYYLVLLASLVFVMLFNGFKQFTDGITDTKTAMWILLGGNVLNIIGNYILIYGKLGLPEMGLLGAGISTLFSRIMMVVVFIIVFMRSPRFLRFKLGFYRLGWSKAIFGRLNSLGWPIAFQMGMETASFSLSAVMIGWLGTIALASHQVMLAISQFTFMMYYGMGAAVAVRVSNFNGQGDILNVRRSAYAGFHLMMALGVVLSSIVFLCRNYLGGWFTDSTEVAAMVTSLILPFLVYQFGDGLQITFANALRGISDVKLMMLIAFIAYFLISLPVGYFCGFVLEWGIIGVWMAFPFGLTSAGLMLWWRFHHKTKLPPSIQNS

SEQ ID NO: 21371 - protein, 785 aa, Bacteroides thetaiotaomicron VPI-5482
MASFRSTKLKITIGYILLLAILLFSLVFVHQEMETLSAADDQQNLRTDSLLSLLHEKDQNTLQMLRVLSEANDSLLSASEIEEIISEQQDSVITQQRVQHRVITKRDSLITTPKKKGFFKRLGEVFAPSKKDTAVLVNTSLEIATDTILEPVKSADSLQHKIRMATEEKRLQRRRTIRRTSTRYQRMNTQLTARMDSLIKGYEEEMSARARQDAELQQEVRMRSANIIAGIAIGAVFLSAFFLILIMRDITRSNRYRRQLEEANKRAEDLLVAREKLMLAITHDFKAPLGSIMGYTELLSRLTEDERQRFYLDNMKSSSEHLLKLVSDLLDFHRLDLNKAEVNRIVFNPAQLFEEIRVCFEPLTAAKGLVLQCHIAPELSEKYISDPLRIQQIVNNLLSNAVKFTQQGKITLTVGYNASKLTIAVADTGKGMASEDRERIFQEFTRLPGAQGEEGFGLGLSIVHKLVLLLEGTIDVQSTLGKGSCFTVVLPLFPVGKSIVENKPCGSRIKKPSKDTDVSPEETDAVPAMKVIRVLLIDDDKIQLNLTAAMLKQHNIDAVCCEQLEELIEQLRSSTFDVLLTDIQMPAINGFDLVKLLRASNIPQARNIPVIAVTARSEMDEKALHEHGFAGCLHKPFTVKELLVTLNEGQMSADEAHITHDMQLIADALPEDTLFNFSALTAFSEDDPEAACSIIRTFIEETGKNADRMQQALTDREVDGIAAMAHKLLPLFTLIGASESVASLRWLESCRGEEFSEEIEKTTLETLEAVRKVVRAAEEYSFGLH

SEQ ID NO: 21372 - protein, 492 aa, Bacteroides thetaiotaomicron VPI-5482
MSFIADKIVMDGLTYDDVLLIPAYSEVLPRTVDLSTKFSRNIELKIPFVTAAMDTVTEAKMAIAIAREGGIGVIHKNMSIEEQARQVAIVKRAENGMIYDPVTIKRGSTVSDALGIMAEYKIGGIPVVDDEGYLVGIVTNRDLRFERDMTKHIDLVMTPKERLVTTNQSTDLESAAQILQKHKIEKLPIVGMDGKLIGLVTYKDITKAKDKPMACKDAKGRLRVAAGVGVTADTLDRMQALVDAGADAIVIDTAHGHSMYVIEKLKEAKKRFPNIDIVVGNIATGEAAKALAEAGADAVKVGIGPGSICTTRVVAGVGVPQLSAVYDVAKALKGTGVPLIADGGLRYSGDVVKALAAGGYCVMIGSLVAGTEESPGDTIIFNGRKFKSYRGMGSLEAMENGSKDRYFQSGTADVKKLVPEGIAARVPYKGTLYEVVYQLSGGLRAGMGYCGAANIEKLHDAKFTRITNAGVMESHPHDVTITSESPNYSRPE

SEQ ID NO: 21373 - protein, 921 aa, Bacteroides thetaiotaomicron VPI-5482
MSSLAQIGWWEADFLAGHYVCSDFLCDLLGLEGDTISFMDFQNLIREDYREQIVQEFRANANIHKDFYEQTFPICLKNGEVWLHTRLALREKGTGTNGGDKSFGVIQRVEAPKEVEQKNTLRRVNDLLRRQNYISQSLLRFLHDDDVDSCIMEILNDVLSLYQGGRVYIFEYNEDYTHHSCTYEVVSEGVSKEKNKQQSIPVNETRWWCEQILSGKPIILTSLKQLPEEAENEYKFLDAQGICSLMVAPLMAGDRVWGFMGIDLVESYREWSNEDFQWFSSLANIISICIELRKAKDRVVREQSFLSNLFHFMPLGYIRMSVVRDENGQLLDYKITDVNKACSRFFARPAETYIGVLASEIYPDFSSQLLFLKEVLDNNSYREKDIFFPQTELYTHWIVYSPEKDEVVGLFTDSTEAVKTNRALDRSEKLFKSIFANIPAGVEIYDKDGFLIDLNNKDLEIFGVENKQDVIGVNFFENPNVPQHIRDRVRDEDLVDFRLNYSFERAEGYYHPDRRDTIDIYTKVSKLYDNEGNFNGYILISIDNTEQIDAMNRIRDFENFFLLISDYAKVGYAKLNLLNRKGYAIKQWYKNLGEEEDTPLADVVGVYRNMHPEDRERIFDFYREVRKGNRKHFQGEMRIYRPGKKNEWNWIRMNVVVTTYNPEENEVEIIGINYDITELKETEKELILARDKAEMMDRLKSAFLANMSHEIRTPLNAIVGFSDLLVDTENIEERREYIQIVKENNDLLLQLISDILDLSKIEAGTFEFTNGDVDVNMLCEDIVRSMQMKVKENVELMFDPHLAECRIISDRNRLHQVISNFVNNAIKFTSEGSIRVGYKQKGEELEFYVQDTGVGIDAESQAHIFERFVKLNSFVHGTGLGLSICQSIVEQMGGKIGVESEPGKGSRFWFSLPCFVVMSEE

SEQ ID NO: 21374 - protein, 647 aa, Bacteroides thetaiotaomicron VPI-5482
MKNEPIYNLLNSINSPDDLRRLEVDQLPEVCDELRQDIIKELSCNPGHFAASLGTVELTVALHYVYNTPYDRIVWDVGHQAYGHKILTGRREAFSTNRKLGGIRPFPSPEESEYDTFTCGHASNSISAALGMAVAAAKKGDDQRHVIAIIGDGSMSGGLAFEGLNNSSTTPNNLLIILNDNDMAIDRSVGGMKQYLFNLTTSNRYNQLRFKASRLLFKLGILNDERRKALIRFGNSLKSMAAQQQNIFEGMNIRYFGPIDGHDIKNLSRVLRDIKDLKGPKILHLHTIKGKGFAPAEKHATEWHAPGKFDPVTGERFVANTEGMPPLFQDVFGNTLVELAEANPRIVGVTPAMPSGCSMNILMSKMPKRAFDVGIAEGHAVTFSGGMAKDGLQPFCNIYSSFMQRAYDNIIHDVAIQNLPVVLCLDRAGLVGEDGPTHHGAFDMAYLRPIPNLTIASPMNEHELRRLMYTAQLPDKGPFVLRYPRGRGVLVDWKCPLEEIPVGKGRKLKDGKDIAVISIGPIGNKARSAIARAESESGRSIAHYDLRFLKPLDEELLHEVGRTFRHIVTIEDGTIQGGMGSAVLEFMADHEYTPTVKRIGIPDKFVQHGTVAELYQLCGMDEDSLTKELLKQCELLPDMSKIKELTN

SEQ ID NO: 21375 - protein, 606 aa, Bacteroides thetaiotaomicron VPI-5482
MYFSFASKDKGSCNVSTCKFIRFPLNSYTFHALIRFFTPQFSKKRTIFHLSILICHWSKLRLCISLPRKLSISTKDYKRMKKHLIAWGILSTMFMANTFAQKDIDRPIMGWSSWNTYHVNISEELIKQQADALIKHGLKEAGYNYINIDDGFFGHRDETGKMHPHPDRFPNGMKVVSDYIHSLGLKAGIYSDAGDNTCGSIYDNDANGVGSGLYGHEQQDMDLYLKEWNYDFIKIDYCGGRELGLDEEKRYSTICQAIANTGRTDVSINICRWAFPGTWAKRLARSWRISPDIRPRWNSVKGIIEKNLYLSAYATDGHYNDMDMLEIGRGLKPNEEEVHFGMWCIMSSPLLIGCDMNTIPDFSLKLLKNKELIALNQDVLGLQAHVVQHENESYVLVKDIERKRGLTRAVALYNPSDQPCDFIVPFETLELGGNVKVRDLIKQKDLGKMKEEIRQTVQPHSVMICKMEAEKRLEPVSYEAEWAYLPCYDDLGKKSKPIVYVPASDCSGRMKISRLGGREENFAEWSEVYSEKGGNYEMTIFYSCDKNRKLEVSVNGTKTVLKDLNSNNEVKSVTIPVSLKQGYNTVRMGNNFGWAPDIDRFTVSRQ

SEQ ID NO: 21376 - protein, 631 aa, Bacteroides thetaiotaomicron VPI-5482
MKQLLRICLTGAFFLLFEGLLSPMLADNGKSDKEILVLNSINFNLPWARNFYWYVHDVLQEQGITARAESLSVPALQDTMEVNAVIEHLRQKYPLPPAAVVIIGDPGWIVCRPLFDDLWKDVPVIITNSRDRLPATLDILLSHASLNETNSVPAQEWRKGYNLTTLKQHYYVKETVELIYSLIPDMDRLAFISDDRYISEETRGDVKEAVEKHFPNLPLELLSTTHLSTEMLLDTLRSYKANTGIIYYSWFESHNKEDNNYLFDHIQEIITNFTSSPLFLLSSEDLSNNTFAGGYYVSAESFGDSLLEIIDRVLHGEQAEDISESIGGKASAYLCYPVLESYNIPYHLYPERAVYVNEPKSIFHQYCVEILSCSIFLLILIAAIAYYIRILRKAYTRLSEAMEKAEQANQLKSAFLANMSHEIRTPLNAIVGFSNMLPDIEDRKEMREYADIIETNTDLLLQLINDILDMSKIEAGTFDFCPSLIDVNQTMEEIEQSMRLRLKKETVTLTFTERLPECTLYTDKNRLIQLISNFVINAIKFTQIGSIRMGYRLKDADTICFYVSDTGCGMSEEQCRHVFERFVKYNPFVQGTGLGLSICQMIIDRLGGTIGVESEEGKGSTFWFTLPYQQE

SEQ ID NO: 21377 - protein, 460 aa, Bacteroides thetaiotaomicron VPI-5482
MKSYNKKFVYSICLVSAMGGLLFGYDWVVIGGAKPFYELYFGIADSPTMQGLAMSVALLGCLIGAMVAGMMADRYGRKPLLLISAFIFLSSAYATGAFSVFSWFLAARFLGGIGIGIASGLSPMYIAEVAPTSIRGKLVSLNQLTIVLGILGAQIANWLIAEPIPADFTPADICASWNGQMGWRWMFWGAAFPAAVFLLLACFIPESPRWLAMKGKREKAWSVLSRIGGNRYAEQELQMVEQTSASKSEGGLKLLFSRPFRKVLVLGVIVAVFQQWCGTNVIFNYAQEIFQSAGYSLGDVLFNIVVTGVANVIFTFVAIYTVERLGRRALMLLGAGGLAGIYLVLGTCYFFQVSGFFMVVLVVLAIACYAMSLGPITWVLLAEIFPNRVRGVAMATCTFALWVGSFTLTYTFPLLNTALGSYGTFWIYSAICVFGFLFFLRALPETKGKSLETLEKDLIK

SEQ ID NO: 21378 - protein, 635 aa, Bacteroides thetaiotaomicron VPI-5482
MEPDTNLYSPNENNEIIRENSQKILSVLAAHQIALWEYDIPTGKCSFTDDYFRTLGLKEAGVVFKDINDFYHFAYPEDINAYQTAFAKMLASESKASQIQVRCVGEHGEVIWLEDHFLSYKGNEEGDPDKLLAYTVNVTSQCEKEQHIKHLEEHNRKIIEALPEFIFIFDENFFITDVLMAPGTILLHPVEVLKGADGRSIYSPEVSDLFLCNIRECLKDGKLKEIEYPLEVDGSKHYFQARIAPFEGNTVLALIHDIGDRIRRSEELIEAKRRAEDADRMKSVFLANMSHEIRTPLNAIVGFSEIMALTENEEEKHEYLEIIQKNSNLLLQLINDILDLSRIESGKSEMHFQQVEIAGLVDEVEKVHQLKMKLNVDLKVVRPQGEFWTSTDRNRVMQVLFNFLSNAIKNTETGSITLGLKQEGDWLKLFVSDTGCGIPEEKLPQIFTRFEKLNDFVQGTGLGLSICKSIVERLGGRIEVSSELGQGSTFALYLPYQEIPVEVAERSLSTKIDSESVRHKKILVVEDIESNFAQLNILLKKEYTILWVRNGQEAINSFIREKPDLILMDIRMPVMDGIQATEKIRTISLSVPIIAVTAYAFYTEQQQAIQAGCNAVISKPYSLEKLKETIETYIG

SEQ ID NO: 21379 - protein, 426 aa, Bacteroides thetaiotaomicron VPI-5482
MKIEKIVAREILDSRGNPTVEVDVVLESGIMGRASVPSGASTGEHEALELRDGDKQRYGGKGVQKAVDNVNKIIAPKLIGMSSLNQRGIDYAMLALDGTKTKSNLGANAILGVSLAVAKAAASYLDLPLYRYIGGTNTYVMPVPMMNIINGGSHSDAPIAFQEFMIRPVGAPSFREGLRMGAEVFHALKKVLKDRGLSTAVGDEGGFAPNLEGTEDALNSIIAAIKAAGYEPGKDVMIGMDCASSEFYHDGIYDYTKFEGAKGKKRTAEEQIDYLEELINKFPIDSIEDGMSENDWEGWKKLTERIGDRCQLVGDDLFVTNVDFLAMGIEKGCANSILIKVNQIGSLTETLNAIEMAHRHGYTTVTSHRSGETEDATIADIAVATNSGQIKTGSLSRSDRMAKYNQLLRIEEELGDLAVYGYKRIK

SEQ ID NO: 21380 - protein, 701 aa, Homo sapiens
MARRGWRRAPLRRGVGSSPRARRLMRPLWLLLAVGVFDWAGASDGGGGEARAMDEEIVSEKQAEESHRQDSANLLIFILLLTLTILTIWLFKHRRARFLHETGLAMIYGLLVGLVLRYGIHVPSDVNNVTLSCEVQSSPTTLLVNVSGKFYEYMLKGEISSHELNNVQDNEMLRKVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 21381 - protein, 347 aa, Danio rerio
MGCTVSAEDKAAAERSKMIDKNLREVKLLLLGAGESGKSTIVKQMKIIHEDGYSEDECKQYRAVVYSNTIQSIMAIIKAMSNLKIDYGESARVDDARQLFALSAAAEEQGILTDDLANVIRRLWADSGVQGCFSRSREYQLNDSAAYYLNDLDRIARSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTETSIILFLNKKDLFEEKITRSPLTICFPEYSGANKYDEAASYIQTKFEDLNKKKDTKEIYTHFTCATDTKNVQFVFDAVTDVIIKNNLKDCGLF

SEQ ID NO: 21382 - protein, 412 aa, Burkholderia multivorans
MSLDSRQLAALAQQYGTPLWVYDADVIRDRIAQLRQFDVIRYAQKANSNVHILKLMRDEGACVDAVSLGEIERSLAAGFSPAGEPEGVVFTADLVDRPTLAAVLKHGVTVNAGSLDMLERVGQHAPGHRVWLRVNPGFGHGHSNKTNTGGPQSKHGIWIDDVPRAIALVRQYGLKLVGIHMHIGSGVDYGHLSQVCDAMVDLVASLGHDIDAISAGGGLSIPYRDGEPRVDVDHYFRQWDAARKRIERHLGHAVRIEIEPGRFLVAEAGTLVTEVQAVNRRPKHDFVLIDAGFNDLMRPAMYGSYHAVSVHAHDGALPEGRPQVDIAIAGPLCESGDVFTQDAGGVVTHRKLPQPQIGDLLFLHDAGAYGASMSSNYNSRPLAPEVLVDRGTPRLIRRRQTIGELLALETFE

SEQ ID NO: 21383 - protein, 256 aa, Delphinium 'MagicFountains dark blue'
MNHEMRTPMKAVIALSSLLLEIELTPEQRVMIETVLKNSNLLAALINDVLELSRLEDGSLELDIRTFSLHGIFREVLNMIKPITAVKKLSLTLMLSPDLPVVAVGDEKRLVQIMLNVVGNAVKFTKEGYVSVIASVAKAESLRDWQAPEIFMVSSDSHFHLCVQVKDSGCGISPQEIPHLFTKFTQLRSGQNRSNDGAGLGLALCKRFLNLMEGHIWVNSDGTDKGCTVTIIVKLGICEGQPEPSNLQVVSRPRLS

SEQ ID NO: 21384 - protein, 256 aa, Delphinium 'MagicFountains dark blue'
MNHEMRTPMKAVIALSSLLLEIELTPEQRVMIETVLKNSNLLAALINDVLELSRLEDGSLELDIRTFNLHGIFREVLNMIKPITAVKKLSLTLMLSPDLPVVAVGDEKRLMQIMLNVVGNAVKFTKEGYVSVIASVAKAESLREWQAPEIFMVSSDSHFHLCVQVKDSGCGISPQEIPHLFTKFTQLRSGQNRSNDGAGLGLALCKRFLNLMEGHIWVDSDGTDKGCTVTIIVKLGICEGQPEPSNLQVVSRPRLS

SEQ ID NO: 21385 - protein, 476 aa, Oryza sativa (japonica cultivar-group)
MDDLAAASPPHPPPPPPESHVPPPPQTPEKDSCEDTGDMRISEEKPCTDQELDADQMNSSSFNSSSECENQTPSNDEMTGSESKSEAAQTEGGGSSEEKVLKKPDKILPCPRCNSMDTKFCYYNNYNINQPRHFCKSCQRYWTAGGSMRNLPVGAGRRKSKSSTANYRSILITGSNLAAPAGDAPLYQLSIKGDQTATAVKFAPDSPLCNSMASVLKIGEQSKNAKPTSTAQPRNGETQTCPASGTTSDSPRNEPVNGAVSGHQNGIVGHSGVPPMHPIPCFPGPPFVYPWSPAWNGIPAMAPPVCTAPAEPANSSDNGSTASVQWSMPPVMPVPGYFPVIPSSVWPFISPWPNGAWSSPWIQPNCSVSASSPTSTSTCSDNGSPVLGKHSRDSKPQGDDKAEKNLWIPKTLRIDDPDEAAKSSIWTTLGIEPGDRSMFRSFQSKPESREQISGAARVLQANPAALSRSQSFQETT

SEQ ID NO: 21386 - protein, 264 aa, Oryza sativa (japonica cultivar-group)
MAAAAGGGTREEMVYMAKLAEQAERYEEMVEFMEKVVTAAAAGGGGELTVEERNLLSVAYKNVIGARRASWRIVSSIEQKEEGRGAAGHAAAARSYRARVEAELSNICAGILRLLDERLVPAAAAVDAKVFYLKMKGDYHRYLAEFKTGAERKDAADATLAAYQAAQDIAMKELSPTHPIRLGLALNFSVFYYEILNSPDRACTLAKQAFDEAISELDTLGEESYKDSTLIMQLLRDNLTLWTSDMQDDGGDEMRDATKPEDEH

SEQ ID NO: 21387 - protein, 361 aa, Oryza sativa (japonica cultivar-group)
MERISTNQLYNSGIPVTVPSPLPAIPATLDENIPRIPDGQNVPRERELRSTPMPPHQNQSTVAPLHGHFQSSTGSVGPLRSSQAIRFSSVSSNEQYTNANPYNSQPPSSGSSSTLNYGSQYGGFEPSLTDFPRDAGPTWCPDPVDGLLGYTDDVPAGNNLTENSSIAAGDELAKQSEWWNDFMNYDWKDIDNTACTETQPQVGPAAQSSVAVHQSAAQQSVSSQSGEPSAVAIPSPSGASNTSNSKTRMRWTPELHERFVDAVNLLGGSEKATPKGVLKLMKADNLTIYHVKSHLQKYRTARYRPELSEGLPRSTFSVFCCILLFIYFVAMYYLFYCHVHQFEIFQVLQKRRQPQKRTYHQ

SEQ ID NO: 21388 - protein, 241 aa, Oryza sativa (japonica cultivar-group)
  unsure (1)..(241): unsure at all Xaa locations
MGRGKIVIRRIDNSTSRQVTFSKRRNGLLKKAKELSILCDAEVGLVVFSSTGXLYEFSSTNMKTVIDRYTNAKEELLGGNATSEIKIWQREAASLRQQLHNLQESHKQLMGEELSGLGVRDLQGLENRLEISLRNIRMRKDNLLKSEIEELHVKGSLIHQENIELSRSLNVMSQQKLELYNKLQACEQRGATDANESSSTPYSFRIIQNANMPPSLELSQSQQREGECSKTAAPELGLHLP

SEQ ID NO: 21389 - protein, 370 aa, Oryza sativa (japonica cultivar-group)
THRALNSSQISLARRSPPPPRSTERRVEGMASEGVLLGMGNPLLDISAVVDDAFLTKYDVKLNNAILAEEKHLPMYDELASKGNVEYIAGGATQNSIRVAQWMLQTPGATSYMGCIGKDKFGEEMKKNAQAAGVTAHYYEDEAAPTGTCAVCVVGGERSLVANLSAANCYKSEHLKKPENWALVEKAKYIYIAGFFLTVSPDSIQLVAEHAAANNKVFLMNLSAPFICEFFRDAQEKVLPFVDYIFGNETEARIFAKVRGWETENVEEIALKISQLPLASGKQKRIAVITQGADPVVVAEDGQVKTFPVILLPKEKLVDTNGAGDAFVGGFLSQLVQQKSIEDSVKAGCYAANVIIQRSGCTYPEKPDFN

SEQ ID NO: 21390 - protein, 176 aa, Oryza sativa (japonica cultivar-group)
MSTESGMLRGAGVGVVSGAVFSIEAVESCIEIWRSSESGKYSIIFVLDIISSLFSGRIVWEKVSPALQRAVQSQMSLLSTPFIDNNDLFETGNTGGMSRDLINRIPKTTFSAATNPDQETDNCCAVCLQDFGASQFVRVLPHCQHTFHARCIDNWLFRHASCPLCRAGVHIDHIHM

SEQ ID NO: 21391 - protein, 244 aa, Oryza sativa (japonica cultivar-group)
SPSTSRGSAGGRGGGDHQRLVVPSSASSMPKGRCSEGESESDSEASDVSGSDGEDHSWISWYCSLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKPSQRYVPRVFGFKLHKP

SEQ ID NO: 21392 - protein, 152 aa, Oryza sativa (japonica cultivar-group)
WGGEGAGQVLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 21393 - protein, 420 aa, Oryza sativa (japonica cultivar-group)
MGGRKRALLVGINYPGTKAELKGCHNDVARMRRALVDRFGFDEADIRVLADADRSAPQPTGANIRRELARLVGDARPGDFLFFHYSGHGTRLPAETGQDDDTGYDECIVPSDMNLITDQDFTELVQKVPDDCLFTIVSDSCHSGGLLDKTKEQIGHSTKQNQAQQIKREERSDSGTGGFRSFLKETLKETVRDAFESRGVHIPHQSSRRNDDEDEEPHMGSSSHGGDRIKNRSLPLSTLIEMLKEKTGKDDIDVGSIRMTLFSLFGDDASPKIKKFMKVMLTKLQEGQHGGVMGLVGALAQEFMKAKLEGNQEADALEPAMKQEVHSVHEAYAGTTARVSNGVLISGCQTDQTSADATTPKGVSYGALSNAIQTILSEKSGRVTNKELVLRARELLSKQGYTQQPGLYCSDKHTSVAFIC

SEQ ID NO: 21394 - protein, 684 aa, Oryza sativa (japonica cultivar-group)
MANARNAAAASPPPPSSSSSYSSSASDGEILRSLHRLARDLAAAEAPAPFLETVFAAVSRRAKLLAAVFDDLLRCGRLPRSASLCLREVLLVLQRFKAVVADCSARSRMRLLLQADEVAARVRELQHDLATLLDLLPVPELGLADDVVDLLALASRQCRRSSPSADAAEHELKTGVLALIQEVEREIVPERERLEGILEEVGINDPACCSDEIETLEREIGDRVAERWTSAMIALVGLLRYAKCVLFTAATPRPMDTKVDVDDDDDDDDAEPPSPPPDFRCPISLDLMRDPVVSASGQTYDRESITRWFGSGKSTCPKTGQVLANLELVPNKALKNLISRWCRENGVAMESSEPSKPEPAPVVTANKAALEAARMTASFLVKKLSVSFSPAAANRVVHEIRQLARSGNDTRAFIGEAGAVPLLVPLLHSDDTATQLNAVTALLNLSILDANKKRIMHAEGAVEAICHAMGSGATWRAKENAAATVLSLASVHSYRRRLGRNPRVVERVVHLVRTGPSSTKKDAIAALLCLSGERENVGKLVEAGAAEAALSAISEEETAVAVLASLAKRGGAEAIVNIDGAVVRLVAELRRGTEWSRECAAAALVLLCRRVGAAVVAQVMSVSGVEWAIWELMATGTERARRKAASLGRACRRWAAADKPRSTPPPPTSRRRPLQRREIPPRPH

SEQ ID NO: 21395 - protein, 485 aa, Oryza sativa (japonica cultivar-group); identical to SEQ ID NO: 3478

SEQ ID NO: 21396 - protein, 252 aa, Oryza sativa (japonica cultivar-group)
HHHLQQPHPQAPPPPPPQQQQQPVPPSFRNALPVPVDGQIPAPLPFFNPPPAFQGQPAQPPLVDAMGLTAAAGLGWGQPREQELLGENSQMSSIDFLQTGSAVSTGLALSLEDRRHGGGSGAGAGNSSGDSPLLLLPMLDDDISREVQRLDADMDRFIKAQSERLRQSILEKVQAKQFEALASVEDKILRKIRDKEAEVENINKRNSELEDQIKQLAVEVGAWQQRAKYNESMTNALKYNLEQVCAHQSKDP

SEQ ID NO: 21397 - protein, 288 aa, Oryza sativa (japonica cultivar-group)
DLDHNTITGVEPSYQRFTCLKSLSLRHVSISALDLSLLVAACPKIESLALDFLEVVTSDPQSTMELTSHTLKSLFAKSVGVDKIILDTDNLEVLNLNALNLDLFELIGKGTLKHLKIDDVSVTHMDIGESTDHLEVVDVSNFTIVRPKLYSMISRASNLRMLRFWGVVFDDEDEIVDSETIAVSFPLLRHLSLSYELRDGLLHYSLQGSSPLDNVSVLELGWTVISEHFGPWVFGMIERCPNLKKLVIHGVLSEAKTREERQMLASFTSFIVCLMRKYVHVDVQFEYE

SEQ ID NO: 21398 - protein, 245 aa, Zea mays; identical to SEQ ID NO: 5982

SEQ ID NO: 21399 - protein, 245 aa, Zea mays; identical to SEQ ID NO: 1093

SEQ ID NO: 21400 - protein, 251 aa, Zea mays; identical to SEQ ID NO: 865

SEQ ID NO: 21401 - protein, 373 aa, Cichorium intybus
VLELGFFRTPSSSRWYLGMWYKKLSERTYVWVANRDNPLSCSIGTLKISNMNLVLLDHSNKSVWSTNHTRGNERSPVVAELLANGNFVLRDSNKNDRSGFLWQSFDYPTDTLLPEMKLGYDLRTGLNRFLTSWRSSDDPSSGDFSYKLQTRRLPEFYLFKDDFLVHRSGPWNGVGFSGMPEDQKLSYMVYNFTQNSEEVAYTFLMTNNSIYSRLTISSSGYFERLTWTPSSGMWNVFWSSPEDFQCDVYKICGAYSYCDVNTSPVCNCIQRFDPSNVQEWGLRAWSGGCRRRTRLSCSGDGFTRMKKMKLPETTMAIVDRSIGLKECEKRCLSDCNCTAFANADIRNGGTGCVIWTGQLEDIRTYFANGQDLY

SEQ ID NO: 21402 - protein, 380 aa, Lotus corniculatus
MSSTAGQVIKCRAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMISDNQSRFSIKGKPIYHFVGTSTFSEYTVLHAGCVAKINPAAPLDKVCILSCGICTGFGATVNVAKPKPGSSVAIFGLGAVGLAAAEGARVSGASRIIGVDLVSSRFEGAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPNVVEMYMRGELELEKFITHTVSFSEINKAFDYMLKGESIRCIIRMEE

SEQ ID NO: 21403 - protein, 542 aa, Lotus corniculatus
MAARTLSYLLSRSRSLSSSSGAASLLPSLGGKSGGWRNSNNRYSTAAVVEELITPQVSINYTQHLINGKFVDAASGKTFPAYDPRTGDVIAHVAEGDAEDVNRAVAAARKAFDEGPWPRMTAYERSRILLRFADLVEKHNDEIAALETWNNGKPYEQAAKAEVPTFVRLFRYYAGWADKIHGLTVPADGNYHVQTLHEPIGVAGQIIPWNFPLLMFAWKVGPALACGNTIVLKTAEQTPLTALVVAKLLHEAGLPPGVLNIVSGYGPTAGAPLASHMDVDKLAFTGSTDTGKVVLGLAAKSNLKPVTLELGGKSPFIVCEDADVDKAVELAHFALFFNQGQCCCAGSRTFVHERVYDEFLEKSKKRALRRVVGDPFKKGVEQGPQIDTEQFEKILRYIKSGIESNATLECGGDRLGSKGFYVQPTVFSNVQDDMLIAQDEIFGPVQTIFKFKEIDEVIRRANSTRYGLAAGVFTQNLATANTLMRALRAGTVWINCFDVFDAAIPFGGYKMSGIGREKGIYSLHNYLQVKAVVTPLKNPAWL

SEQ ID NO: 21404 - protein, 179 aa, Enterococcus faecalis V583
MSWLKRSVAAVKRNDPAARTTLEVLLTYPGLHALFWHRLSHFLYRHQLFLLAKIHAQFWRFITGVEIHPGATIGAGVFIDHGMGIVIGETAEIEEDVVLFHGVTLGGTGRDTGKRHPTVKKGAMISARAQILGPVVIGERSKIGAGAVVISDIPADATAVGVPAKVVRLNGRKVEKGHD

SEQ ID NO: 21405 - protein, 496 aa, Enterococcus faecalis V583
MSKKEINQVVASSYQLYINGEWTTGSGNKMIASYNPSNGEKLAEFVDATNADVDRAVEAAQEAFQTWKDVDVVTRSNLLLKIADLIEENQEHLAMVETLDNGKPLRETQSIDVPASADHFRYFASVIRGEEGSVKEFDKDTLSIVVKEPIGVVGQIIPWNFPLLMGAWKLAPALAAGNTVVIHPSSSTSLSLLELFKIFDQVLPKGVVNLITGRGSDSGNYMLAHPGFDKLAFTGSTEVGYTVAKAAADRLIPATLELGGKSANIIFEDANWERALEGVQLGILFNQGQVCCAGSRVFVQSGIYDQFVEALKEKFEQVNVGFPWEKDVEMGAQINEHQLEEILKYVEIGVKEGATLITGGQRLTENGLDKGAFLAPTLLANGTNAMCVAQEEIFGPVATVIKFETEEEVIRLANDSEYGLGGAVFSQDINVALRVARGVRTGRMWVNTYNQLPAGAPFGGYKKSGIGRETHKSMLDAYTQMKNIYIVTKEEADGLY

SEQ ID NO: 21406 - protein, 262 aa, Enterococcus faecalis V583
MEFKMNDFQLDGKVALITGAVYGIGFEIAKSLAEAGATIVFNNLSPESVEQGLENYRAAGIEARGYVCDVTDEEQVQAMVAQIKEEVGSIDILVNNAGIIKRIPMVDMSAEEFRQVIDVDLNAPFIMAKAVIPDMIEKGHGKIINICSMMSELGRETVSAYAAAKGGLKMLTKNIASEYGQYNIQCNGIGPGYIETPQTAPLREPGHPFNEFILGRTPANRWGTPADLAGPAVFLASNASDFVNGHILYVDGGILAYIGKQP

SEQ ID NO: 21407 - protein, 279 aa, Enterococcus faecalis V583
MITSLADTVTLNNGTKIPGMGLGVFQIPDEETAKVVEEGIINGYRLIDTAQIYGNESGTGAGIKAGLAATGLNREDLFVTSKVWNAHISYDETIQAFNDSLERLGLDYLDLYLIHWPGNNSYKESWQALETLYAEGKVKAIGVSNFQVHHLEDLLSYAKVVPVINQVELHPKLDQKEVRDFCEKHDIKVQAWSPLMQGQLLSNETILAIAENHNKSAAQVILRWDIQQDILLAVKSVHKERMISNAAVFDFELSAEEMAQINQLNESLRVGPDPDTFDF

SEQ ID NO: 21408 - protein, 575 aa, Enterococcus faecalis V583
MSEMLKGIAASDGVAVAKAYLLVQPDLSFNKTSVEDTDAEATRLDDALAKSTEELQAIRDKAAQSLGEAEAQVFDAHLMVLSDPEMVGQIKQNIQDNKVNAEAALKEVTDMYIGMFEAMDDNAYMQERAADIRDVAKRILAHLLGVTLPNPSMINEEVIVVAHDLTPSDTAQLDRTYVKAFVTDIGGRTSHSAIMARSLEIPAIVGTKEITDKVKAGDILAVNGIIGDVIIDPTDAEKSEFEAEAKAYADQKAEWDKLKNAETVTADGKHVELAANIGTPKDLEGVHKNGGEAVGLYRTEFLYMDSSDFPTEEDQYQAYKAVLEGMEGKPVVVRTMDIGGDKELPYLTLPHEMNPFLGYRALRISLSELGDGMFRTQMRALLRASVHGNLRIMFPMVATLKEFRAAKAIFEDEKQKLVNEGVEVSNDIQVGIMIEIPAAAVLADKFAKEVDFFSVGTNDLIQYTMAADRMNERVSYLYQPYNPSILRLIKNVIDAAHAEGKWAGMCGEMAGDQTAVPLLLGMGLDEFSMSATSILKTRSLMKRLDTTKMAELADRALKECDTMEEVFALVEEYTK

SEQ ID NO: 21409 - protein, 222 aa, Enterococcus faecalis V583
MFKGVLFDLDGVITDTAEFHYHAWKKLGNEIGISIDRVFNEQLKGVSREDSLQLLLKYGKKEGTFSSEEFAQLAQRKNDYYLEMIQAITPEDVYPGILSLLTELREANIKIALASASKNGPFLLEKMQLTPLFDAIANPADVQAGKPAPDIFILAAKEIDLTPAECLGIEDAKAGIQAILASGAQPVGVGRKEELGEGLPIVPETSALTFDYLKKVWLDHEG

SEQ ID NO: 21410 - protein, 881 aa, Enterococcus faecalis V583
MKKFIYSFNETHNEGKETLGGKGANLAEMTRLGLPIPQGFTITTRCCMDYLADATFFEEHLQSEILKAVKNLETETGKSFTADNEILLVSVRSGAAFSMPGMMDTILNLGLNDQRVKKFATLTSPGFAFDCYRRLIQMFGDVVYHIPKELFDQQKERLEQELNKKITAFQEEDHFALIVRYQEVFEQHQVVFPQDPVAQLFEAIKAVFDSWNNQRAVVYRNLHHIAHDLGTAVNIQEMVFGNRGLDSGTGVVFTRNPVTGENQLFGEFLLNAQGEDVVAGIRTPEPIRRLRLTMPKVYQDFRHYAELLEYHYRDMQDIEFTIENEKLYILQTRNGKRTAAATVKIALDLAKENRITKQEALLRVTPDTIDQLIHPVFDQEKRQHMERLAMGLPASPGAASGQIVFTAEKAKELTNLGKKVILVRQETSPEDIEGMVVSEAIVTSRGGMTSHAAVVARGMGTCCVTGCESLTVNEETKQLHCGPQVILEGTIISVDGSTGEIYLGEIPTISADNNDDLQELLSWADAYADLTVRANAETTQDLETAIRFGAAGIGLARTEHMFFGEERVLEMRRLILAESEKEATYALEQLLHFQQEDFYQMLKVVQDKPMVVRLLDPPMHEFLPHEKNDIQLLAKQLQRFPVTIAKQIERLQETNPMLGHRGCRLGVTQPQIYKMQVTALFTSAIRLVKEGITVYPEVMIPLIAEKEELLYLKRILKETIDGLFEEHKMTPFPYEIGTMIELPRACLIADQLAEEADFFSFGTNDLTQMTYGFSRDDIGKFINTYREKKIITQDPFQSLDQTGVGQLIQLAVEKARRTKPNMSIGVCGEVGGDPQSITFFQTLGLNYISCSPYRVPIAKLAAAQAKILTEPAVTEEQMVLL

SEQ ID NO: 21411 - protein, 233 aa, Enterococcus faecalis V583
MDAYEIIQYIGDAKKQTLVKVTLKGQLKEVTFPETIKVFNNCKTGTLFGDWADVKPFLEANKEKIEDYVVENDARNSAIPFLDLKDINARIEPGALIREKVEIGDQAVIMMGAILNIGAVVGAGTMIDMGAVLGGRATVGKHCHIGAGTVLAGVIEPPSAAPVVIENEVVIGANAVVLEGVRVGEGAVVAAGAVVVEDVPAHTVVAGVPAKVIKQIDDKTKSKTEILEELRKL

SEQ ID NO: 21412 - protein, 274 aa, Enterococcus faecalis V583
MTLDKTKKLANGNEMPRLGLGVWRVEDGSEATNSVKWALEVGYRLIDTAAVYKNEVGVGEGIRQSGIPREEIFVTTKLWNEDQGYENAIKAFDKSLEKLGLDYVDLYLIHWPVAGKYKESWKALEEIYASGRAKAIGVSNFHQHHLEDLLTEANVVPMVDQIELHPTLTQEPLRKYLAENKIAVEAWSPLGQGNLLSEPVLVKIGEKYGKSAAQVIIRWHLQNDIIVIPKSVHEKRIQENFAVFDFELTPEEITAINQLNKDHRFGADPDNFDF

SEQ ID NO: 21413 - protein, 489 aa, Enterococcus faecalis V583
MKYLYQQLLAFIGVIALIILIVGTSFTQLTKRTMQENNYEQLYGYAESALETRDFFINVAGVSDRDVLSYSFQLTERVLQKQDVQFVFINKDREVQYPPVDSTKKLDFSLIDKNWDQIMKGNRVYATENIDIYGARNTSSYVMLPVYASNQSSDKKVIIGSLVITQPAKNVDRSVQSVTQNLIKGFIFSGVIALLLSYLFATFQVKRINRMRKATKEITSGNFDIQLPVHDKDEFDDLAEDFNKMAASLKESQEEINRQEERRRQFMADASHEMRTPLTTINGLLEGLQYNAIPENQKENAIKLMQNETARLIRLVNENLDYEKIRTNQIQIVVKKFNGTEALENIVTQLTAKAEAAGNQLYLDTTEPIDVYADYDRFVQVVVNIVQNAIQFTENGEIHIALEKGYLETIVRISDTGIGMTEEQILNIWDRYYKVDPSRKNTKYGESGLGLPIVQQLVRLHKGKINVESELGKGTTFIISFPDVEITEN

SEQ ID NO: 21414 - protein, 325 aa, Enterococcus faecalis V583
MAQKTMIQAITDALALELEKDENVLIFGEDVGNNGGVFRATEGLQEKFGEDRVFDTPLAESGIGGLAFGLALQGYRPVPEIQFFGFVFEVFDEIVGQMARTRYRMGGTRNMPITVRAPFGGGVHTPELHSDNLEGLIAQSPGVRVVIPSNPYDAKGLLISSIRSNDPVVYLEHMKLYRSFREEVPDEAYEVPLDKAAVTREGTDVSIITYGAMVREAIKAADSLAKDNISAEIIDLRTVAPLDVETIINSVEKTGRVVVVQEAQKQAGVGAMVVSEISERAVLSLEAPIGRVSAPDTIFPFGQAENIWLPNAKDIEAKAREIVEF

SEQ ID NO: 21415 - protein, 430 aa, Enterococcus faecalis V583
MLFGTAKMNRENHLEIGGCDTVKLAQKFGTPLFVYDVAHIRAQARGFKQTLNQLGIKNKVVYASKAFSCLAIYQVLKEEDIACDVVSGGELFTALKGGMEPAEIEFHGNNKTPEELRYALDNKIGTIVIDNFYEIDLLEELLATRNQTQKVLFRVSPGVDAETHDYILTGQEDSKFGFDVASGQATEALVRLLSNPSFDVQGVHCHIGSQIFAVEGFLAAVEKMFTILEDWRQVHQFTARVLNMGGGFGVQYTQQDEPLAPATFVEKIVYSLKGHCEQLGYPLPELWIEPGRSLIAEAGTTIYTVGAQKEVPGVRHFVSVDGGMGDNIRPALYQAVYDGFLANRDGHDSVKEVTVVGKYCESGDVLLRDILLPEVKAGDLLAISSTGAYGYSMASNYNRNPRPAVVFVEDGQAKLVARRETYEDMTTLDC

SEQ ID NO: 21416 - protein, 368 aa, Enterococcus faecalis V583
MEKETSKKYEAAVAAFIKENKPKGTVVYDDLANQLATPYTLDAEAMEKLIQKVEDAGISVVDENGDPSEHSLKKDEKEAEKAQAEDLSAPTGVKINDPVRMYLKEIGRVQLLTAAEEVELALKIEEGDQEAKQRLAEANLRLVVSIAKRYVGRGMQFLDLIQEGNMGLMKAVEKFDYRKGFKFSTYATWWIRQAITRAIADQARTIRIPVHMVETINKLIRIQRQLLQDLGREPTPEEIGAEMDLPTEKVREILKIAQEPVSLETPIGEEDDSHLGDFIEDQDATSPAEHAAYELLKEQLEDVLDTLTDREENVLRLRFGLDDGRTRTLEEVGKVFGVTRERIRQIEAKALRKLRHPSRSKQLKDFLE

SEQ ID NO: 21417 - protein, 684 aa, Enterococcus faecalis V583
MEFTFLIIVFALSITFSNIFNRIVPVIPLPIVQIIVGVLIGLTKMGQEIEFEPEVFLVMIIAPLLFREGELINLKAMMKNFGMILFLAFFGVLITLVGVGWTLHMILPTLPLAACFAFGAALGPTDAVAVGSLSGRIDIPERSMNILSGEGLINDASGVTAFQFALAALLTGSFSPVEAAGTLVISSIGGAVVGIVLVLLKQQIVHLLETAVAKDVTGYLLIELLLPFIAYLISELIGVSGIIAAVIAGIMQASSLKKVSLFEAELSNVGESIWSLIEFTLNALVFLFLGIELSQVFSPIWIDQQYSNWFLLLVVLIISAVVFLIRFLAIFSVYTLQHGLKKVKNAMNEMLILTFGGVKGTVSLATIFILPTAINGEHFKERPLLLFITACVILVTLIGGILVLPFLTDSETEVENEESVEIDLLRDVIDVLKQQNEENPRGEMNAVIENYQDRLKELYTEQLSAERKQEVQELRTLIVSIERDGLEESLKQGEISVRSYRMYQRLITRMQRSIAKQLLSIVGFWLLFARQIISILLHPKLFFNRGEASEEEKELRNEELENIRQVFLRNSQVILKSLDNLRGVYDDDLIDFFIDGRLDLAHKFEKGEFIDSYIVHTETDYVKDLLLGFQEERRMIDHYEQSERISIIEANELRKNVNLLESYSISGEVNNVPLKRFVKNFNKE

SEQ ID NO: 21418 - protein, 328 aa, Enterococcus faecalis V583
MAEMTYLEAINLGISEEMARDEKVVIFGEDVGGDKGGVFGVTKGLAAKYGDERCFNTPLTEGLIGGLAVGLGLMGYRAIGEFQFADYILPATNQLLSEARTMRYRTKGDWTAPIVYRTPYGGGVRGGLYHSQSTEKVFCGQPGLRVVTPSNPYDAKGMIKAAIRSDDPVIFYEHKRLYRLLKDEVPADDYIVPIDKANVVRTGSDLTVISYGMTLQLALAAAEKLAAEGIDAEIVDVRSLYPLDRETLVAAAKKTGKVLLVTEDNKEGSVMSEIAAMISEDALFDLDAPIQRLAGPDCPSMPYALPLEREFLINEEQVLAAMKELAEF

SEQ ID NO: 21419 - protein, 195 aa, Enterococcus faecalis V583
MAKKGGFFLGAVIGGTAAAVAALLLAPKSGKELRDDLSNQTDDLKNKAQDYTDYAVQKGTELTEIAKQKAGVLSDQASDLAGSVKEKTKDSLDKAQGVSGDMLDNFKKQTGDLSDQFKKAADDAQDHAEDLGEIAEDAAEDIYIDVKDSAAAAKETVSAGVDEAKETTKDVPEKAAEAKEDVKDAAKDVKKEFKG

SEQ ID NO: 21420 - protein, 254 aa, Enterococcus faecalis V583
MPKEFETKRVLVTGAASGIGQAQAIAFAEQGAEVIGIDLDETGLKQTAALVDPDSAKSFTYFVGDVSSPSFVQATMKQIVKNNGQIDILLNTAGILDDYRPSLETSEALWDQILATNLKSVFLVTNAILPYFLQQKKGVIVNMASIAGLVAGGGGAAYTASKHAIIGYTKQLSYDYAKLGIRANAIAPGAIQTPMNAADFAGEGEMAAWVARETPAGRWAQPQEVAKLSLFLASDDADYIHGTVMTIDGGWTMK

SEQ ID NO: 21421 - protein, 432 aa, Enterococcus faecalis V583 [sequence omitted]

SEQ ID NO: 21422 - protein, 173 aa, Enterococcus faecalis V583
MGKKETTLTQEEKEFFMREAIAEAKKAEGLAEVPIGAVIVRQGEIIGRGHNLREARQEATAHAEMYAIQEACRGIENWRLEETQLFVTLEPCPMCSGAMLLARIPEVYYGATDPKAGTAGTLMNLLEDERFNHVAYVEAGVLEEECRLLLVQFFKKLRAKKKEEKLLKNQKKD

SEQ ID NO: 21423 - protein, 267 aa, Enterococcus faecalis V583
MDFNMDMFRLDGKVALITGAVYGIGFEIAKSLAAAGATIVFNNLTQESVDEGSANYKAEGIEAKGYVCDVTDEKAVQAMVKQIKEEVGSIDILVNNAGIIKRIPMTDMSATDFRQVIDVDLNAPFIMSKAVIPEMIEKGGGKIINICSMMSELGRETVSAYAAAKGGLKMLTKNIASEYGQFNIQCNGIGPGYIATPQTAPLRELQENGERHPFDQFIVGRTPAARWGDPVDLAGPSVFLASQASDFVNGHVLYVDGGILAYIGKQP

SEQ ID NO: 21424 - protein, 259 aa, Enterococcus faecalis V583
MYGELHGKVAVVTGAATGLGLFITLRYILEGMNVVADYVGELPKEFEDVQAKHADRVKFVKADVSNEEDIKALAETALKEFGHVDIWVNNAGVEASFPTIDMPLKEWQRVIDVNLNGVFLGSREALRIFRDQKIKGSIINMSSVHQRIPWPTFAHYAASKGATEMFTKTIALEYAEYGIRANCIAPGAINTPINAEKFSDPEQLKQTTSMVPMGIIGKPNQVAAAAAWLASDESSYVTGTTLFVDGGMSLYPSFQHGAG

SEQ ID NO: 21425 - protein, 325 aa, Enterococcus faecalis V583
MKVFDYEDVQLIPNKCIVNSRSECDTTVTLGKHSFKMPVVPANMQTIIDETIAETLAENGYFYIMHRFDEEARVPFIKKMQQKGLITSISVGVKEGEYAFVETLAREGLVPDYVTIDIAHGHSNAVINMIQHLKKSLPETFVIAGNVGTPEAVRELENAGADATKVGIGPGKVCITKIKTGFGTGGWQLAALRWCAKAARKPIIADGGIRTHGDIAKSVRFGATMVMIGSLFAGHEESPGETKVEDGVVYKEYFGSASEFQKGEKKNVEGKKIWLRHKGKLADTLVEMQQDLQSSISYAGGRDLEAIRKVDYVIVKNSIFNGDTI

SEQ ID NO: 21426 - protein, 184 aa, Enterococcus faecalis V583
MKTILLGVSGSISAYKAADITSQLAKLGYNVEILMTKSSTAFITPLTLQSLSKNPVHTDVMMEIDPSKINHIELAKKADLFLVAPASANTIGKLAHGIADDLLSTVALALYPETPKIIAPAMNTYMYQNPIVQRNIGILKEVGYQEIIPREALLACGDYGRGALATVEDILQTVMKILASDNKE

SEQ ID NO: 21427 - protein, 245 aa, Enterococcus faecalis V583
MELTGKNVFITGSTRGIGKAVALAFAKEGANIVLNGRSEITPEQRQEIEAFGVKCIGLSGDISDFDAAGEMIQATVDQLGSIDILVNNAGITNDKLLLRMTKEDFNACLDINLVGTFNMTQQAVKRMMKQRSGRIINMASVSGLMGNVGQANYAASKAGVVGFTKSVAREVAPRGITCNAIAPGFIQTEMTDVLSEKVKTQMNAQIPLQTFGQVEDVAATAIFLAKSPYITGQVVNVDGGLVMHG

SEQ ID NO: 21428 - protein, 218 aa, Enterococcus faecalis V583
MKKFDGVIFDMDGLLFDTELIYYTSTQKVADAMGLPYSKEVYLDYVGISDEEVQENYRRIYASYGHDTVEEFIRRSYDDTLQEFRSGNVPLKPGVVEFLDFLDDQKIPRLVASSNVRPAIEMLLSHAGIQDRFVGIVSAEDVKRAKPDPEIFQKARQLLGTEAPKTLIFEDSFHGVSAAHSAGIPVIMVPDLLQPTEVIQEKTLHVLESLHQAPHYLK

SEQ ID NO: 21429 - protein, 216 aa, Enterococcus faecalis V583
MTIGFIFDLDGVITDTAKFHYQAWKALADSLGIPIDETFNETLKGISRMDSLDRILVHGHRENAFTPAEKEALAQQKNDHYVQLLEQLTTEDVLPGVVPLLQQAQARHIPCAVASASKNAPLILEKLGVRAYFATIVDPDSLSKGKPDPEIFLAAADSIGVLPQNAIGFEDAQSGIDGLKAAGIYAVGLSASQPLIGADMQVSEMTELSVDALLNR

SEQ ID NO: 21430 - protein, 493 aa, Enterococcus faecalis V583
MSNWETKFAKKGLTFDDVLLIPAESHVLPNDVDMSVQLAKNIKLNIPLMSASMDTVTDSNMAIAMARQGGLGVVHKNMTVAQQADEVRKVKRSESGVIIDPFFLTPTNLVADAEELMSRYRISGVPIVETMENRKLVGIITNRDMRFVTDYQIKIEEVMTKDHLVTAPVGTSLKDAEKILQKHKIEKLPIVDEAGRLSGLITIKDIEKVIEFPNAAKDEHGRLLVAAAVGVTSDTFERAEALLEAGADAIVIDTAHGHSAGVIRKIKEIRETFPEATLIAGNVATAEATKALYDVGVDVVKVGIGPGSICTTRVVAGVGVPQLTAIYDAASVAREYGKAIIADGGIKYSGDIVKALAAGGHAVMLGSMLAGTDESPGEFEIYQGRRFKTYRGMGSLGAMEKGSSDRYFQGSVNEANKLVPEGIEGRVAYKGSVSDIVFQLIGGLKSGMGYVGAADLKALREEAQFVQMSGNGLKESHPHDVQITKEAPNYSVQ

SEQ ID NO: 21431 - protein, 774 aa, Danio rerio
MSSTRGQNTHGLKQIGLEQIWDDLRSGIQQVYTRQSMARSRYMELYTHVYNYCTSVHQARPTGIPSSKPSKKTPTPGGAQFVGLELYKRLKDFLRSYLTNLLKDGEDLMDESVLKFYTQQWEDYRFSSKVLDGICAYLNRHWVRRECDEGRKGIYEIYSLALATWRECLFRPLNKQVTNAVLKLVEKERNGETINTRLVSGVVQSYVELGLNEDDAFVKGPTLSVYKEYFEAQFLADTERFYTRESTEFLQQNPVTEYMKKAEARLLEEQRRVQVYLHESTQDELARKCEQVLIEKHLEIFHTEFQNLLDADKNEDLGRMYNLVSRITDGLGELKKLLESHIHNQGLAAIEKCGDSALNDPKMYVQTTLDVHKKYNALVMSAFNNDAGFVAALDKACGRFINNNAVTRMAQSSSKSPELLARYCDSLLKKSSKNPEEAELEDTLNQVMVVFKYIEDKDVFQKFYAKMLAKRLVHQNSASDDAEASMISKLKQACGFEYTSKLQRMFQDIGVSKDLNEQFKKHLSNSEPLDLDFSIQVLSSGSWPFQQSCTFALPSELERSYQRFTAFYGSRHSGRKLTWLYHLSKGELVTNCFKNRYTLQASTFQMAILLQFNTENCYSVQQLADSTQIKTDILVQVLQILLKSKLLVLEDENANIDEMDFKPDTLIKLFLGYKNKKLRVNINVPMKTEQKQEQETTHKNIEEDRKLLIQAAIVRIMKMRKVLKHQQLLAEVLNQLSSRFKPRVPVIKKCIDILIEKEYLERVDGEKDTYSYLA

SEQ ID NO: 21432 - protein, 308 aa, Giardia intestinalis
MSVSAAPSATSIDRYRRITKLGEGTYGEVYKAIDTVTNETVAIKRIRLEHEEEGVPGTAIREVSLLKELQHRNIIELMSVIHHNHRLHLIFEYAENDLKKYMDKNPDVSMRVIKSFLYQLINGVNFCHSRRCLHRDLKPQNLLLSVSDASETPVLKIGDFGLARAFGIPIRQFTHEIITLWYRPPEILLGSRHYSTSVDIWSIACIWAEMLMKTPLFPGDSEIDQLFKIFEVLGLPDDTTWPGVTALPDWKQSFPKFRGKTLKRVLGALLDDEGLDLLTAMLEMDPVKRISAKNALEHPYFSHNDFDP

SEQ ID NO: 21433 - protein, 524 aa, Zea mays
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYITVRFLIGFSLATFVSCQYWMSTMFSSKIIGTVNGLAAGWGTMGRRRHAAHMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCAQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 21434 - protein, 165 aa, Malva pusilla
RNSARAAFEDGDLKLFESGAINHYVAHEYADKGTQLLITGSNKETAVLQLWREVEAHQFDPPCSKIVWEVYYKPIFGMVTDAAAVEENEAKLVKVLDVYETRLSQSKYLACDYFTLADLNHLPNIQCLLATPSKKLIDSRPHVSAWVKDITARPAWTKVVAMQKQ

SEQ ID NO: 21435 - protein, 173 aa, Escherichia coli
MIKIVNEDLHAFTKNGSFASKVKCTIISHTFHLVLMIRLGQFLSKIPVIGAFFRLVIEYSIRIIFSSDISLRARIGGGLVIMHGHDIVIGRDVVIGRNCKILNGVTLGNKDTESTENQQPVVGDNVIIGTGAKILGKVVIGNNVKIGANSVVISDIAPDSVAVGIPARVTKGI

SEQ ID NO: 21436 - protein, 116 aa, Petunia x hybrida
MAKSSATKDAQALFHSLRSAYTATPTNLKIIDLYVIFAIFTALIQVVYMALVGSFPFNSFLSGVLSCVGTAVLAVCLRIQVNKENKEFKDLPPERAFADFVLCNLVLHLVIMNFLG

SEQ ID NO: 21437 - protein, 415 aa, Lytechinus variegatus
MMAHTARNSNMNTLGFKKLQNLDNENAGARLGAKSMAVQKPAQRAALGNISNTMRTTQVAGKKVVKKDARTKTMVKSKATSSLQSVASLPVPVDKPDICRSPLPQVVDKMEVDSVESAIEAFSQQLIDLQVEDIDKDDSDNPQLCSEYVKEIYLYMRSLEKRMAVPAAYLDREGQLTGRMRHILVDWLVQVHLRFHLLQETLFLTVQLIDRFLVDHTVSKGKLQLVGVTAMFIASKYEEMYPPEINDFVYITDQAYTKSQIRQMEIVMLKGLGYNLGKPLCLHFLRRNSKAAMVDPQKHTLAKFLMEITLPEYNMVQYDPSEIAAAALYMSMRLLGSEEDGWGAKMTHYSMYNEDHIRPIVRKMAQAVIRNDAMTEKYHAVKTKYRSSRFMNISTLPELESDLIKSLAEDGEERM

SEQ ID NO: 21438 - protein, 358 aa, Brassica oleracea
MVAVERVESLAKSGINSIPKEYIRPKEELESINDVFQEEKKEDGPQVPTIDLQDIESEDETIREKCIEELKKAAMDWGVMHLINHGVPVELMERVKKSGEEFFGLPVEEKEKYANDQAKGKIQGYGSKLANNASGQLEWEDYFFHLVYPEDKRDLSLWPKTPTDYIEATSEYAKCLRLLATKVFKALSIALGLEPDRLENEVGGIEELLLQMKINYYPKCPQPELALGVEAHTDVSALTFILHNMVPGLQLFYEGKWVIAKCVPDSIVMHIGDTLEILSNGKFKSILHRGLVNKEKVRISWAVFCEPPKEKIVLKPLPEMVSVESPAKFPPRTFAQHIEHKLFRNEQEELVTEKKDEV

SEQ ID NO: 21439 - protein, 375 aa, Salix discolor
MDPEAFTASLFKWDTRAMVPHPNRLLEMVAPPQQPPAAAFAVRPRELCGLEELFQAYGIRYYTAAKIAELGFTVNTLLDMKDEELDEMMNSLSQIFRWDLLVGERYGIKAAVRAERRRLDEEDPRRRQLLSGDTNTLDALSQEGFSEEPVQQDKEAAGSGGRGTWEAVTAGERKKQPGRKKGHRKVVDLDGDDEHGGAICERQREHPFIVTEPGEVARGKKNGLDYLFHLYEQCRDFLIQVQNIAKERGEKCPTKVTNQVFRYAKKAGASYINKPKMRHYVHCYALHCLDEDASNALRRAFKERGENVGAWRQACYKPLVAIASRQGWDIDSIFNAHPRLAIWYVPTKLRQLCYAERNGATASSSVSGTGVHLPF

SEQ ID NO: 21440 - protein, 773 aa, Caenorhabditis elegans
MSNSEPSTSTPSGKTKKRGKKCETSMGKSKKSKNLPRFVKIQPIFSSEKIKETVCEQGIEECKRMLKGHFNAIKDDYDIRVKDELDTDIKDWLKDASSSVNEYRRRLQENLGEGRTIAKFSFKNCEKYEENDYKVSDSTVTWIKPDRTEEGDLMKKFRAPCSRIEVGDISPPMIYWVPIEQSVATPDQLRLTHMPYFGDGIDDGNIYEHLIDMFPDGIHGFSDNWSYVNDWILYKLCRAALKDYQGSPDVFYYTLYRLWPNKSSQREFSSAFPVLCENFAEKGFDPSSLEPWKKTKIAEGAQNLRNPTCYACLAYTCAIHGFKAEIPIEFPNGEFYNAMLPLPNNPENDGKMCSGNCWKSVTMKEVSEVLVPDSEEILQKEVKIYFMKSRIAKMPIEDGALIVNIYVFNTYIPFCEFVKKYVDEDDEESKIRSCRDAYHLMMSMAENVSARRLKMGQPSNRLSIKDRVNNFRRNQLSQEKAKRKLRHDSLRIQALRDGLDAEKLIREDDMRDSQRNSEKVRMTAVTPITACRHAGPCNATAENCACRENGVCSYMCKCDINCSQRFPGCNCAAGQCYTKACQCYRANWECNPMTCNMCKCDAIDSNIIKCRNFGMTRMIQKRTYCGPSKIAGNGLFLLEPAEKDEFITEYTGERISDDEAERRGAIYDRYQCSYIFNIETGGAIDSYKIGNLARFANHDSKNPTCYARTMVVAGEHRIGFYAKRRLEISEELTFDYSYSGEHQIAFRMVQTKERSEKPSRPKSQKLSKPMTSE

SEQ ID NO: 21441 - protein, 1207 aa, Lycopersicon esculentum
MKAHKTVFNQHPLSLNKLFFVLLLIFFLPPASPAASVNGLYKDSQQLLSFKAALPPTPTLLQNWLSSTGPCSFTGVSCKNSRVSSIDLSNTFLSVDFSLVTSYLLPLSNLESLVLKNANLSGSLTSAAKSQCGVTLDSIDLAENTISGPISDISSFGVCSNLKSLNLSKNFLDPPGKEMLKAATFSLQVLDLSYNNISGFNLFPWVSSMGFVELEFFSLKGNKLAGSIPELDFKNLSYLDLSANNFSTVFPSFKDCSNLQHLDLSSNKFYGDIGSSLSSCGKLSFLNLTNNQFVGLVPKLPSESLQYLYLRGNDFQGVYPNQLADLCKTVVELDLSYNNFSGMVPESLGECSSLELVDISYNNFSGKLPVDTLSKLSNIKTMVLSFNKFVGGLPDSFSNLLKLETLDMSSNNLTGVIPSGICKDPMNNLKVLYLQNNLFKGPIPDSLSNCSQLVSLDLSFNYLTGSIPSSLGSLSKLKDLILWLNQLSGEIPQELMYLQALENLILDFNDLTGPIPASLSNCTKLNWISLSNNQLSGEIPASLGRLSNLAILKLGNNSISGNIPAELGNCQSLIWLDLNTNFLNGSIPPPLFKQSGNIAVALLTGKRYVYIKNDGSKECHGAGNLLEFGGIRQEQLDRISTRHPCNFTRVYRGITQPTFNHNGSMIFLDLSYNKLEGSIPKELGAMYYLSILNLGHNDLSGMIPQQLGGLKNVAILDLSYNRFNGTIPNSLTSLTLLGEIDLSNNNLSGMIPESAPFDTFPDYRFANNSLCGYPLPIPCSSGPKSDANQHQKSHRRQASLAGSVAMGLLFSLFCIFGLIIVAIETKKRRRKKEAALEAYMDGHSHSATANSAWKFTSAREALSINLAAFEKPLRKLTFADLLEATNGFHNDSLVGSGGFGDVYKAQLKDGSVVAIKKLIHVSGQGDREFTAEMETIGKIKHRNLVPLLGYCKVGEERLLVYEYMKYGSLEDVLHDRKKIGIKLNWPARRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKQPTDSADFGDNNLVGWVKLHAKGKITDVFDRELLKEDASIEIELLQHLKVACACLDDRHWKRPTMIQVMAMFKEIQAGSGMDSTSTIGADDVNFSGVEGGIEMGINGSIKEGNELSKHL

SEQ ID NO: 21442 - protein, 1207 aa, Lycopersicon peruvianum
MKAHKTVFNQHPLSLNKLFFVLLLIFFLPPASPAASVNGLYKDSQQLLSFKAALPPTPTLLQNWLSSTDPCSFTGVSCKNSRVSSIDLSNTFLSVDFSLVTSYLLPLSNLESLVLKNANLSGSLTSAAKSQCGVTLDSIDLAENTISGPISDISSFGVCSNLKSLNLSKNFLDPPGKEMLKGATFSLQVLDLSYNNISGFNLFPWVSSMGFVELEFFSIKGNKLAGSIPELDFKNLSYLDLSANNFSTVFPSFKDCSNLQHLDLSSNKFYGDIGSSLSSCGKLSFLNLTNNQFVGLVPKLPSESLQYLYLRGNDFQGVYPNQLADLCKTVVELDLSYNNFSGMVPESLGECSSLELVDISNNNFSGKLPVDTLLKLSNIKTMVLSFNKFVGGLPDSFSNLPKLETLDMSSNNLTGIIPSGICKDPMNNLKVLYLQNNLFKGPIPDSLSNCSQLVSLDLSFNYLTGSIPSSLGSLSKLKDLILWLNQLSGEIPQELMYLQALENLILDFNDLTGPIPASLSNCTKLNWISLSNNQLSGEIPASLGRLSNLAILKLGNNSISGNIPAELGNCQSLIWLDLNTNFLNGSIPPPLFKQSGNIAVALLTGKRYVYIKNDGSKECHGAGNLLEFGGIRQEQLDRISTRHPCNFTRVYRGITQPTFNHNGSMIFLDLSYNKLEGSIPKELGAMYYLSILNLGHNDLSGMIPQQLGGLKNVAILDLSYNRFNGTIPNSLTSLTLLGEIDLSNNNLSGMIPESAPFDTFPDYRFANNSLCGYPLPLPCSSGPKSDANQHQKSHRRQASLAGSVAMGLLFSLFCIFGLIIVAIETKKRRRKKEAALEAYMDGHSHSATANSAWKFTSAREALSINLAAFEKPLRKLTFADLLEATNGFHNDSLVGSGGFGDVYKAQLKDGSVVAIKKLIHVSGQGDREFTAEMETIGKIKHRNLVPLLGYCKVGEERLLVYEYMKYGSLEDVLHDRKKTGIKLNWPARRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKQPTDSADFGDNNLVGWVKLHAKGKITDVFDRELLKEDASIEIELLQHLKVACACLDDRHWKRPTMIQVMAMFKEIQAGSGMDSTSTIGADDVNFSGVEGGIEMGINGSIKEGNELSKHL

SEQ ID NO: 21443 - protein, 1021 aa, Daucus carota
MGVLRVYVILILVGFCVQIVVVNSQNLTCNSNDLKALEGFMRGLESSIDGWKWNESSSFSSNCCDWVGISCKSSVSLGLDDVNESGRVVELELGRRKLSGKLSESVAKLDQLKVLNLTHNSLSGSIAASLLNLSNLEVLDLSSNDFSGLFPSLINLPSLRVLNVYENSFHGLIPASLCNNLPRIREIDLAMNYFDGSIPVGIGNCSSVEYLGLASNNLSGSIPQELFQLSNLSVLALQNNRLSGALSSKLGKLSNLGRLDISSNKFSGKIPDVFLELNKLWYFSAQSNLFNGEMPRSLSNSRSISLLSLRNNTLSGQIYLNCSAMTNLTSLDLASNSFSGSIPSNLPNCLRLKTINFAKIKFIAQIPESFKNFQSLTSLSFSNSSIQNISSALEILQHCQNLKTLVLTLNFQKEELPSVPSLQFKNLKVLIIASCQLRGTVPQWLSNSPSLQLLDLSWNQLSGTIPPWLGSLNSLFYLDLSNNTFIGEIPHSLTSLQSLVSKENAVEEPSPDFPFFKKKNTNAGGLQYNQPSSFPPMIDLSYNSLNGSIWPEFGDLRQLHVLNLKNNNLSGNIPANLSGMTSLEVLDLSHNNLSGNIPPSLVKLSFLSTFSVAYNKLSGPIPTGVQFQTFPNSSFEGNQGLCGEHASPCHITDQSPHGSAVKSKKNIRKIVAVAVGTGLGTVFLLTVTLLIILRTTSRGEVDPEKKADADEIELGSRSVVLFHNKDSNNELSLDDILKSTSSFNQANIIGCGGFGLVYKATLPDGTKVAIKRLSGDTGQMDREFQAEVETLSRAQHPNLVHLLGYCNYKNDKLLIYSYMDNGSLDYWLHEKVDGPPSLDWKTRLRIARGAAEGLAYLHQSCEPHILHRDIKSSNILLSDTFVAHLADFGLARLILPYDTHVTTDLVGTLGYIPPEYGQASVATYKGDVYSFGVVLLELLTGRRPMDVCKPRGSRDLISWVLQMKTEKRESEIFDPFIYDKDHAEEMLLVLEIACRCLGENPKTRPTTQQLVSWLENIDVSS

SEQ ID NO: 21444 - protein, 366 aa, Filobasidiella neoformans
MTIDQSQINFNVPSTYKLEEIVGEGAYGLVVAGTHLPSGTQVAIKRITPFDHTMFCQRTLREIKLLRHFHHENIISILDLIQPESYEVFNEVYLVQELMETDLHRVIRSQELSDDHCQYFVYQTLRGLKALHSADVLHRDLKPSNLLLNANCDLKICDFGLARSSAKPPPGTSDGGQGFMTEYVATRWYRAPEVMLSFQEYTKAIDLWSVGCILAEMINGKPLFPGRDYHHQLSLILQVLGTPTMDDFNEITSQRSKDYLRALEFTRRQDFSAICPKAKPAAVDLLKQTLTFSPSKRITVEEALMHSYVEAYHDPHDEPNAEPLKPGFFDFEFHQEKLSRDQWKRMIYDEVQDPVPTILSQWTESH

SEQ ID NO: 21445 - protein, 387 aa, Debaryomyces hansenii
MVSDGEFTRTQIFGTVFEITNRYTDLNPVGMGAFGLVCSAIDKLTGQNVAVKKIMKPFLTSVLAKRTYRELKLLKHLRHENLITLDDIFLSPLEDIYFVTELQGTDLHRLLTSRPLEKQFIQYFTYQILRGLKYVHSAGVIHRDLKPSNILINENCDLKICDFGLARIQDPQMTGYVSTRYYRAPEIMLTWQKYDTEVDLWSVGCILSEMIEGKPLFPGKDHVHQFSIITELLGSPPPDVIETICSENTLRFVQSLPHRDPIPFSERFAQCTHVEPEAIDLLAKMLIFDPKKRISALDALSHPYMEPYHDPTDEPVCEVKFDWSFNDADLPVDTWRVMMYSEILDFHQIIGAGANGTTQEQMAQIQQEGIQAPSSQYQQTNQEQKVE

SEQ ID NO: 21446 - protein, 375 aa, Geomys knoxjonesi
MSTAGKVIKCRAAVLWEKNKPFSIEEVEVAPPKAYEVRIKIVATGICRSDDHVVNGSIITPLPAILGHEAGGIVESIGEGVTTVKPGDKVIPLFVPQCGKCRACKHPESNLCTHGDLGRAQGTLMDGTSRFTCKGKPIHHFLGVTTFSEYTVVSEISVTKIDAASPLEKVCLIGCGFSTGYGSAVKVGKVARGSICSCVWSGRVGLSAIIGCKAAGAARIIAVDINKDKFAKAKELGATECVNPQDYDKPIYQVLQEMTDGGVDFSFEVIGRLDTMVSALMCCQESHGVSVIVGVPPNAQSLTMDPMVLLSGRSWKGAVFGGYKGKDDVPKLVADFMAKKFPLEPLITNVFPFAKINEGFDLLRAGKSIRTVLTF

SEQ ID NO: 21447 - protein, 498 aa, Danio rerio
MNEYEENRPLLVNDERTEEDRSEQDAYLDKVKNGKLFIATFAAVLGPLSFGFVLGYSSPAIPELRRIQDLRLQLSVEEASWFGSVVTIGAALGGLLGGWIVERIGRKLSLMFCAIPFIFGFTTIIAAQNHWMFYVGRVLTGLASGVTSLVVPLYISEMAHERVRGTLGSCVQLMVVIGIMGAYVTGLFLDWRWLAVASSIPPTLMLLSMCFMPETPRFLLCQGKRREAEDALRFLRGPDAPAEWECARIEDAYKNEEQSFSLGDLKDPGVYKPLGIGVMMMLLQQFTGINAIMFYAETIFEQAHFKSSDVATVIVAATQVVFTAIAALIMDKAGRKVLLILSGVVMCVSEAVFGVYFKLTVMKPNNSSMTSVLTDTHGLLEDQPSADLAWLAVGSMGFFIAGFAIGWGPTPWLVMSEIFPTRVRGLGSALCVLTNWTCAFIVTKTFQNLMDALSSAGTFWMFSALCASNVVFTAFFVPETKGKTLEEIQAGFKGTRMR

SEQ ID NO: 21448 - protein, 289 aa, Danio rerio
MCQRACEAAIAAGYRHIDTAFCYRNEVDVGMAIQNKIQQGIIRRQDMFIVSKLWGTHHAPEDIPVCFNKSLSDLQLDYLDQYLVHFPVGLKKVGDELFPERDGKILTTDIDYVDVWRGMEALKATGKVKSIGVSNFTMEQIDRLLSVAKIPPAVNQVELHPYLVQSDLIDYCKSKNIALTAHSPFGSPGRPLEFQTGDEDPMGLLEDPVVVDVARKHRRTPAQVLLRYHIQQDIAVIPKSVKPHHILENTKIFDFTLDEEDMNALKSLNRGWRACIITELEAHYFYPFK

SEQ ID NO: 21449 - protein, 377 aa, Danio rerio
MIILYFLTLRLLKSFRSLLNFEKMGCTLSSDDKSAQERSKMIDRNLRDDGEKASREVKLLLLGAGESGKSTIVKQMKIIHEAGYSEEECKQYRVVVYSNTIQSIIAIIRAMGRLRIDFADPERADDARQLFVMAGSVDEGFMTSELAGVIKRLWRDEGVRLCFHRSREYQLNDSASYYLNDLDRISNSSYVPTQQDVLRTRVKTTGIVETHFTFKDLHFKMFDVGGQRSERKKWIHCFEGVTSIIFCVSLSDYDLVLAEDEEMNRMHESMKLFDSICNNKWFTDTSIILFLNKKDLFEEKIRMSPLSICFPEYPGSDVYEEAAAYIQCQFEDLNKRKDTKEIYSHFTCATDTKNVQFVFDAVTDVIIKNNLKDCGLF

SEQ ID NO: 21450 - protein, 298 aa, Danio rerio
MESFQKVEKIGEGTYGVVYKAKNKVTGETVALKKIRLDTETEGVPSTAIREISLLKELNHPNIVKLRDVIHTENKLYLVFEFLHQDLKRFMDSTSVSGISLPLVKSYLFQLLQGLAFCHSHRVLHRDLKPQNLLINAQGEIKLADFGLARAFGVPVRTYTHEVVTLWYRAPEILLGCKYYSTAVDIWSLGCIFAEMITRRALFPGDSEIDQLFRIFRTLGTPDESIWPGVTSMPDYKPSFPKWARQDLSKVVPPLDEDGRDLLGQMLTYDPNKRISAKNALVHRFFRDVTMPVPPLRL

SEQ ID NO: 21451 - protein, 329 aa, Mus musculus
GGLDRGSRRRRRPRSGRAAQPAQPAATEVVMGKEEEIARIARRLDKMVTRKNAEGAMDLLRELKNMPITLHLLQSTRVGMSVNALRKQSSDEELIALAKSLIKSWKKLLDVSDGKSRNQGRGTPLPTSSSKDASRTTDLSCKKPDPPRTPSTPRITTFPQVPITCDAVRNKCREMLTLALQTDHDHVAVGVNCEHLSSQIEECIFLDVGNTDMKYKNRVRSRISNLKDAKNPGLRRNVLCGAITPQQIAVMTSEEMASDELKEIRKAMTKEAIREHQMARTGGTQTDLFTCNKCRKKNCTYTQVQTRSSDEPMTTYVVCNECGNRWKFC

SEQ ID NO: 21452 - protein, 270 aa, Physcomitrella patens
MSTAFQAVWLVCVGLLSLQAAEAGYLAQNGYHERWVRARGTWYGDPYGEGSSGGNCGYTKLWGTPIGPKIVAGSRSIYANGQGCGQCYQIRCVDPNGGPRLCNPQGTNVVVTDFCPGGTYCSTGENAFDMSGAAINAMALRGREGQLRNRGLYNLLYKRVPCRYRGTNIEFRVDNGSSPFWLSILIKYVGGPGDIGQVYIRMANWYKFQPMRHAWGANWMIPNYDGKPFRGPMDIRIVSRLNRHTVLARGVIPAYFRPGTSYRSRVQMAF

SEQ ID NO: 21453 - protein, 268 aa, Physcomitrella patens
MGGFQLGLLLLCCVVGVSQAWDLPGGVKLSAEGYNENWLGGHATWYGDPYGEGSSGGACGYTQLTGTPIGSKIAAGNAPIFQEGKGCGQCYEVKCNYPSCSPQGTRIVITDLCPGGQYCSTDQPAFDFSGAAITAMALPGRDGELRNIGLYDIQYKRVPCEYPNQNIAFKVDAGSSKYWFSFTVKYLGGPGDINTVEVKCGKNGYFQYAQHSWGANWMLINYSGVPFQFPLTIKITTKLNDHTVVAEDVIPDWFGPGVQYESNVQIRY

SEQ ID NO: 21454 - protein, 260 aa, Triticum aestivum
PEQRLMVETVLKSSNLLATLINDVLDLSKLEDRSLELEIRAFNLHAVFKEVMGFIRPIAAIKRLSMSVMLTPDLPLCAIGDEKRLMQTILNISGNAVKFTKEGHITLLASVLKPDSLREFRTPDFHPAASDDHFYLKVQLKDTGCGISPQDLPHVFTKFAQTQPGGNQGYSGSGLGLAICRRFVTLMGGHIWLDSEGAGRGCTATFIIRLGVSDNTDAYQQQLAPLAWPGSANVESAGPKALHEETWPPSSLKPRYQRSV

SEQ ID NO: 21455 - protein, 359 aa, Vitis vinifera
MSPPLLGVGEEEGQSNVTILASSASMESVCQISSGLKERNYMGLSECSSVDSSAISTDSDGNKSSLNLKATELRLGLPGFLSPGREPELCLLSSTKLDEKPLFPLHPSKDLTYTSSQKTVVSGNKRGFADAMNGFSEGKFLANSEVNVMLSPRPSPNKENLGSQPAKMKEMASPKIVQERPRATNETPPNHTGTGNNNSSAPATKAQVVGWPPIRSFRKNTLATTSKNTEVDGKAGPGALFVKVSMDGAPYLRKVDLRNYSAYQELSSALEKMFSCFTIGQYGSHGAPGREMLSESKLKDLLHGSEYVLTYEDKDGDWMLVGDVPWQMFIETCKRLRIMKSCDAIGLAPRAVEKCKNRN

SEQ ID NO: 21456 - protein, 583 aa, Penicillium marneffei
MYNAHRGMVPAPNNRLTELLEQLRQEFESQSRSTGEFEHQLTGQIQEMEMIRQKVYQLEQAQIKIKAEYENEIRVLRHELESRGVQTVPSHVGGPTHAGPSQAPPALGHGTNNLFGGIMANQGGSGPGLAPPPPQEQQPPQHGLQQPAPAAQQGPPQPPQSSYGGYQPSAGVNGYGPPPPPTASPGPGKGRGRAPPGPATPQQTHQLNYPAPGASPQIPRPTPTGQLVRERPGNTLANWNPDDLPASQKREGPDWYAVFNPEVQRVLDVELVHHLVHDSVVCCVRFSRDGKYVATGCNRSAQIFDVATGQNVATLQDESVDKDGDLYIRSVCFSPDGKYLATGAEDKQIRVWDIATRSIKHVFTGHEQDIYSLDFAGNGRYIASGSGDKTVRLWDVLEGKLVYTLSIEDGVTTVAMSPDGHYVAAGSLDKSVRVWDTTTGYLVERLENPDGHKDSVYSVAFAPNGRDLVSGSLDKTIKMWELTAPRGMLPGTGVKGGKCVRTFEGHKDFVLSVCLTPDGHWVMSGSKDRGVQFWDPNTGSAQMMLQGHKNSVISVAPSPTNNLFATGSGDMRARIWRYVEFPE

SEQ ID NO: 21457 - protein, 639 aa, Avena sativa
MSKLLVIAILLLPLISHGRDLSTIWVWEDKDFFKYCPPSQCSQHGPEIRYPFCLASSNTSSCGCGSRSVRKLVCSGQDTILVHPVLGPYNVSAIDYRHSSMKLIPLVDPCMVLQKKLISSRSSSSSQVYDDNDYDEDYDEYHEFLDPSATLVYCSREFTPSAADRIAGPVSCLSNTTHFLYFVASDEVISLLPLDCKVIPVSDGGGGRTIAMYMYAPVSMLDLYPQSFKESAESILSFAKKTVYWNGYNCRQCELSGGRCAFSAQRLEPFCMPHGSRTKVIAATSSVAAFVVLLLTVATALYLSLRTRYNEEIHLKVEMFLKTYGTSKPTRYTFSEVKKIARRFKEKVGQGGFGSVYKGELPNRVPVAVKMLENATGEGEVFINEVATIGLIHHANIVRLLGFCSEGMRRALIYEFMPNESLEKYIFSHDPNIFQNVLVPNKLLDIALGIARGMEYLHQGCNQRILHFDIKPHNILLDYNFNPKISDFGLAKLCAKDQSIVTLTAARGTMGYIAPELYSRNFGGISYKSDVYSFGMLVLEMVSGRRNSDPSTESQNDVYLPEWIYEKVINGQELALTLETTEEEKEKVRQLAIVALWCIQWNPRNRPSMTKVVNMLTGKLQNLQMPPKPFVTSENQPMP

SEQ ID NO: 21458 - protein, 641 aa, Avena sativa
MSKLLAIAILLLPLIDHGIDLATAWDDKDFFKYCPPSRCSQHGPEIRFPFCLESINTSSCGCGSRSIRKLACSGQDTILLHPVLGPYNVSAIDYRHSSMKLIPLVDPCMVLQKKLINFRSSPCPQIDDINDNLLVHFYRSTSLVCCSGEFTPSAADRIAGPISCLSNATHFLYFAAGYEDMSLLPLDCKVVPVSDGLYGRIPTYILDDPIVGRYQQSQLFKESAEIILSSAEMTVYWYDGAQNANTMGDTARSTHKGKLHSACLTLTNSTKVPLVAFLSNHIEPTTSSVAVFVVLLLTTVTMIYLSLRTRYSEEIHFKVEMFLQTYGTSQPTRYTFSEVKKIARRFKEKIGQGGYGSVYRGELQNRVPVAVKMLENSRGEGEVFINEVAPIGLIHHANIVRLVGFCSEGTRRALIYEFMPNESLEKYIFSHDPNIFQHLLVPQKLLDIALGIARGMEYLHQGCNQRILHFDIKPHNILLDYNFNPKISDFGLAKLCPRDQSIVTLTAARGTMGYIAPELYSRNFGEISYKSDVYSFGMLVLEMVSGRRNSDPSIESQNKVYLPEWIYEKVINDHELALPAETTEEEKEKVRQLAIVALWCIQWNPRNRPSMTKVVNMLTGSLQNLQMPPKPYVTSENQLMP

SEQ ID NO: 21459 - protein, 619 aa, Avena sativa
MSREEMKGATFSCGHLQGISYPFRRRGDPLECGVGAYELGCTSSKATIHINTGAYYVTAINYTGSYFWVMDANFDTYSSCPLPLWNHLPYSGYYGKFDSHGFRNLATQSYYRACFANCSRAVTDNSAYKPVACLSADNSHVYVWVSNYECTVDDLEPYCGYLSMIPLGDDWQIQLQDASYADITQLITKGFTVQFPVDTNAWSVSVSKTISICLNDSISYFKEQISDASMVKRIRAYFWSEMHFYQCVAYRSYNSDYTATSILVVIAIVSAIAIPKFLFAYKYWKTRITIDAVEKFLRIQQMIVPTRYSYTDIVAITSHFRDKLGQGGYGSVYKGVLLPGGVHIAVKLLEGNSSCNGEDFISEVSTIGRIHHVNVVRLVGFCAEEMRRALVYEYMPHGSLDKYIFSADKSFSWDKLNEIALGIARGINYLHQGCDMQILHFDIKPHNILLDSNFVPKVADFGLAKLYPRGESFVPLSALRGTIGYIAPEMISGSFGVISSKSDVYSFGMLLLEMAGGRRNADPNAGTSSLGYYPSWVYDQLTRRDAGEISPVSNMHELEKKLCVVGLWCIQMRSRDRPTMSDVIEMLEAGAGGCRCLRGRFSAMKGTSMWRNLTISLLS

SEQ ID NO: 21460 - protein, 1050 aa, Rattus norvegicus
MDAAGRGCHLLPLPAARGPARAPAASSALSPAGLCSGTASASSAAAGAVAMNPSSSAGEERGATGGSSSSGSGAGSCCLGAEGGVDPRGAGAAAAAALEEPAAAGQKEKEEALEEKLRDLTFRKQVSYRKAISRTGLQHLAPAHPLGLPVANGPAIEPRATLDWSENAVIGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGTEQENKGRPLVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTIVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGLHYDKEKLREASIPLGILVVRGDCDLETCRMYIDRLQEDLQSVSSGSQRVHYQDQETSFPRAISAQRLSPRWCFLDATSADRFYRIDRSQEHLHFVMEISHDEIFILDPDMVVSQQAGTPPGMPDLVVEQASGLSDWWNPALRKRMLSDSGMITPHYEDSDLKDFSHSRVLQSPVSSEDHAILQAVITGDLMKLMESYKNGGSLLIQGPGHCSLLHYAAKTGNGEIVKYILDHGPAELLDMADSETGETALHKAACQRNRAVCQLLVDAGASLRQTDSKGKTPQERAQQAGDPDLAAYLESRQNYKIIGHEDLETAV

SEQ ID NO: 21461 - protein, 840 aa, Rattus norvegicus
MDAAGRGCHLLPLPAARGPARAPAASSALSPAGLCSGTASASSAAAGAVAMNPSSSAGEERGATGGSSSSGSGAGSCCLGAEGGVDPRGAGAAAAAALEEPAAAGQKEKEEALEEKLRDLTFRKQVSYRKAISRTGLQHLAPAHPLGLPVANGPAIEPRATLDWSENAVIGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGTEQENKGRPLVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTIVQLDRWNLHVERNPDLPPEELEDGVCKLPLNVFNNYFSLGFDAHVTLEFHESREANPEKFNSRFRNKMFYAGAAFSDFLQRSSRDLSKHVKVVCDGTDLTPKIQELKFQCIVFLNIPRYCAGTMPWGNPGDHHDFEPQRHDDGYIEVIGFTMASLAALQVGGHGERLHQCREVMLLTYKSIPMQVDGEPCRLAPAMIRISLRNQANMVQKSKRRTSMPLLNDPQSVPDRLRIRVNKISLQDYEGLHYDKEKLREASIPLGILVVRGDCDLETCRMYIDRLQEDLQSVSSGSQRVHYQDQETSFPRAISAQRLSPRWCFLDATSADRFYRIDRSQACFSPLGTFALCDGDFS

SEQ ID NO: 21462 - protein, 591 aa, Rattus norvegicus
MDAAGRGCHLLPLPAARGPARAPAASSALSPAGLCSGTASASSAAAGAVAMNPSSSAGEERGATGGSSSSGSGAGSCCLGAEGGVDPRGAGAAAAAALEEPAAAGQKEKEEALEEKLRDLTFRKQVSYRKAISRTGLQHLAPAHPLGLPVANGPAIEPRATLDWSENAVIGEHLWLETNVSGDLCYLGEENCQVRFAKSALRRKCAVCKIVVHTACIEQLEKINFRCKPTFREGGSRSPRENFVRHHWVHRRRQEGKCKQCGKGFQQKFSFHSKEIVAISCSWCKQAFHNKVTCFMLHHIEEPCSLGAHAAVIVPPTWIIKVKKPQNSLKASNRKKKRTSFKRKASKRGTEQENKGRPLVIKPISSPLMKPLLVFVNPKSGGNQGTKVLQMFMWYLNPRQVFDLSQEGPKDALELYRKVPNLRILACGGDGTVGWILSILDELQLSPQPPVGVLPLGTGNDLARTLNWGGGYTDEPVSKILCQVEDGTIVQLDRWNLHVERNPDLPPEELEDGVCKLPLNVFNNYFSLGFDAHVTLEFHESREANPEKFNSRFRNKMFYAGAAFSDFLQRSSRDLSKHVKVVLSWMRLSDS

SEQ ID NO: 21463 - protein, 210 aa, Agapanthus praecox
MGRGKIEIKRIENSTNRQVTFSKRRNGIIKKAREISVLCESQVSVVIFSSCGKMSEYCSPNTSFPRILERYQHNCGKKLWDAKHENLNAQIDRVKKENDNMQIELRHLKGEDLNSLNPKELIPIEEALENGLNGVRAKQMEYLKMLKKNERLLEEENKRLTYILRHQQLAMEGNVRQLDLGYHQREREFAAQMPMAFRVQPIHPNLQQNK

SEQ ID NO: 21464 - protein, 243 aa, Agapanthus praecox
MGRGRVELKRIENKINRQVTFSKRRNGLLKKAYELSVLCDAEVALIVFSSRGKLYEFGSAGTSKTLERYQRCCYTSQDATIADREKQNWYQEVARLKAKFESLQSAQRHLLGEDLGPLSVKELQQLERQLEASLSQARQRKTQIMFDQMEELRKKEHHLGEINKQLKTKLEAEGENLRAIQGSWESDATNVGGGNVFSMHPSHSSAMECEPTLQIGYHQLVQPEGSLPRNSGGENNFMLGWVL

SEQ ID NO: 21465 - protein, 256 aa, Selaginella remotifolia
ETWLVTTTSSSNPEVGLATGLAATGGAQDLLNPPLNKQKEPPVGRGKIEIKRIENATSRQVTFSKRRGGLLKKAHELSVLCDAQVALIIFSSTGKLFEYASTSMKEILDRYGKYPESVQGGNMASHHEASDFISHEIRRLKQQLQRSQQSRRHLLGDDLSHLPIKDLQNLEQQLEVGLSRVRSRKDQVLMDQVDELRRRELTLHKDNEMLRRRLSDVQGMAESGRSTLIVNPWRQGNLLQTWQMYPCHFLDTKAAA

SEQ ID NO: 21466 - protein, 501 aa, Oryza sativa (japonica cultivar-group)
MPRRPSGGGGGAGPAAAAVRKVPLRKLLRAASVACGVQFGWAPQLSLLTPYVQELGIPHAFASLVWLCGPLSGLLVQPLVGHLSDRIAPAASPLGRRRPFIAAGAASIAAAVLTVRFSADLGRIFGDSITPGSTRLGAITAYLVGFWLLDVGNNATQGPCRAFPADLTENDPKRTRIANAYFSLFMALGNILGYATGAYSGWYKIFPFTVTPSCSISCANLKSAFLLDIIILVVTTCITVASVQEPQSFGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQVIVSLGSGPWDQLFGGGNAPAFAVAAAASFIGGLVAILGLPRARIASRRRGHR

SEQ ID NO: 21467 - protein, 595 aa, Oryza sativa (japonica cultivar-group)
MDSAAGGGGLTAIRLPYRHLRDAEMELVSLNGGTPRGGSPKDPDATHQQGPPAARTTTTRKLVLACMVAAGVQFGWALQLSLLTPYIQTLGIDHAMASFIWLCGPITGFVVQPCVGVWSDKCRSKYGRRRPFILAGCLMICFAVTLIGFSADLGYILGDTTEHCSTYKGSRFRAAIIFVLGFWMLDLANHTVQGPARALLADLSGPDQCNSANAIFCTWMAVGNVLGFSSGASGNWHKWFPFLMTRACCEACSNLKAAFLVAVVFLLFCMSVTLYFAEEIPLEPTDAQRLSDSAPLLNGSRDDNNASNEPRNGALPNGHTDGSNVPANSNAEDSNSNRENVEVFNDGPGAVLVNILTSMRHLPPGMYSVLLVMALTWLSWFPFFLFDTDWMGREVYHGDPNGNLSERKAYDNGVREGAFGLLLNSVVLGFGSFLVDPLCRLMGARLVWAISNFTVFICMLATAILSWISFDLYSSKLHHIIGANKTVKNSALIVFSLLGLPLSITYGVPFSVTAELTAGTGSGQGLATGVLNLAIVVPQIVVSLGAGPWDALFGGGNVPAFALASVFSLGAGVLAVLKLPKLPNSYRSAGFHGFG

SEQ ID NO: 21468 - protein, 143 aa, Oryza sativa (japonica cultivar-group)
MPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGASPGTDQKPSS

SEQ ID NO: 21469 - protein, 714 aa, Meleagris gallopavo
MAAKSKSKGSSVPNCFGYPLSIFFIVINEFCERFSYYGMRAVLVLYFKYFLRWDDNLSTAIYHTFVALCYLTPILGALIADSWLGKFKTIVSLSIVYTIGQAVMAISSINDMTDQNRDGNPDNIAVHIALSVTGLILIALGTGGIKPCVSAFGGDQFEEHQEKQRSRFFSIFYLSINAGSLISTVITPILRAQECGIHSRQQCYPLAFGVPAALMAVSLIVFIAGSGMYKKVQPQGNIMVQVCKCIGFAIKNRFRHRSKEYPKREHWLDWASEKYDKRLIAQTKMVLKVLFLYIPLPMFWALFDQQGSRWTLQATTMDGDFGALQIQPDQMQTVNPILIIIMVPVVDAVIYPLIQKCKINFTPLRKITVGMFLAGLAFIAAALVQVQIDKTLPVFPAAGQAQIRIINLGNSNANVTFLPDLQNVTVLPMESTNYRIFETSQLKSVIINFGSENRSESIDSTSSNTHTVTIKNAATGIVSSLRSDNFTSKPEEGKNLIRFVNNLPQTVNITMGDTDFGILEETSISNYTLFSGGRTDDIVIVADSTNCTVTSEALGYGGAYTIIINECSEDVTQLRYIEDIQPNTVHMAWQIPQYFLLTCGEVVFSVTGLEFSYSQAPSNMKSVLQAGWLLTVAFGNIIVLIVAGASKLSEQWAEYVLFAALLFAVCIIFAVMAYFYTYIDPNEVEAQLDEEEKKKQIKQDPDLYGKESEADSRM

SEQ ID NO: 21470 - protein, 150 aa, Nyctotherus ovalis
QALNFAFKDTFRKYLCPFDPKKEMGKFFLGSLASGGAAGATSLLFVYPLDFSRTRLAADVGKAKHEREFTGLGNCLATIFKKDGMLGLYRGFSVSVVGIIVYRACYFGGYDWGKQYLFKDFRNANALFLFLFAEVNTTLSGLASYPLDTV

SEQ ID NO: 21471 - protein, 150 aa, Nyctotherus ovalis
QALNFAFKDTFRKYLCPFDPKKEMGKFFLGSLASGGAAGATSLLFVYPLDFSRTRLAADVGKAKHEREFTGLGNCLATIFKKDGSLGLYRGFSVSVVGIIVYRACYFGGYDFGKQYLFKDFRNANALFLFLFAEVNTTLSGLASYPLDTV

SEQ ID NO: 21472 - protein, 150 aa, Nyctotherus ovalis
QALNFACKDTFRNYLCPFDPKKEMGKFFLGSLASGGAAGATSLLFVYPLDFSRTRLAADVGKAKHEREFTGLGNCLATIFKKDGMLGLYRGFSVSVVGIIVYRACYFGGYDWGKQYLFKDFRNANALFLFLFAEVNTTLSGLASYPLDTV

SEQ ID NO: 21473 - protein, 150 aa, Nyctotherus ovalis
QALNFAFKDTFRKYLCPFDPKKEMGKFFLGSLASGGAAGATSLPFVYPLDFSRTRLAADVGKAKHEREFTGLGNCLATIFKKDGLLGLYRGFSVSVVGIIVYRACYFGGYDFGKQYLFKDFRNANALFLFLFAEVNTTLSGLASYPLDTV

SEQ ID NO: 21474 - protein, 150 aa, Euplotes sp.
QALNFAFKDTFKRYLNPYNKKTQPGMFFIGNILSGGAAGAASLCVVYPLDFARTRLAVDVGKGEGSRQFNGLVDCIAKIAKSDGPLGLYRGFGISVMGIIVYRGAYFGLFDTGNAIIFGDSKNANFFAMWGFAQLTTTAAGIISYPMDTV

SEQ ID NO: 21475 - protein, 149 aa, Tetrahymena thermophila
QALNFAFKDTFKRMSIKRKKTLCYLVRCQHGFRWLAGSVSLAFVYSLDYARTKLTNDLKSSKKGGQKQYSGLVDVYKKTLATDGVAGLYRGFVISCVGIVIYRGLYFGLYDTVKPLLPSNIKNNFYVNFGVGWTVTVLAGLASYPIDTI

SEQ ID NO: 21476 - protein, 153 aa, Nicotiana benthamiana
MKMIVLRSSDGETFEVEESVALESQTIKHMIEDDCADTSIPLPNVTSKILAKVIEYCKRHVDAASKTEDKAVEDDLKAFDADFVKVDQSTLFDLILAANYLNIKRLLDLTCQTVADMIKGKTPEEIRKTFNIKNDFTPEEEEEVRRENAWAFE

SEQ ID NO: 21477 - protein, 491 aa, Squalus acanthias
MEEVQRRQHPHPRRSLKKLSEDSLTKQPEEVFDVLEKLGEGSYGSVFKAIHKESGQVVAIKQVPVESDLQEIIKEISIMQQCDSPHVVKYYGSYFKNTDLWIVMEYCGAGSVSDLIRIRNKTLTEDEIATILQSTLKGLEYLHFMRKIHRDIKAGNILLNNEGHAKLADFGVAGQLTDTMAKRNTVIGTPFWMAPEVIQEIGYNCVADIWSLGISAIEMAEGKPPYADIHPMRAIFMIPTNPPPTFRKPELWTDEFTDFVKQCLVKNPEQRAAATQLLQHPFIKNAKPVSILRDLITDMMEIKLKRQEEQQRDLDQDDEENSEEDDMDSGTMVRASAEDTGTMRAASTLSDGARTMIEHDSSTLDSQMGTMVINSGEDEEDGTMKRKEETIQQSKPSFLEYFEQKEKENQANSHSNRNAQALQNSSDNWKVPQDGDFESLKSWSVEELQRRLASLDPTMEQEIEEIRQRYQAKRQPILDAIDAKKRWQQNF

SEQ ID NO: 21478 - protein, 261 aa, Streptomyces murayamaensis
MTENTARVALVTGATSGIGLSVARLLGSQGHKVFIGARNADNVAETVKQLQGEGLEADGSALDVTDAASVKAFVQAAVDRFGTVDVLVNNAGRSGGGVTADIEDELWDAVIDTNLNSVFRVTREVLNTGGMRHKDRGRIINIASTAGKQGVVLGAPYSASKHGVVGFTKALGNELAPTGITVNAVCPGYVETPMAQRVRQGYAAAYSTSEDAILEKFQSKIPLGRYSTPDEVAGLVGYLASDTAASITAQALNVCGGLGNF

SEQ ID NO: 21479 - protein, 261 aa, Streptomyces sp. WP 4669
MSDKHERVALVSGATSGIGLAAARLLAQQGHRVFLGSRDADNVARTVKELTAEGLDVDGGTLDVRSALSIESFVQAAVDRFGPVDVLVNNAGRSGGGVTADIDDELWYDVVETNLNSVFRLTRAVLTTGGMRHKNRGRIINIASTAGKQGVVLGAPYSASKHGVVGFTKALGNELAPTGITVNAVCPGYVETPMAQRVRAGYAAAYDTTEDAIMEKFTAKIPLGRYSTPEEVAGLVGYLASDTAASITAQALNVCGGLGNF

SEQ ID NO: 21480 - protein, 69 aa, Eschscholzia californica subsp. californica
  unsure (1)..(69): unsure at all Xaa locations
XRKVLXNNIQGITKPAIRRLARRGGVKRISGLIYEETRGVLKIFLENVIRDAVTYTEHARRKTVTAMDV

SEQ ID NO: 21481 - protein, 705 aa, Cavia porcellus
MEDQRKYGAYGTPQKYDPTFKGPIYNRGCTDVLCCVLLFLAIVGYVAVGLIAWTHGDPRKVIYPTDSRGEFCGQKGTKNANKPFLFYFNIVKCASPLVLLEFQCPTPQICVEKCPNRYLTLLNAWNTPEFEYYKQFCVPDFQKNKKGVAQVLRDGQCPAVLIPSKPLAQRCFPDIHAHKGVIMVGNATTYEDGHGSRKNITELVEGAKQANGILEARQLAMRIFEDYTVSWYWIVIGLVIAMVLSLLFIILLRFLAGIMVWVMIVLVILVLGYGIFHCYMEYARLRGEAGSDISVLDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKILGDSSCPHQGQTCHPETFFNSTEAHACPNARCQFAFYGGESGYHRALLGLQIFNAFMFFWLANFVLALGQVTLAGAFASYYWALRKPDDMPAFPLFAAFGRALRYHTGSLAFGSLILAIVQIIRVILEYLDQRLKAAENKFAKFLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNNGSSERPYFMSSTLKKLLNKTNKKPVES

SEQ ID NO: 21482 - protein, 309 aa, Leishmania donovani
MAVPPRMRIPLSNQTNLVREPYQKPAAQPPTPLTNESRFVSEYGSEILTYFLEVERVVYSERMYMSRQSEVTDRMRKILIDWLIDVVTEFKLHPETFFLAVDIIDRFLFFYSIPRTKLQLVGVTAILVAAKHEEIWPPTVNDCVAVTANTYTSREVIDMEFDVVTTLRFKFTVPTTYPITCRLLESCHMAPAVRHATFLFLESAAHCYPLLQFLPSRIAAGAVLLGAFLIHYNRSKGVISLQGLWEIEVSPFAQGIGFEELQPVTEQLLPFTQRLCSGSSRLQAVRRKYSSSEYDCVASLEFPFISASA

SEQ ID NO: 21483 - protein, 156 aa, Danio rerio
MASYFDEHDCEPTNPEGQYRQNALLELARSLMQGLDIDSGSFDLSDWDQRLPPPAAKAVVQSLPVVIISPEQADKGVKCPVCLLEFEEQESVREMPCKHLFHTGCILPWLNKTNSCPLCRLELPTDNADYEEFKKDKERRRQREHRLEDLHGAMYT

SEQ ID NO: 21484 - protein, 369 aa, Danio rerio
MATAAVSAPAGGGPNPGSGAEMVRGQAFDVGPRYSNLSYIGGGAYGMVCSAYDRDNKVRVAIKKISPFEHQTYCQRTLREIKILLRFKHENIIGINDIIRTPTIDQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCIINIKARNYLLSLPLRSKVPWNRLFPNADPKALDLLDKMLTFNPHKRIEVEEALAHPYLEQYYDPTDEPVAEAPFKFDMELDDLPKETLKELIFEETARFQPGYRP

SEQ ID NO: 21485 - protein, 458 aa, Homo sapiens
MGLCYSLRPLLFGGPGDDPCAASEPPVEDAQPAPAPALAPVRAAARDTARTLLPRGGEGSPACARPKADKPKEKRQRTEQLSAEEREAAKEREAVKEARKVSRGIDRMLRDQKRDLQQTHRLLLLGAGESGKSTIVKQMRILHVNGFNPEEKKQKILDIRKNVKDAIVTIVSAMSTIIPPVPLANPENQFRSDYIKSIAPITDFEYSQEFFDHVKKLWDDEGVKACFERSNEYQLIDCAQYFLERIDSVSLVDYTPTDQDLLRCRVLTSGIFETRFQVDKVNFHMFDVGGQRDERRKWIQCFNDVTAIIYVAACSSYNMVIREDNNTNRLRESLDLFESIWNNRWLRTISIILFLNKQDMLAEKVLAGKSKIEDYFPEYANYTVPEDATPDAGEDPKVTRAKFFIRDLFLRISTATGDGKHYCYPHFTCAVDTENIRRVFNDCRDIIQRMHLKQYELL

SEQ ID NO: 21486 - protein, 45 aa, Ovis aries
DDAIAELDTLNEDSYKDSTLIMQLLRDNLTLWTSDQQDEEAGEGN

SEQ ID NO: 21487 - protein, 398 aa, Oryza sativa (japonica cultivar-group); identical to SEQ ID NO: 3556

SEQ ID NO: 21488 - protein, 210 aa, Gerbera hybrid cv. 'Terra Regina'
MGRGKVQLKRIENKINRQVTFSKRRGGLLKKAHEISVLCDAEVALIVFSAKGKLFEYSTDSCMENILDRYEQYSNIDRQHVAVDTDSPIRWTQECNKLKSRAELLQRNLRHYMGEDIESLGLREIQNLEQQLDTALKRIHSKKNQLLHQSISELQKKEKAIQEQNNTLIKNIKEKEKTITQKAQWEPHNYGPNTTPLLFSLPPHSSLNIG

SEQ ID NO: 21489 - protein, 379 aa, Petunia x hybrida
MSSTVGQVIRCKAAVAWQPGKPLVIEEVEVAPPQKMEVRLKILYTSLCHTDVYFWEAKGQNPVFPRILGHEAAGIVESVGEGVTELVPGDHVLPVFTGECKDCAHCKSEESNMCSLLRINTDRGVMIHDGQSRFSINGKPIFHFVGTSTFSEYTVVHVGCLAKINPLAPLDKVCVLSCGISTGLGATLVAKPTKGSSVAIFGLGAVGLAAAEGARIAGASRIIDVDLNASRFEEAKKFGVTEFVNPKDYSKPVQEVIAEMTDGGVDRSVECTGHIDAMISAFECVHDGWGVAVLVGVPHKEAVFKTHPMNLLNERTLKGTFFGNYKPRSDLPSVVEKYMNKELELEKFITHKLPFAQINKAFDLMLKGEGLRCIINMED

SEQ ID NO: 21490 - protein, 374 aa, Petunia x hybrida
QVIRCKAAVAWEAGKPLVIEEVEVSLLQKMEVRLKILYTSLCHTDIYFWEAKGQNPVFPRILGHEAAGIVESVGEGVTELVPGDHVLPVFTGECKNCAHCKSEESNMCSLLRINTDRGVMIHDDQSRFSINGKPIYHFVGTSTFSEYTVVHVGCVAKINPLAPLDKVCVLSCGISTGLGATLNVVKPTKGSSVAVFGLGAVGLAAAEGARIAGASRIIGVDLNASRFELAKKFGVTEFVNPKDYNKPVQEVIAEMTDGGVDRSVECTGHIDAMISAFECVHDGWGVAVLVGVPHKEAVFKTHPMNLLNERTLKGTFFGNYKPRSDLPSVVEKYMNKELELEKFITHQLPFSDINKAFDLMLKGEGLRCIIHMEH

SEQ ID NO: 21491 - protein, 983 aa, Pseudomonas fluorescens
MPGAWNVMSATDLSGGSVRSVGNVILNPDDSPQTHSEKMARIILDRMYHFAGLLDRDGTILEINLPALEGAGLRIEDIRGTPFWEARWFAVSQESKALQHQLVQRAAAGEFIRCDLEVYGEGSGEQTIVTDYSLTPLRDNHGEVAFLLAEGRNITSKKKYEQEIARKNSELEKLVEQIRKLDEQKSRFFSNLSHELRTPLSLILGPVDEMLVSSEFSERHDTNLASIRRNAVTLLRHVNELLDLAKVDAGKLQLAYERIDIKGLVEDIAAHFEAHAKQRRIRCAVLSPGPILVEADPERIGHVVFNLMANAFNATPDGGRISCRVEIGRGNRCLLTVSDSGPGIPPEMRQRIFERFQQGLEDHGQARAGSGLGLAIVKEFIELHGGTVTVGEAPGSGAIFQVEIPAFAPPQAVVRSGSTGEQAFSHDMSLEADIDIRPGRRLVSDTQADLPRILIVEDNEEMLHLIARTLSSEFSVECAGNGEQGLGLMLANPPDLVIRDLMMPGMSGEKLIRLMREEAQLTQIPVLVLSARADEDVRMTLLANMVQDYVTKPFFIPELLSRVRNLVMTRRARLALQDELKTHNADLVQLTRELISGRQAIQRSLEAQQKSERRWRAIHENSAVGIAVVDLQWRFVNANPAFCRMLGYTQEDVLGYSVLELTHPDDRNITDQRLHHLLDGRLQTYHHQKRFLHKDGHSLWTRSSVSVIPGSGDTPPLMIGVVEDIDEQKRAEHELERARSELARVMRVTAMGELVASITHELNQPLAAMVANSHACRRWLNSNPPNLKEGVASVEAVVRDSQRAAEVVLRLRMFMRRGEIQHEPLNLSGVVEEVLDYVRESLVMQSISLETTLPTDLPVVLADRVQLQQVVLNLLLNAIEAIQARSPNVPRLKLRICRSPDNGDLQLEVEDNGCGVPALQAERIFEPFYTTKSQGMGMGLAICRTILEAHGGQLNLLPPSDSGSAASGSVFQVVLPTDQGALR

SEQ ID NO: 21492 - protein, 416 aa, Saccharomyces cerevisiae
MTTNEEFIRTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKGQRSCSCK

SEQ ID NO: 21493 - protein, 436 aa, Danio rerio
MKGFVDAPNYFIELLEGGTTLENVIDNHIYEQNLAEKNAFVVADLGALMRQHVVWKTTMPLVRPFYPVSCNSSPVVIELLSALGVGFVCANKAETTLVLSHDVPPENIILSGVCKQLSLIKHAAKTGINFLLCENEAELRKIARAHPEAKLLLQVSTEAQIEEASVTIGCSLKGCRHLLELAKELNVSVAGVTFQVPASCKDPQAYTHALSDARCIFDMGKELGFDMNILDIGGGFSGSEFQLKQVHSVIRPLLEAYFPSESGVSIIAEPGNFFVFSCFTLAVNVIGKKAAYRNLHTSTHDKLTSSDAPEFVYYMNDGVYGSFMGRLFGNIISTPSVHKMSLTLDEPVFSSSLWGPSCDPLDQVVERCLLPELAVGDWLVFSNMGASGQEGPATFSDTDQPPVYYTISTDDWFEMQEAGISLDDTMKNLSLVQFGL

SEQ ID NO: 21494 - protein, 174 aa, Danio rerio
MGDPSLTRDCPLDCKVYVGNLGNSGNKTELERAFGYYGPLRSVWVARNPPGFAFVEFEDPRDATDAVRELDGRTLCGCRVRVEMSNGEKRSRFRGPPPSWSRRPRDDYRRGDDYRRRSSPPARHRSPRRSFSRSRSRSLSRERRRERSLSRDRNYKPSRSFSGSRSRSRSNGRK

SEQ ID NO: 21495 - protein, 869 aa, Saccharomyces cerevisiae
MTESAIDDQRFNLTKELQRHSCRDQGKITQKDDALDFISYSSFQSSFNTDQKSANNGSTVRRSIRSIFRRAAELPRVHMGPLTYSHGINELVNKKLRKDCDLSTLCRVLQRGIRMIRMTRRRRKFYEFKLINNNGQIIWKDGSKYLELDSVKDIRIGDMASTYQEEVDPKRLRSDSKLWITIIYKVSNKLKALHVVALNELDFNTFLSCICGLVKLRRELMESILLPDNSQFARIHWQITVSEKEEDEKKDTLSFADVKKLCDKFHIYVSTGQLLEFFQLADINHNGLLNYFEFEKFIKILKNRKEVNMIWSKFTKPPHSHLSFENFFQFLITEQHEQVDRQTAWSYFIKYREPTQLTMGQDGFTKFLKEQPYLVEVKEELYSKPLNHYFIASSHNTYLLGKQIAETPSVEGYIQVLQQGCRCVEIDIWDGENGPVVCHGFLTSAIPLKTVIRVIKKYAFITSPYPLIISLEINCNKDNQKLASLIMREVLAEQLYFVGTRTDKLPSPRELKHKILLKSKKTSEATRGLSVNEPFPSSFSSSYESANEQELRMKDDSTNSSSATNSSSMQRIKRIGLKKHVDIINDVSNISGIHGIKFRNFSLPESKTIAHCFSLNERKVEYMIKDKHLKLSLDKHNRRYLMRVYPHVLRYKSSNFNPIPFWKAGVQMVATNWQTNDIGQQLNLAMFQILDHQPDGSFKSGYVLKPKKLLPVVTKAKMIPLIYEHFENGSDPVTVKIRILSTQLLPRLNDTSPSRNNTNSFVKVEFHTDDEPTMPISIDKGTRISATEASTKSSQGNGFNPIWDAEVSITLKDTDLTFIKFMVISEETQIASVCLKLNYLRMGYRHIPLFNMEGEQYIFCTLFIHTQIL

SEQ ID NO: 21496 - protein, 895 aa, Oryza sativa (indica cultivar-group)
MASSSSKASDSSSQRPKRPDQGPSGKDAAGLVVLHGKLAQLKRQVQSTRLAAIKERVEANRKALQVHTCALFDVAAAAEVASRGAEGGNALSRGAAEGHCRLVGWDSASGPGERELVHVQEENLVAGTLVLSSSGGSGASHRTVVQLAKLPVVDKIPPYTTWIFLDKNQRMADDQLVCRRRIYYDPIVNEALICSESDDDVPEPEEEKHVFTEGEDQLIWKATQDHGLSREVLNVLCQFVDATPSEIEERSEVLFEKYEKQSQSSYETDFQLFLGKTMDVALDSFDNLFCRRCLVFDCRLHGCSQNLVFPSEKQPYGHGLDENKRPCGDQRYLRRREVYQDTCNDDRNACTTYNTDSRSSSLKVSATILSESEDSNRDEDNIKSTSIVETSRSKITNSEYADKSVTPPPGDASETENVSPDMPLRTLGRRKISKHASKSNDHSPDKRQKIYSSPFPFAMSVLNKQSVPEIGETCPDSIESAVDQLPSLDDPNKKISTKDMCAGSTTNTTENTLRDNNNNLFISNKEHSISHWSALERDLYLKGIEIFGKNSCLIARNLLSGLKTCMEVASYMYNNGAAMAKRPLSGKSILGDFAEAEQGYMEQDLVARTRICRRKGRARKLKYTWKSAGHPTVRKRIGDGKQWYTQYNPCGCQQMCGKDCACVENGTCCEKYCGCSKSCKNRFRGCHCAKSQCRSRQCPCFAASRECDPDVCRNCWVSCGDGSLGEPLARGDGYQCGNMKLLLKQQQRILLGKSDVAGWGAFIKNPVNRNDYLGEYTGELISHREADKRGKIYDRANSSFLFDLNEQYVLDAYRKGDKLKFANHSSNPNCYAKVMLVAGDHRVGIYAKDRIEASEELFYDYRYGPDQAPAWARRPEGSKKDEASVSHHRAHKVAR

SEQ ID NO: 21497 - protein, 299 aa, Sphaerechinus granularis
MNNFEKIEKIGEGTYGVVYKAKDLKSGKTVALKKIRLDTESEGVPSTAIREIALLKELDHKNIVKLHDVVHSDKKLYLVFEFMNQDLKKYMDIAPPSGLPTALVKSYLQQLLHGIAFCHAHRVLHRDLKPQNLLIDADGHIKLADFGLARAFGVPVRTYTHEVVTLWYRAPEILLGCRFYSTAVDIWSIGCIFVEMITRRALFPGDSEIDQLFRIFRTMGTPDEKLWPGVTSLPDYKTSFPRWSPQDFNKIVPMLSKDGKDLLKCMLCYEPDKRISAKTALSHPYFKDVKLVPPPHLPT

SEQ ID NO: 21498 - protein, 348 aa, Mus musculus
MPHIDNDVKLDFKDVLLRPKRSTLKSRSEVELTRSFSFRNSKQMYSGIPVIAANMDTVGTFEMARVLCKFSLFTAIHKHYSIHQWQEFASQNPDCLECLAASSGSGSADFEQLEQILEAIPQVKYICLDVANGYSEHFVEFVKDVRKRFPQHTIMAGNVVTGEMVEELILSGADIIKVGIGPGSVCTTRKKTGVGYPQLSAVMECADAAHGLKGHIISDGGCSCPGDVAKAFGAGADFVMLGGMLAGHSESGGELIERDGKKYKLFYGMSSEMAMKKYSGGVAEYRASEGKIVEVPFKGDVEHTIRDILGGIRSTCTYVGAAKLKELSRRTTFIRVTQQVNPIFSNSQ

SEQ ID NO: 21499 - protein, 609 aa, Schizosaccharomyces pombe
MIQTASTISSNGGTNQGMESSSANSPEMHGTQNSMSVGMSGSGSSQNRKITQFSNKLYNMVNDSSTDSLIRWSDRGDSFLVIGHEDFAKLVLPRYFKHNNFSSFVRQLNMYGFHKVPHIQQGVLQSDSPNELLEFANPNFQRDQPELLCLVTRKKAGSQPVEESNTSLDMSTISSELQNIRIQQMNLSNELSRIQVDNAALWQENMENRERQRRHQETIDKILRFLASVYLDGKQKPPSKVMPKSRRLLLEAKYPTVSPTNEPSAHSRPSPQGTTANSSSASISSLHNTTPDGEGKYRSVQNGRALNYVSSFNSDSHSPKDYISQSYTNEPGLKKESADSFNNSIDSYISPNQSPNTDVPSLNRDDTTDPKVVNTGDIINMLDDANSIEGSNMNSLSPLLFDYPNSLYPVNNTSSEQHHNSYRGSVSNSQPSGNLSESTNLQPVQPVDYMSNSNPSYGSYNAEDQLTNFHPGYAMDQKRISKLSDGITKQDQNIQALADILGIPLGDGKIDDAGFSANSPTNLNLPVSSDLDSVLNIPPNEDVFPDSNPVFDEFTNISNLTSPIEASNGNTFGSNPVSLPNQQKSVNPSLMTVSSPRQVRKKRKSSIGA

SEQ ID NO: 21500 - protein, 238 aa, Drosophila miranda
ERVKLLLQVQHISKQISPDKQYKGMVDCFIRIPKEQGFSSFWRGNLANVIRYFPTQALNFAFKDKYKQVFLGGVDKNTQFWRYFMGNLASGGAAGATSLCFVYPLDFARTRLAADTGKGGQREFTGLGNCLTKIFKSDGLVGLYRGFGVSVQGIIIYRAAYFGFYDTARGMLPDPKNTPIYISWAIAQAVTTVAGIVSYPFDTVRRRMMMQSGRKATEIIYKNTLHCWGTIAKQEGTG

SEQ ID NO: 21501 - protein, 238 aa, Triticum monococcum
MGRGKVVLQRIENKISRQVTFAKRRNGLLKKAYELSLLCDAEVALVLFSHAGRLYQFSSSSNMLKTLEKYQRYIFASQDAAVPTTDEMQNNYLEYMELKARVEVLQRSQRNLLGEDLAPLSTIELEQLEGQVGKTLRQIRSRKTQVLLDEMCDLKRKEQILQDANMTLKRKLGEIELEATPDPPQQPQQQQMWQGDRGVPPHTPPQPEHFFQALERYPSLQPVFRGMDVNQPPPAWMA

SEQ ID NO: 21502 - protein, 255 aa, Homo sapiens
MYEILKALDYCHSMGIMHRDVKPHNVMIDHEHRKLRLIDWGLAEFYHPGQEYNVRVASRYFKGPELLVDYQMYDYSLDMWSLGCMLASMIFRKEPFFHGHDNYDQLVRIAKVLGTEDLYDYIDKYNIELDPRFNDILGRHSRKRWERFVHSENQHLVSPEALDFLDKLLRYDHQSRLTAREAMEHPYFYTVVKDQARMGSSSMPGGSTPVSSANMMSGISSVPTPSPLGPLAGSPVIAAANPLGMPVPAAAGAQQ

SEQ ID NO: 21503 - protein, 305 aa, Saccharomyces cerevisiae
MSSSSQFKQLEKLGNGTYATVYKGLNKTTGVYVALKEVKLDSEEGTPSTAIREISLMKELKHENIVRLYDVIHTENKLTLVFEFMDNDLKKYMDSRTVANTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHAS

SEQ ID NO: 21504 - protein, 65 aa, Platynereis dumerilii
MRAILVDWLIEVCEVYRLHRETFYLAVDFVDRYLSQTKNIQKQVLQLIGISALFIAAKYEEIYPP

SEQ ID NO: 21505 - protein, 135 aa, Populus x canescens
CNKPILFTMARLDRVKNLTGLVEWYGKNTKLRELANLVVVGGDRRKESKDIEEQAEMKKMYNHIEKYNLNGQFRWISSQMNRVRNGELYRYICDTKGAFVQPALYEAFGLTVVEAMTCGLPTFATCNGGPAEIIV

SEQ ID NO: 21506 - protein, 812 aa, Caenorhabditis elegans
MLLSPEQFSRLSEYAAYSRRKLKDMLSDFQQDGKFYSYLSVDGQTINIDGFRAFLIDYFGADLPSDLVDQLFLSFSKPPIKERRTSLFEDAISTVRAKFSESLSGRMAGLNIAGGSGQQTDRSQSSEPQALVCIPEDDVMGPRVANNDSQEPRIPLKPLICTLSLLEADTPENKLDVVFHVYDSDGNGFLDKSEIDGIIEQMMNVARYQQWDTIELEQVIRQMMVDIDYDNDGIVSFDEWRRGGLTNIPLLVLLGFDTEMKEDGSHVWRLRHFTKPTYCNACCSILVGWGGKQGLSCSLCKYTVHERCVRSAATNCIRTYSSRQQDKLYHHWQDANATAKCVKCKATVGVFQGKGCRWCHNYVHHRCMSALAQECDLGALVHHILPPTHIFPAFLERKTSTSLKNHNFSSHSASLLQAVSPSNDCRPLLVLVNPKSGGKQGVKILQKFEYLLNPRQVYDLSKTGPEPGLQLFSTLKNCNILVCGGDGTIGWVLESMDKMTFPHGRPPVAVLPLGTGNDLARCLRWGGGYENENLHKILEQIEKSSLIDMDRWQIKIEITENKSARRASEKGDTPPYSIINNYFSIGVDASIAHRFHVMREKFPEKFNSRMRNKLWYFELGTSETLSSSCKNLHEQIDILCDGESIDLGQDASLEGIALLNIPSIYGGSNLWGRSRKSKGRMPGLFPMKNAEKMQLQTRVQDIGDGLIELVGLESAMQMGQIKAGVRGARRLSQCSTVVIQTHKSFPMQIDGEPWMQPPCIIQITHKNQAKMLVGEFRHILELSINFFLFTAAAPRKRSSWMLLKRQSTNDDN

SEQ ID NO: 21507 - protein, 604 aa, Caenorhabditis elegans
MVQVAPVAAGAGSGQTRPSSDPKTGWFVYMLAFSAVIGGFLFGYDTGIVSAAMLYVPNASGIKPLDSVWQEIIVSITPGVAAIGSLCSGPGSDFLGRKKIIIGASVTFTIGAIICAAAWTKIILLIGRILLGLAIGFASMIVPIYVSEASPSHIRGKLVTGFQLMITVGLVIANIIGGAFSYVDPDQVGWRLMFAFAAVPAIIQFVCFLFLPESPRWLYEHGRTVEAREVLTRIYNGHTEWVDYEINEISFSYEEELRAKAEHAGNGPTIIRILKTPHVRKAMIIGSLLQMFQQLSGINTVMYYTGNIIRSAGVKDNHTTIWISVGTSAINFLGTFIPIALVERVGRRVLLLVSMIGVILFLIAMGVSFLLINNDSLRTFDQQNYTLNYNPSVKHAAKCLKYSNCDFCVTDENCGFCESKVAKKGYCLPFPSDDSSDYSATGICEFSNLTNNGTDFEWEDTYCHTKFTVLPIIIMVFYLLSFSAGYAPLPWVLNAEFYPLWARSTAVSVSTACNWIFNLIVSLTFLSLSQAATKYGTFFIYCGCTMVALVFVFFFVPETKGYSIDEVEMLFMTKEERRKAQKVLDESKEGKHRNSVAMSFDTKF

SEQ ID NO: 21508 - protein, 1396 aa, Mus musculus
MPPPLLPKRSKLETEKAQSNKITPREEQQSEKIGKSNHAASSSSSSTQGAVKRRSVFEDVTNASHSQCVQSKEDNIELKSHVSKRTKKGVGEVTQKKIKSSKMGHVTSLSNMEKEFILDIPNKPKTLTTEEPSVFQKTLVLNEEPATKETCLMRKTLKSCAFHQETLLMEKPLTLLVETEDYNEFDTELMTSKKKDKPEDPTIIEEMTDLKKSVIRKVTLTSSPLWLKNKHVVQEEKPVIQEKSSFKRISLVSNVVTTKEKPPVKKPHFRKKKPTTEMKSLLQEPSLEEKYNTQEDASILKKPQVLQENTNNKDATLTEPVTFKGKHSANEATHTKKPSSSKNNPDPQGKGTNLRPLRVHPVTYENEPMSSKKSTTKKKDSHFHGPSVLPDKHSPQMEVSTVKKSLALPNPTTEEKMLHFPVATVLEKQHNMGEAPCLKKPSPLRKQQQLPKRRRFFSNSAVQETVIRKPLFFKMSTTEKDPPSQWPSALPKKHISPGELSKQKKQHVSPKHNMEEDSQCWLDSAFKKQLSREEPASTHTPLKLEMQQAITKETGFHLRNPLVLPTVTSEAKSLTKEPPSFREQNTSLLKRKSTTHTITLQQAQSEWQEMTDEDRNLFSIKPGSHRKEPIPEFLQNPLPPNENCLISQKLSHSMPFASQKTTSQERAHRKESVASNDDKNFFSQDLFSPFSSADEDTLKFHKSLDFQEQVDRKNDSHKKMFDSQDSVSEEESFLRKLFCKDRCSSTEELSQERTVALEQEFLLIKILNENTSSDVDEPLSHQSPHIQNHSDTTKEALEASEALEAPEALETLEALVASEDLEEPLNILEELSTENMVALMKMLVTEDESTKDSFSGNYTAAREAHAEKSLSLEETSINEAATLKESLSSQEKHRAELVTVLKELLVLMKNPSLKRVALAFQENPSNNVETLLREVLALVENSTADESTLQEKPSTKTDVTPKELLALEENSSNKKANPMDSLSFDHKPDTEMGEIARMVLTDEEYNIDTLYERVLALSQGLIAADQLSFTDLQNFEETKIVDEEEFFKSFLVFENKNSPNMSSNAFESRTDNSSAIMPSSKAFNPVENSNPYVSSSKSFKSTLGAKETEITIQDDSDSLERIEKEGQDPLLNTIYAKDVFNYLKEREEKFLVQKYMDGQMELTSDMRAILVDWLVEIQGSFQMTHETLYLAVKIMDLYLMKAQCKKNHLQLLGSTTYMIAAKFEESYPPSLSEFLFICEDMYEKSDMVSLESSILQTLNFDINIPTAYNFLRRYASCIHASMKTLTLSRFICEMTLQEYEYIEERPSKLAAASFILALYMRNLSNCVPTLEYFTGYKMAELHILVRKLNHLLNFRSHSILKNVFEKYSEETYFEVAKIPPLSKQDLENLLNCALFH

SEQ ID NO: 21509 - protein, 493 aa, Mus musculus
MPPPLLPKRPKLETEKAQSNKITPREEQQSEKIGKSNHAASSSSSSTQGAVKRRSVFEDVTNASHSQCVQSKEDNIELKSHVSKRTKKGVGEVTQKKIKSSKMGHVTSLSNMEKEFILDIPNKPKTLTTEEPSVFQKTLVLNEEPATKETCLMRKTLKSCAFHQETLLMEKPLTLLVETEDYNEFDTELMTSKKKDKPEDPTIIEEITIQDDSDSLERIEKEGQDPLLNTIYAKDVFNYLKEREEKFLVQKYMDGQMELTSDMRAILVDWLVEIQGSFQMTHETLYLAVKIMGLYLMKAQCKKNHLQLLGSTTYMIAAKFEESYPPSLSEFLFICEDMYEKSDMVSLESSILQTLNFDINIPTAYNFLRRYASCIHASMKTLTLSRFICEMTLQEYEYIEERPSKLAAASFILALYMRNLSNCVPTLEYFTGYKMAELHILVRKLNHLLNFRSHSILKNVFEKYSEETYFEVAKIPPLSKQDLENLLNWALFH

SEQ ID NO: 21510 - protein, 149 aa, Cocos nucifera
RTLRELKLLRHMDHENVVAIRDIIPPPVREIFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIF

SEQ ID NO: 21511 - protein, 149 aa, Cocos nucifera
RTLRELKLLRHMDHENVIAIRDIIPPPVREIFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDGGLVGCIF

SEQ ID NO: 21512 - protein, 148 aa, Cocos nucifera
TLRELKLLRHMDHENVVAIRDIIPPPVREIFNDVYIAYELMDTDLHQIIRSNQALSEEHCQYFLYQILRGLKYIHPANVLHRDLKPSNLLLNANCDLKICDFGLARTTSETDFMTEYVVTRWYRAPELLLNSSEYTAAIDVWSVGCNV

SEQ ID NO: 21513 - protein, 299 aa, Sphaerechinus granularis
MEDFIKIEKLGEGTYGVVYKGRHKKTGKIVALKKIRLESEEEGVPSTAIREISLLKELYHPNIVHLEDVLMEPQRLYLIFEYLTMDLKKYMESLKGKQMDPALVKSYLHQMVDVILFCHSRRILHRDLKPQNLLIDNNGTIKLADFGLARDFGIPVRVYTHEVVTLWYRAPEVLLGSTRYACPIDMWSLGCIFAEMVTKRPLFHGDSEIDQLFRIFRTLGTPTEETWPGVTQLQDYKSSFPMWTKPNLKGASQKAMGEEGLDLLQEMLIYDPCKRITAKASMRHPYFNDLPDRLIPIRS

SEQ ID NO: 21514 - protein, 462 aa, Sphaerechinus granularis
MAFSIGSSNAGNDMTNMAQGVQQFGGRKTKRDDIASRNGPQACKRAALGTITNTSSTRVQPARAAKQFRVSGENPFPVFQDENAHSRIPQGKPFGIPSAAAAPAFSIHVDPTSTYVQPQTASTSIKSTDKENEHILLDTALSLPVPPQAQRIPLRSSGPDVEDNNVSLNEESLTSSEYSPMLLDTSLDAKCISPQTVVAERDLSLGEPEYSEEIYQYLKTAELKHRPKHGYMRKQPDITNNMRCILIDWLVEVSEEYRLHNETLYLAAAFIDRFLSQMSVLRAKLQLVGTASMFVASKYEEIYPPDVKEFIYITDDTYSIKQVLRMEHLILKVLSFDLAAPTINCFLPRFLKAAQANSKTEHLTQYLAELTLQKYDFIKYVPSMIAASRVCLANHTLNNEGWTPTMAHYTDYQLADIYVCTDLHQLFIKAPTMDQQAVREKYKSQKYSGASSTPVPTSLPTL

SEQ ID NO: 21515 - protein, 420 aa, Zygosaccharomyces rouxii
MATHEEFIRTQVFGTVFEITNRYTDLNPVGMGAFGLVCSATDTLVGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKDHVHQFSIITDLLGSPPRDVINTICSENTLKFVTSLPHRDPVPFQERFKTVEPDAVDLLRRMLVFVPKKRITAADALVHPYLAPYHDPTDEPTAEAQFDWDFNDADLPVDTWRVMMYSEILDFHKIGGGDGQIDTNAAFDDQVAAAHAAAMAQHHHQTQQQSSGKHTNPTTSSSAATITVTVPIAITMPSLIMVIKRFTT

SEQ ID NO: 21516 - protein, 240 aa, Zea mays
MGRGKIVIRRIDNSTSRQVTFSKRRNGIFKKAKELAILCDAEVGLVIFSSTGRLYEYSSTSMKSVIDRYGKAKEEQQDVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIP

SEQ ID NO: 21517 - protein, 149 aa, Danio rerio
KCSSLCFPSVSSEKRSSSSGEMAGGKAGKDSGKAKTKAVSRSQRAGLQFPVGRIHRHLKTRTTSHGRVGATAAVYSAAILEYLTAEVLELAGNASKDLKVKRITPRHLQLAIRGDEELDSLIKATIAGGGVIPHIHKSLIGKKGQQKTV

SEQ ID NO: 21518 - protein, 346 aa, Enterobacter cloacae
MPARVSRPGITGRSHLMSQNTLKVHDLNEDAEFDENGAEAFDEKALVEEEPSDNDLAEEELLSQGATQRVLDATQLYLGEIGYSPLLTAEEEVYFARRALRGDVASRRRMIESNLRLVVKIARRYGNRGLALLDLIEEGNLGLIRAVEKFDPERGFRFSTYATWWIRQTIERAIMNQTRTIRLPIHIVKELNVYLRTARELSHKLDHEPSAEEIAEQLDKPVDDVSRMLRLNERITSVDTPLGGDSEKALLDILADEKDNGPEDTTQDDDMKQSIVKWLFELNAKQREVLARRFGLLGYEAATLEDVGREIGLTRERVRQIQVEGLRRLREILQGQGLNIEALFRE

SEQ ID NO: 21519 - protein, 422 aa, Danio rerio
SFKQTDEFVSVNVKGSCQDSMVRVVFLHPDLGIGGAERLVVDAAVALRSRGCSVQIWTAHYDPQHCFSETLSPDLPVVCVGDWLPTSVFGYFHALCAYLRMIYLTIYLVLFSGEEFDVVFCDQVSACIPFLRLARQRKKVLFYCHFPDQLLTQRRSALKRLYRGPIDWFEELTTGMADRILVNSQFTAKVFKQTFPKLSEIHTDVLYPSLNSSAFDDEVEGLGGLLPEGRSFIYLSINRYERKKNLPLALQALANLKDRLSVGEWECVHLVMAGGYDERVVENVEHYEELRSLVTSLGLEDHVTFLRSFSDKQKLSLLHNSTCVLYTPSNEHFGIVPIESMYLRCPVIAVNSGGPLESVAHEETGFLCEPTPERFSEAMQNFVSDPKLKQRMGQAGRERVQQRFSMQAFAEQLYSHIASLNQ

SEQ ID NO: 21520 - protein, 81 aa, Plasmodium falciparum
EFLFRALFPLYFNLNIILFFKKKAKLSKQQKKQMYIEKLSSLIQQYSKILIVHVDNVGSNQMASVRKSLRGKATILMGKNT

SEQ ID NO: 21521 - protein, 217 aa, Schistosoma japonicum
MSSSDEISWISWFCGLRGNEFFCEVDEDYIQDRFNLTGLSEQVPKYRDALDMILDLETDPSDNPENTDLVEQAAEMLYGLIHSRYILTNPGLNIMLAKWQHGDFGCCPRVYCESQPCLPIGSSDVPGEDTVKIYCPRCQDTYRPKSTRHHHTDGAYFGTGFPHMLFLVHPEYRPKRASKQFTARLYGFKIHPLAYQLQYQAAANYVMPVRPGFPKCT

SEQ ID NO: 21522 - protein, 201 aa, Boea crassifolia
MGGLKVFASVLFLVAVAVSGLEQLVSAETHHHVGGEEGWNSASNISSWLSGRVFRVGDKLWFSVPATADSIVELQSLEELATCDLRNPIRMYADGSNHVTLDKEGTRYFSSGNLESCKNGMKLPVTVQNRHDEDKPYRPDPPVEPYPHHHDEGEPYRPDPPVEPYPHPPPTTPHPYPAAATALNVFLSVVFDGLFLSCIGM

SEQ ID NO: 21523 - protein, 479 aa, Dunaliella salina
MATVQEYIDKHQLQKKTEDVLNIAVKSKPDEPLSFLAKELLRMAPSEILKVVGRQIIDSRGNPTVEADVHTHKGMFRAAVPSGASTGIHEAVELRDGDKTKFLGKGVQKAVESINTIISPALKGMDPKNQSEVDQKMIDLDGTPNKAKLGANAILAVSLATAKAGAAEKEVPLYRHIADLAGNPKLYLPVPAFNIINGGSHAGNALAMQEFMILPTGASSFSEAMRMGTEVYHTLKGIIKAKYGQDATNVGDEGGFAPNIQSNDDGLSLVTDAIEKAGYTGKVKIGMDVAASEFITEDKMYDLNLKQQPNDGSHKKTAAQMLEMYKEFCTKYPVISIEDPFEQDDWEPAKSLTAENICQVVGDDMLVTNPIRVKRGIEQKAVNSLLLKVNQIGSLTESIEAVRMSKEAGWGVMTSHRSGETEDCFIADLAVGLSTGQIKTGAPCRSERNAKYNQLLRIEEELGENAVYAGEKWRFIEWQ

SEQ ID NO: 21524 - protein, 133 aa, Listeria monocytogenes
ISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGP

SEQ ID NO: 21525 - protein, 191 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARKWIDSWT

SEQ ID NO: 21526 - protein, 195 aa, Listeria monocytogenes
PGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLEKGIQLLSNVNIYVAGVLLVLTLILGPTLFIMNNFTNSFGDYLQNIIQMSFQTAPDAPDARKWIDS

SEQ ID NO: 21527 - protein, 191 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDSWT

SEQ ID NO: 21528 - protein, 208 aa, Listeria monocytogenes
AEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDSWT

SEQ ID NO: 21529 - protein, 199 aa, Listeria monocytogenes
PGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDSWTIF

SEQ ID NO: 21530 - protein, 208 aa, Listeria monocytogenes
AEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARKWIDSWT

SEQ ID NO: 21531 - protein, 194 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARKWIDS

SEQ ID NO: 21532 - protein, 197 aa, Listeria monocytogenes
WGAAEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTA

SEQ ID NO: 21533 - protein, 210 aa, Listeria monocytogenes
AEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARKWIDSWTIF

SEQ ID NO: 21534 - protein, 191 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDSWT

SEQ ID NO: 21535 - protein, 202 aa, Listeria monocytogenes
AEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARK

SEQ ID NO: 21536 - protein, 196 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDS

SEQ ID NO: 21537 - protein, 211 aa, Listeria monocytogenes
WGAAEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDSWT

SEQ ID NO: 21538 - protein, 194 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDS

SEQ ID NO: 21539 - protein, 207 aa, Listeria monocytogenes
PLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDSWTI

SEQ ID NO: 21540 - protein, 190 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARK

SEQ ID NO: 21541 - protein, 185 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARK

SEQ ID NO: 21542 - protein, 196 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARKWIDSWT

SEQ ID NO: 21543 - protein, 194 aa, Listeria monocytogenes
EVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDSWT

SEQ ID NO: 21544 - protein, 184 aa, Listeria monocytogenes
GAAEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDY

SEQ ID NO: 21545 - protein, 193 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDSWTIF

SEQ ID NO: 21546 - protein, 198 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDSWT

SEQ ID NO: 21547 - protein, 187 aa, Listeria monocytogenes
VFWGAAEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAAVLLVLTLILGPTLFIMNNFTNSFGDY

SEQ ID NO: 21548 - protein, 194 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLEKGIQLLSNVNIYVAGVLLVLTLILGPTLFIMNNFTNSFGDYLQNIIQMSFQTAPDAPDARKWIDS

SEQ ID NO: 21549 - protein, 200 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDSWTIF

SEQ ID NO: 21550 - protein, 193 aa, Listeria monocytogenes
QAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARK

SEQ ID NO: 21551 - protein, 185 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARK

SEQ ID NO: 21552 - protein, 198 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARKWIDSWTIF

SEQ ID NO: 21553 - protein, 172 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDY

SEQ ID NO: 21554 - protein, 213 aa, Listeria monocytogenes
VFWGAAEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDSWT

SEQ ID NO: 21555 - protein, 196 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARKWIDS

SEQ ID NO: 21556 - protein, 199 aa, Listeria monocytogenes
AVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDS

SEQ ID NO: 21557 - protein, 196 aa, Listeria monocytogenes
PGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDSW

SEQ ID NO: 21558 - protein, 206 aa, Listeria monocytogenes
AEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDS

SEQ ID NO: 21559 - protein, 196 aa, Listeria monocytogenes
AEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPD

SEQ ID NO: 21560 - protein, 212 aa, Listeria monocytogenes
GAAEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDSWTIF

SEQ ID NO: 21561 - protein, 177 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTA

SEQ ID NO: 21562 - protein, 194 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWI

SEQ ID NO: 21563 - protein, 165 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDY

SEQ ID NO: 21564 - protein, 165 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDY

SEQ ID NO: 21565 - protein, 206 aa, Listeria monocytogenes
AEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDS

SEQ ID NO: 21566 - protein, 216 aa, Listeria monocytogenes
VFWGAAEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDSWTIFY

SEQ ID NO: 21567 - protein, 209 aa, Listeria monocytogenes
WGAAEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDS

SEQ ID NO: 21568 - protein, 203 aa, Listeria monocytogenes
AAEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARK

SEQ ID NO: 21569 - protein, 191 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDAR

SEQ ID NO: 21570 - protein, 191 aa, Listeria monocytogenes
PGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARK

SEQ ID NO: 21571 - protein, 185 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLEKGIQLLSNVNIYVAGVLLVLTLILGPTLFIMNNFTNSFGDYLQNIIQMSFQTAPDAPDARK

SEQ ID NO: 21572 - protein, 198 aa, Listeria monocytogenes
QAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARKWIDSW

SEQ ID NO: 21573 - protein, 174 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNI

SEQ ID NO: 21574 - protein, 195 aa, Listeria monocytogenes
PGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDS

SEQ ID NO: 21575 - protein, 204 aa, Listeria monocytogenes
PLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDS

SEQ ID NO: 21576 - protein, 199 aa, Listeria monocytogenes
QAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDSWT

SEQ ID NO: 21577 - protein, 198 aa, Listeria monocytogenes
PGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLEKGIQLLSNVNIYVAGVLLVLTLILGPTLFIMNNFTNSFGDYLQNIIQMSFQTAPDAPDARKWIDSWTI

SEQ ID NO: 21578 - protein, 186 aa, Listeria monocytogenes
FWGAAEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDY

SEQ ID NO: 21579 - protein, 206 aa, Listeria monocytogenes
PLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARKWIDSWT

SEQ ID NO: 21580 - protein, 212 aa, Listeria monocytogenes
WGAAEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDSWTI

SEQ ID NO: 21581 - protein, 200 aa, Listeria monocytogenes
AVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDSW

SEQ ID NO: 21582 - protein, 195 aa, Listeria monocytogenes
PGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDS

SEQ ID NO: 21583 - protein, 207 aa, Listeria monocytogenes
EPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDSWT

SEQ ID NO: 21584 - protein, 192 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARK

SEQ ID NO: 21585 - protein, 195 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWID

SEQ ID NO: 21586 - protein, 193 aa, Listeria monocytogenes
PGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWI

SEQ ID NO: 21587 - protein, 206 aa, Listeria monocytogenes
AEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARKWIDS

SEQ ID NO: 21588 - protein, 206 aa, Listeria monocytogenes
EPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDSW

SEQ ID NO: 21589 - protein, 208 aa, Listeria monocytogenes
PLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTAPDAPDARKWIDSWTIF

SEQ ID NO: 21590 - protein, 191 aa, Listeria monocytogenes
PGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARK

SEQ ID NO: 21591 - protein, 157 aa, Listeria monocytogenes
IYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPD

SEQ ID NO: 21592 - protein, 182 aa, Listeria monocytogenes
EVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTALM

SEQ ID NO: 21593 - protein, 179 aa, Listeria monocytogenes
EVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQT

SEQ ID NO: 21594 - protein, 187 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDA

SEQ ID NO: 21595 - protein, 179 aa, Listeria monocytogenes
EVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQT

SEQ ID NO: 21596 - protein, 193 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWMT

SEQ ID NO: 21597 - protein, 172 aa, Listeria monocytogenes
EVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNI

SEQ ID NO: 21598 - protein, 188 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDA

SEQ ID NO: 21599 - protein, 189 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARKWMTH

SEQ ID NO: 21600 - protein, 180 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDA

SEQ ID NO: 21601 - protein, 193 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKW

SEQ ID NO: 21602 - protein, 170 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNII

SEQ ID NO: 21603 - protein, 182 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTA

SEQ ID NO: 21604 - protein, 185 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDA

SEQ ID NO: 21605 - protein, 184 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTA

SEQ ID NO: 21606 - protein, 177 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTA

SEQ ID NO: 21607 - protein, 190 aa, Listeria monocytogenes
VGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARKWMT

SEQ ID NO: 21608 - protein, 182 aa, Listeria monocytogenes
APEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTA

SEQ ID NO: 21609 - protein, 190 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDA

SEQ ID NO: 21610 - protein, 180 aa, Listeria monocytogenes
EVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTA

SEQ ID NO: 21611 - protein, 176 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQT

SEQ ID NO: 21612 - protein, 195 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARKWMT

SEQ ID NO: 21613 - protein, 187 aa, Listeria monocytogenes
GEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDA

SEQ ID NO: 21614 - protein, 178 aa, Listeria monocytogenes
TQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAP

SEQ ID NO: 21615 - protein, 181 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQT

SEQ ID NO: 21616 - protein, 179 aa, Listeria monocytogenes
EVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQT

SEQ ID NO: 21617 - protein, 184 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTA

SEQ ID NO: 21618 - protein, 176 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNI

SEQ ID NO: 21619 - protein, 174 aa, Listeria monocytogenes
QAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQ

SEQ ID NO: 21620 - protein, 144 aa, Listeria monocytogenes
YFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLLLGPTLFIMNNFTNSFGDYLQNIIQMSFQT

SEQ ID NO: 21621 - protein, 182 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTA

SEQ ID NO: 21622 - protein, 190 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDA

SEQ ID NO: 21623 - protein, 168 aa, Listeria monocytogenes
QAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNI

SEQ ID NO: 21624 - protein, 172 aa, Listeria monocytogenes
EVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNI

SEQ ID NO: 21625 - protein, 176 aa, Listeria monocytogenes
GTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQ

SEQ ID NO: 21626 - protein, 194 aa, Listeria monocytogenes
AAEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLLLGPTLFIMNNFTNSFGDYLQNIIQMSFQT

SEQ ID NO: 21627 - protein, 166 aa, Listeria monocytogenes
SFFHWGISAWSIYAIVALALAYFKFRKNAPGLISATLYPILGKHAKGPIGQLIDIIAVFATVIGVATTLGLGAQQINGGLTYLFGVPNNFTVQFTIIVIVTILFMLSAMSGLDKGIQLLSNVNIYVAGVLLVLTLILGPTLFIMNNFTNSFGDYLQNIIQMSFQTA

SEQ ID NO: 21628 - protein, 182 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTA

SEQ ID NO: 21629 - protein, 156 aa, Listeria monocytogenes
FHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNI

SEQ ID NO: 21630 - protein, 192 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARK

SEQ ID NO: 21631 - protein, 176 aa, Listeria monocytogenes
QAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTA

SEQ ID NO: 21632 - protein, 182 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLLLGPTLFIMNNFTNSFGDYLQNIIQMSFQTA

SEQ ID NO: 21633 - protein, 179 aa, Listeria monocytogenes
VGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTA

SEQ ID NO: 21634 - protein, 178 aa, Listeria monocytogenes
QAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNII

SEQ ID NO: 21635 - protein, 175 aa, Listeria monocytogenes
GGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNII

SEQ ID NO: 21636 - protein, 176 aa, Listeria monocytogenes
APGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNI

SEQ ID NO: 21637 - protein, 183 aa, Listeria monocytogenes
LRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLVLTLILGPTLFIMNNFTNSFGDYLQNIIQMSFQTAPDAPDARKWIDSWT

SEQ ID NO: 21638 - protein, 204 aa, Listeria monocytogenes
PLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDS

SEQ ID NO: 21639 - protein, 207 aa, Listeria monocytogenes
VFWGAAEPLSHFAVQAPGGEVGSQAAMKDALRYSFFHWGISAWSIYAIVALALAYFKFRKDTPGLISATLYPILGKHAKGPLGQLIDIIAVFATVIGVATTLGLGAQQINGGLTYLFHVPNNFTVQLIIIVIVTVLFLLSAMSGLDKGIQLLSNVNIYVAGVLLILTLILGPTLFIMNNFTNSFGDYLQNIIQMSFQTAPNAPDARK

SEQ ID NO: 21640 - protein, 208 aa, Listeria monocytogenes
AEPLSHYAVQAPGGEVGTQAAMKDALRYSFFHWGISAWSIYAIVALALAYFKFRKNAPGLISATLYPILGKHAKGPIGQLIDIIAVFATVIGVATTLGLGAQQINGGLTYLFGVPNNFTVQFTIIIIVTILFMLSAMSGLDKGIQLLSNVNIYVAGVLLILTLILGPTLFIMNNFTNSFGDYLQNIIQMSFQTAPDAPDARKWIDSWT

SEQ ID NO: 21641 - protein, 169 aa, Listeria monocytogenes
WGAAEPLSHYAVQAPGGEVGTQAAMKDALRYSFFHWGISAWSIYAIVALALAYFKFRKNAPGLISATLYPILGKHSKGPLGQLIDIIAVFATVIGVATTLGLGAQQINGGLTYLFGVPNNFGIQFTIIVIVTILFMLSAMSGLDKGIQLLSNVNIYVAGVLLVLTLILG

SEQ ID NO: 21642 - protein, 205 aa, Listeria monocytogenes
WGAAEPLSHYAVQAPGGEVGTQAAMKDALRYSFFHWGISAWSIYAIVALALAYFKFRKNAPGLISATLYPILGKHSKGPLGQLIDIIAVFATVIGVATTLGLGAQQINGGLTYLFGVPNNFGIQFTIIVIVTVLFMLSAMSGLDKGIQLLSNVNIYVAGVLLVLTLILGPTLFIMNNFTNSFGDYLQNIIQMSFQTAPDAPDARK

SEQ ID NO: 21643 - protein, 195 aa, Listeria monocytogenes
VFWGAAEPLSHYAVQAPGGEVGTQAAMKDALRYSFFHWGISAWSIYAIVALALAYFKFRKNAPGLISATLYPILGKHSKGPLGQLIDIIAVFATVIGVATTLGLGAQQINGGLTYLFGVPNNFGIQFTIIVIVTVLFMLSAMSGLDKGIQLLSNVNIYVAGVLLVLTLILGPTLFIMNNFTNSFGDYLQNIIQMS

SEQ ID NO: 21644 - protein, 194 aa, Listeria monocytogenes
GGEVGSQAAMKDALRYSFFHWGISAWSIYAIVALALAYFKFRKDTPGLISATLYPILGKHAKGPLGQLIDIIAVFATVIGVATTLGLGAQQINGGLTYLFHVPNNFTVQLIIIVIVTVLFLLSAMSGLDKGIQLLSNVNIYVAGVLLILTLILGPTLFIMNNFTNSFGDYLQNIIQMSFQTAPNAPDARKWIDS

SEQ ID NO: 21645 - protein, 409 aa, Coxiella burnetii RSA 493
MNGFVVSAVLIGAFLGALFSGHLADYIGRKRLLIIDALIFIVGTAISSMTVSISWLVIGRIIVGIAIGIASYSAPLYISEISPPHRRGALVSLNQLAVTIGIFLSYVVDYYFARHDAWRSMFAAGVIPAALLLLGMIVLPYSPRWIFSRGHEEKALWILRKLRGHGPHAEQELEHIRASLQQQKGDWRTLFSKIIRPTLFIAIGLAVFQQVTGINTVLYYAPTILKMTGFQASQTAILATMGIGAVLVIITIISLPLIDSLGRRPLLFIGVGAMTVSLLVLSWSFKVHGHMDYMRWIAFGSLLVFISGFSISLGPIMWLMFSEIFPLRVRGLGASIGACTNWASNWLVTITFLTLIEYLGPSGTFFIYFIISVITLIFIYTSVPETKGVTLEQIEENLYAGKDMRYLGK

SEQ ID NO: 21646 - protein, 249 aa, Coxiella burnetii RSA 493
MPTLLKGKTALVTGASRGIGASIAAELGRQGAIVLGTATTEAGAKKITQMLMEEKVEGKGYALDICDQERMKAILSDIQGDFDAPSILVNNAGITRDNILLRMRSEQWDEVINTNLNGVFHLTKACLKSMVKARSGRIINISSVVATMGNAGQANYVAAKAGLVGFTKVVAMEYAAYGITANCIAPGFIETEMTGALSEQQREAILARVPMKRMGQPNEIAQAAAFLASDNAAYITGETLHINGGMCMV

SEQ ID NO: 21647 - protein, 492 aa, Coxiella burnetii RSA 493
MLNYIPLVTQGLLMKQPRALTPLFLTEMWERFGFYVTQSLLILYITSVLNFSDSRAYMILGEFTALVYIAPLAGGFFADRVLGPRYAIFLGAIFLGLGYFFLGFAGQKLLFLSLSILVVGNGLLKPNISSFLGQFYYENDPRRDAGFTLFYIGINLGGLLALGSAGFIQEKLGWGAAFLSAGVGMLIATVTFCFGFKKYENRGLPIPPDQIRPSFLRMTRHKLSIIFLILLTILIAYLLLSSTGIANLLQLVLGISILVTLLFVSSRFEKRIRNKFLVLIILILASIVFWGILFQAFASVNLFTQRVVDRHIVGLLIPSPAFISLETIFIILLGPFLAALWQRLHIKKLDPTPGAKFSFAMFSAAIAMTLLVLAVHWTETSGLIHPIWVVLFYLFLTLGEMLLSPIGLSMVTELSPPHLTGLMMGIWFMALGFGGQLSGFLAEQAGVPKYIVDIHAANEIYGHAFMNNAILSFVIGLILLILSPWLKRLMKN

SEQ ID NO: 21648 - protein, 504 aa, Coxiella burnetii RSA 493
MSVRSLTGQPKPFYLIFFIEIWERFGYYGVQALLVLYMVERLGYQDSHADFLFAAFSALVFLLPCLGGYVGDKLLGTKRTILLGAIVLALGYLLLSLPAISNAYLALPLAFIAVGNGLFKANPSSLLSKVYEKTQHNLDSGFTLYYMAVNIGAAVSMNLTPILSKFFGWHVAFSVCCAGLVIAIFNFFAMRGSIADYGSKPDQSLLRLHYLMYVLLGTAGLIVGGYFLLIHFQIMSWLLSIGTVALLLTYFVLTGKAKPEERKGMFLFIILFSQAVVFFVLYFQMPTSLSLFALRNVHHSILGIPIEPAQFQMLNPLWVMIMSPVMAVIYQRLHKRGRDLSMPAKFSLGTFLAGLAFLSLPFGALFNHHGVISGMWLVLSYWLQSTGELLVSALGLSLAARYVPQRFMGFTMGLWFLCTSIASIIAGKVASIASIPKNISKDALMSLPIYDHLFMKIGLITVAISLVMFTLVPLLKKLAANDKQFVDKQDVAELLSDDQLVELS

SEQ ID NO: 21649 - protein, 142 aa, Coxiella burnetii RSA 493
MHEALALAKKANENNEVPIGAVLVKENEIVGHGFNEPITLNDPTAHAEILALRNAAKRVGNYRLVDTTLYVTLEPCAMCVGAMIQARIKRLVFGAFDPRAGAVESVFQLLNEPRLNHRIVWTSGVIAEACAEPLKAFFRARR

SEQ ID NO: 21650 - protein, 551 aa, Coxiella burnetii RSA 493
MLTHRRSIKRISWSVVSLPPRYGQKGYMLTGQVISKSVNASQIFLENILYNIPQYILWKDRNFVYLGCNHNFAKLVGFETPESIIGKTDFDLWRSQGANSIRPTDVEVLEGKQLVDVEQSLSLPNGKEGVFLISKVPLRDERNEIIGILVVGTDITERKQNEQKLIEAKLQAELSDRAKSEFIANISHDLRTPINGILGIAQIFNMHEHTKKQEPLINDLSASANLLLGLVEDILDFARLEVGKLELKYSTFNLRQLVTFLVKTFSFQTQQKQIKINVYYDASLPDSIVSEPNYIRRIFLNLIGNAVKFTEKGQIDVTVNLEGNKPAMLKILVKDTGIGIPKDKLNTIFDRFSRATPVYSSRYEGLGLGLSIIKRLLDNLGGEVHVSSIENEGSTFTLTIPCEIASLQSPREKEETQALDEGQRLKILKERKVRVLLIEDDKLSQNIEKIFLEEFGCKVDTASNAEEALVKFNESYELICTDIGLPDKDGYALVREIRQMANSHKPVPILAMTAHVFDREKNKCLEAGMNGFINKPVTVEEIRRALLDYLF

SEQ ID NO: 21651 - protein, 326 aa, Coxiella burnetii RSA 493
MDKITLVEAVNQALSYEMAKDDSVIVLGEDVGINGGVFRATVGLVEKFGPQRVLDTPLAESMIAGISVGMAAQGLKPVAEFQFEGFIYSGLDHILSHAARLRNRTRGRLHCPIVYRAPFGGGIHAPEHHSESMEALFAHIPGVRVVIPSSPARAYGLLLASIRNPDPVLFFEPKRIYRLVKQKVPNDGKALPLDQCFLLREGGDITLVTWGAMIKETLEAAEQLKEQGIEAEVIDVATIKPIDMDTILQSVEKTGRCVIIHEAPLTGGVGAEIAAGIAEHGLLSLIAPVKRVAGYDTIMPYFKLEKKYMPSADRIIKTVQSLMEFS

SEQ ID NO: 21652 - protein, 396 aa, Coxiella burnetii RSA 493
MKLQTITSIAESRPIQPVFAFRPAALGRAVNYFCTQFDGRVLYAVKTNPEKHVIQAVHAHGVTAFDVASYEEIRIIKEYAPGAELYFMHPVKSPHAIREAYFEYGVRHFSLDCLEELHKILRHTENAKDLCLHLRLAIPNTFAEFNLAEKFGINLHEAPELLKQLRKAAYQLGVTFHVGSQCMHPDAYRIAIRMADKVINEAQVEIESFNVGGGFPSIYPGMIPPALTIYFEAIHDEFAKVAQRHPGIQLLCEPGRSLVAESTSVIVNVELRKDDILYINDGTYGSLFDAGIPHFIFPVHLLRPKHTADVDLLPFSFYGPTCDSLDYMKGPFYLPNDIKAGDYIEIGQMGAYGRTLSTAFNGFKQREGVIMVSDEPLMTMYSDEYITHEPLEVIAA

SEQ ID NO: 21653 - protein, 808 aa, Coxiella burnetii RSA 493
MSLDAIISNKFSFEVFINQIDCPLLFISDEGFIEAANDFAIKLLQLKPDQFPDVDFHAFCRANKYSLSRFFNKVEPPTEALEETYLLKGRQYVILWKIIRFSQFDDMLKGSLLVGHDRTQLQLVSGELKSKIFFYENILSKLPTNVYWKDKNSVYLGCNERLARVMGLPSRKAIEGMTDFDFVWGKEAAKSFIEFDQKVMRSGIPLMTEDVFKEASGNIVTVLTNKTPLKNEHGETIGVLAISVDITELKKTQAQLEIQRQKAEAANKAKSEFIANMSHDIRTPIAGMLGMLQDLLNVAEETKTSSNASILNVIETVQRDSELLMGATDELLQLCNEILEVIRLESGKESEQSEAFDLRELIKRTIELLQPVAHQKKLTLACEVDEGIPQYLDGIRMYLSRTLLNLISNALKFTENGFVKVKVRLSDKTNSHYRVGDKATIQIAVEDTGMGIPRDKFDTIFEHFSRLTPSYEGLYKGAGLGLYTVKRYVDAMGGEITVDSEVGKGTCFTVIIPFTVADHAERTNEPLRLPKTPKRIDLKANVFAEGAKPSETALSVLVVEDNALAATAVAVVLKPFNCAVDFAESGAQAIEKARKGIYDLILMDVGLPDISGIEATQRIRAMEDKAKAQVPIIALTGHADNGEKRQECLEAGMQEVLSKPLQRLAIESTLEQFIFRAKAEKEAKSGPPVTSMPESTEVIDWNACVRMCNGSPEFTRQLLTILDEDLKSTRAKLEKAYQERNNEILRAELHRLRGGVSYLKLPQLDNALKMFHEVVKIEPPNPALLEESYSKAKKAIEAFLKMWEKQSF

SEQ ID NO: 21654 - protein, 452 aa, Coxiella burnetii RSA 493
MNTSTPQIIKNVVNLALPMAGSRLIQMLSGFIGMLMLARLGHSILAASMLMTSTQVTIIVIFISLLFSMSVVVGQAYGAKKYDEVGVILQQGCILALILSIPLIILFLVADRILLALGQLPELVIYVKHYFRALIWGTPGFVLLAALQQALYGMSRQRIVILANLFCLGVFVLSAYVLVFGHLGISAQGVTGVPYAFAIQAYLNIIILLFCFYYQKQFKPMGIFKWRSHQRWRYLKQLFQIGWPMCMQFGGELMAFFVISIMIGWLGKNELAAAQVTQQCLFLFVVPMFAVAEATGIMVSHAVGGKQYQSVKRIGEISLIIAMILVSVAALIFLAFPEFLASLYIDVKAPQYTHMIHLIKILFILVAFSITFDTLRNVASGALRGFYDTRFAMWAGLGAMWIISVPGGYLLGVVFHYGVIGFRIASAFAFLIGALLVLWRWRERVKEYSQLP

SEQ ID NO: 21655 - protein, 517 aa, Coxiella burnetii RSA 493
MQDQPKIVVVGGGYWGKNLIRNFAKLGALAGICEVSQEVAIKLGEEYKVPVLSWKETLTNTSYNAVAIATPAKDHAELAWQALEANKDVFVEKPLALQMDDAEKVGQLAFARHRILMVGHLLQYHPAFTALKLLAHEGKLGRLQYLYSNRLNLGKIRREEDILWSFAPHDISMILSLVNEKPSVVKAMGGYFLHKSIADVTTTHLEFPSGVQAHIFVSWLHPHKEQKLVVVGSKGMAVFDDAKPWTQKLAFYSHQIHWRDGMPFPDKADATYCSLTEEEPLTRECQHFIDCVKTREQPITDAKEGLRVLEVLNQATKSLNLESSPRVNDFFIHETAVVDNHVALGKNTKVWHFSHILEGCKIGENCIIGQNVMIGPDVKIGNYCKIQNNVSLYKGVTLEDGVFCGPSCVFTNVNNPRAEIERKNEFKKTYVERGVTIGANATIVCGVHLGAYSLIGAGAVVTKDVKPHALVLGNPARQVGWVSHAGERLDDRLICPREGRRYGVNDENELIEIACIS

SEQ ID NO: 21656 - protein, 342 aa, Coxiella burnetii RSA 493
MNLVKNWLNQGKKICVITFFNEKADFFELPIAVSRKSINFTGESKNLVVAIWNNLRRVKSLRSMIKAYQPKLVLSFLGTTNVLTILATFFMQIPVIVSERSDPTRDSLGNIWDKLRHLLYRYADIVTANSHGAIVALEKFVDAGKLKYVPNPVCIEEPFRPLTYSFPAILAVGRLSYEKGHDILLSAFSKFIHQFPQWRLVIVGDGELRNKLKQFAVNLNIDKYIIWGGMQLDIFSYYNAATIFVMPSRYEGTPNALLEAMGCGLPVIVSNASSGILQFVKNEETGLVVPVEDVETLYLAFCRLANDELLRKRLGEKARQKIKMETQCAYELWDEVLNINRY

SEQ ID NO: 21657 - protein, 430 aa, Coxiella burnetii RSA 493
MMNMFLRKLKRDLCIVVAINALDVGGAEKHLLRVLPSLKKRGYNIILYLTNHRGVMFDEMLAAGIPIITPPLCEFLNKLGPLGKPFIYSLSIIRLSFLILKRNPSILHFFLPGTYVLGGISGLLARARCMVMSRRVTNEYQKTHPIVAKIEPLLHKYMKVVLATSLRVGTELLEEGVPPNKLGLIYNGVEVEKYNIHYNKPAIKRSFCLGDDTFIIVILANLYKRKGHKDLFYALSSIKEKISKNWKLLCIGRDGGEKNALESLRDNLGLREYVTFLGQQHDIPQLLSIADMGVLSSHEEGFSNALLECMAAGLPMVVTDVGGNAEAIVDKQCGFVVPPKQPQQLAEALLMLALDKETRDKYGNAAKERVKKYFSLEACVLRYDQFYEAMLASEWERAISVVKPPSWQDDDNKNTAEGKACSNFPLSGNN

SEQ ID NO: 21658 - protein, 391 aa, Coxiella burnetii RSA 493
MFSNQKLLIGVTGAIAAYKSVELVRRLREKGALVRVVMTSAAQAFITPLTFQAVSGHPVAVDLFSSDSSMGMEHIDLARWADFVLIAPASADFIARLAHGRADDLLTTICLATQAPIAVAPSMNQQMWRNKITQTNVDRLRDYGIHLFGPATGEQACGDYGPGRLLEPEELINQLAIHSVEKVLSGKQVLITAGPTQEAIDPVRYLTNGSSGKMGFALAEAALAMGANVTLVSGPTPLKVSQKINRIDVTTATQMFETVIKHAVECDVFIGAAAVSDYRPKNFSPQKFKKSDANWALNLVRNPDIISEIGRLPNKPFVVGFALETDNPLDNAKLKLQKKNMNVIVVNEASALCSDENAVTLMTRSGKTKKLPMTTKKTLALQLMEFVSKEM

SEQ ID NO: 21659 - protein, 394 aa, Coxiella burnetii RSA 493
MESDAYRYVKAKGKMGYSEFATDPCRSIFKRFFQAFSPRPTDNANVNVSMIADKFVALTETPMPIVFDPQTLERMGVINYEDKLKGNLTTAHPHYDFETKEGINYLTVFSAKSTSQIYRVSHHSKTRELLGSIPVKEPGYMHSFGMTQNYVILAEYPFFVNPLNLLLNGNPFIENFNWKPNKGTHFYLLDRKTGKFQNYKTESFFAFHHVNAFEENDKVIVDIIAYPNTDIIQSLYLDVLHGETNKNIVSAGELRRYEINLLDSSVNYVVLSEEPIELPRINYFLSNTKNYLFVYGVGSDKNDPNNFLNRLLKIDVQQKATKIWKETMCYPGEPVFVSLPNAKKEDDGVILSVVLNAQKGNSFLLILDAVSFKEIARASVPHHIPFGFHGQFYK

SEQ ID NO: 21660 - protein, 683 aa, Coxiella burnetii RSA 493
MGRQNWKIKNLEVCMEVSTTRIHKPILKKLGSLFLNLAETSQDIFWIRSVDFYTHVYVSPAFENIFGISRQTLYANPNKWMNAVIIEDRDRLRHLIMEWQVKNKKGAAYTVDYRIIDAYGEMHWINETSYPVYEDDQCLGYAGVVKDVSSEKLRVKEFDNAVHYFRHFVERVSGVFWVKGSRGDKQIYISPTYEKIWGVSCESLYQNPKSWIDYVLPEDISNGKVNVNFYETAADQRTPDSKYEFHFRIRRPDGEIRWIKDTYFPIMENGKLVGFAGIAEDVTNDALREKELWEAKEFAEQANRTKSDFLAMMSHELRTPLNAILGMSQILKTHNLSDEQQGQIDVISQAGQNLLALLNDLLDFAKLEAGKLSFTEETMDLHELVMKIKGDMLLLAHKKGIQLKFDYPENIPSKVMGDAKRIRQVLVNLLSNALKFTEKGYVQLTANCLKKDHKKMTLCFTVKDTGIGMEKTKLSSIFNRFQQINSVYQRKYDGVGLGLSIVKELLEKMGGTISVTSEPGVGSEFTCIIPFRLQADSNPTLPARDLLEKQAVNNSTYDRESRFNMNVLVVEDNLINQRISKIMLEQVGCQVDIAGCGKDAIEKMKKHYDMVFMDIGLPDMDGFETTQCIRHNETPGQRVPIVAMTAHVFAQDRKRCFDVGMDEVMAKPIMQDDLIKVLKRWAA

SEQ ID NO: 21661 - protein, 103 aa, Coxiella burnetii RSA 493
MSQNKIYVGSLSYDVTADELQSFFGQYGEIEEAKLIMDRETGRSKGFAFITYGTQDAAQEAVSKANGIDLQGRKIRVNIARENTGDRRRDGGSGGRGGRGGRF

SEQ ID NO: 21662 - protein, 455 aa, Coxiella burnetii RSA 493
MPIRTTNPSTGEVIKTYQEMTDQQVEDIINDVHYDYEKWRSVGFKERGGKLRRIAERLRKNKTDYAKLIATEMGKPITAGEAEAEKCAWVCDYYADHAEALLKPRIVNTDWKKSYVTYQPSGVIFGIMPWNFPLWQVFRFAAPNLMAGHGCLLKHASISTGTALAIEKLIQSADLPDNIFRTLVINTEKASDVISHPKISAVTLTGSEGAGKAVGSAAGKALKKVVLELGGNDAYLILKDADLEKAAEACVESRLSNSGQSCIAAKRLIIVENVYDEFKALVIEKAQSYRMGDPLKKETELGPLARSDLRDTVHGQVRESIDKGALLETGGEIPESKGFYYPPTVLSGVRAGQPAFDDEVFGPVIALIRAKDEKHAIEIANNSKFGLGAAVFTNDNERGEKIAASELQAGTCVVNTFVKSDPRLPFGGVKHSGYGRELAAEGIRSFMNVKTVVVD

SEQ ID NO: 21663 - protein, 532 aa, Coxiella burnetii RSA 493
MTAFEIIPFILFLVVIGTAIAERINVPYPLVLVVTGLIVGFIPGIPNWHPPSDLVLPLFLPPILFAAARLISWEDIQNNKSEISSLSILLVIASTIVIGVILAWIVPGMPLSASLVLGAIISPTDAIASTSILNRMRIPKHIIRSLEVESLFNDAVSIVLYNMGLMFVFMGAINLLHAGESMLIVGLGGIAVGLMFSYFTSLIVKEFLTESENELPIIMSVILAYVSYLFADRIGVSGVLAVVAAGLFHKRTEKTIKARTRLSEKSVWDTLIFFLNGLIFIVIGMQFPNFLGKVNYLPIGQLILFSTITVLSLILLRFIWVLATNLLVNSLSRLRKHPTKRYVFSWREVLISSWSGMRGLVSLALALALPIMLPDTTPFPYRDLIIFLTIIAILFTLLVQGLTLPYLVKLLKSEKSDAAFIKESSKIYRRLTKEAIQHIDQLDAGEHICSENAKKLVNNYYANRLLQFKVTYETECDTHEVGHEAEALLSKILNYERNRLHEMRSHGEVSEEVYIRILSKIDRDEVGFASYK

SEQ ID NO: 21664 - protein, 305 aa, Coxiella burnetii RSA 493
MKLSVRAHLALFFITLLWGLTFPLIKDALGSISPSLFVVLRTSVASLILLPVIFLQRKKTTFTMIKWTLVLGFFQSATYVFQSIGLESISSADSAFITALSVVVVPFLALIFLKSKPRWFDFVTALLCLGGIFILTGANIFNMKGGDFWTLGCAVAYALYIVTLQAFSKKLKPEDTILALSYQILFSLIFPLLTAFYKTTASIFSWPVIIAVLFCAIFATGLVFYLQLRYQRYIPVSRAVLIYAFEPIFAALFGYLLNGEAIYLNTVIGGFLILVSFVLSELFPSKKSSQDNNPLSETYASESKS

SEQ ID NO: 21665 - protein, 489 aa, Coxiella burnetii RSA 493
MRVKEEALTFDDVLLLPNYSEVLPKDVSLTTRLTREITLNIPLLSAAMDTVTEARLAIALAEAGGIGILHKNMSPTYQANEVRKVKKFESGVVFDPITVSPESTIGELKKITSEYNISGLPVVEGEQLIGIITSRDIRFETDMQQKVVNLMTPKDRLITIKEGASRDEIINLFRQHRVEKLLVINDRFELRGLITVKDILRSERNPNACKTKSGQLRVGAAVGTGGETPDRVTALAAGGVDVIVVDTAHGHSKGVIEQVKWIKKNYPHIPVIAGNIATASAARALADAGVDAVKVGMGPGSICITRVVAGIGVPQITAINAVAAELKKEDISIIADGGIRFSGDICKAIAAGAHAVMIGGLFAGTEEAPGEEVLYQGRSYKAYRGMGSAGAMFGKYGSSDRYFQESFDKQEKYVPEGIEGRVPYKGPLRGVVHQLIGGLRSGMGYTGCRTIDEMRTKTKFIRVTNAGVRESHVHDVTVTKESPNYSVEE

SEQ ID NO: 21666 - protein, 759 aa, Coxiella burnetii RSA 493
MNMLKILRQITQEVNAAPNLEQALKLVVVRLCEALPADACSLFICDDVHGEYVLMATQGLNSKQVGKLRLKFGEGLIGLVGEREEPINLADAPLHPAYKHRPELGEEDYHGFLGIPIIEQGELLGILVIQQLESHHFAEEEEAFCVTLAIHLAAEIAHARAKGALEKLGARKRRRRKTETVLYGVPGSSGVAIGTAMIVYPPADLDAVPDQEITDIEAEVSDFEAALAAARDEIQTLQARAKNSLSVAENALFDAYLRLLDSRTFINEVIHEIKEGQWAQGALKRIIKKHVLHFESLEDPYLRERAADFRDLGRRILAHLQFSEQEELEYPKNTILVSEEVTATSLIEVPQDRLRGVISGTGSSNSHVAILARALGLPAVMGVRGTPLFKLGEQEIIVDGYNGQIYLSPSAEIKKEFKALAEEEQQLDEELQALRELPAETKDGHALALYVNTGLAIEGGLSLSVGAEGVGLYRTEMPFMIRDRFPSEEEQRIMYRQLLNTFAPRPVIMRTLDIGGDKTLPYFSVEEDNPFLGWRGIRVTLDHPEIFLQQVRAMLHASEGLNNLSVLLPMITSINEVETATRMINQARDELIEEGINVELPSVGLMIEVPATVYQAFELAKRVDFLSVGSNDLIQYLLAVDRNNPRVANLYDGLHPAVLQALKIVVKAGHRAGKPVSICGEMAGDPLAVILLLAMGFDTLSMNARILPRVKWVIRNFEMAHAKELLDEALKMDDPKDIRLLMEHTLEEAGLGGLIRAGR

SEQ ID NO: 21667 - protein, 417 aa, Coxiella burnetii RSA 493
MDIYTLGSIVLTFAVLIAYVNHRFIRMQSTIAIMSASLLLSAIFIIFHHFHIANIGQLTENVIENIDFPDLLLKGLLNFLLFAGALTIDFNMLKAQKWEIGMLASLSTIVSTVLIAFILYYFLQFLHLDLPFLYCLLFGALISPTDPIAVLATFKQLGAPERLTACVAGESLFNDGVGIVLFITFYALTVNHIPATIEKISLLFLRQAVGGIIYGLLLGFITTQLLKSVKDYSLSILLTLAAVTGGYQLALALGISGPLAMVITGIMVGAYIRRDQDETHKKKTKALETFWEVIDEVLNAILFLLIGFELLAIKASTLQIVAILLTIPLVLLVRLITVSIPIKFIQLKRNHNPYIISILTWGGLRGGLAVALALSLPFNEYRNFILGMTYGVVIFSIIVQGLTIKPLTRLARRSHEG

SEQ ID NO: 21668 - protein, 698 aa, Coxiella burnetii RSA 493
MPSRKKKSSVTKTKKKTTGKKARVTAKAKPSVKSKLKTVKRAPAKPKSVTVAKTKSKKEKAKVVSQPLPKTAEKKPSAPPSETQQPKIGENAAESQRLGFGALLEEAKNKGYLVHEDLINLLPNDYADPSQMEGIIGRLTEMGIKVFEIPPDADSLLLEEDTQSDDDEINEDVAEVLATETRTTDPVRMYMREMGSVELLTREGEIVIAKRIEEGIRQVMGAVVQYPELIEKFIKEYDTIVATEGRLSDLLIGFFDEEESTASPVAPEARDKEAETSDEDDGGEGGSDEFGESGPDPLITQQHMEELKKLYGRYQNAIKRYGKKAPATLKHQKALAELFSTFKLSIKQFNRLTGQLRRMLRAARAQERLIMSYCVVKAKTPRKKFIASFPHNETNMKWLEQYKNENKEQAKRLEKYSKEIYRAQRNLAQLEEQNNLNIQEIKEINRRVAIGEAKSRRAKKEMIEANLRLVISIAKKYTNRGLQFLDLIQEGNIGLMKAVDKFEYRRGYKFSTYATWWIRQAITRSIADQARTIRIPVHMIETINKLNRISRQILQETGIEATPEELGRRMDMPEEKVRKVLKIAKEPISMETPIGEDEDSNLGDFIEDINMESPVDFATSAGLMEATREILSTLTPREAKVLRMRFGIDMNTDHTLEEVGKQFDVTRERIRQIEAKALRKLRHPSRAEKLHSFIEVEE

SEQ ID NO: 21669 - protein, 444 aa, Coxiella burnetii RSA 493
MKTFQARYKLLFPLVLSGVIATIVLSYWFLPAVLAFYKVYWLFIFVAAIVVLTPLGNRRLGEMPPSKKLPHWILQVLIFEISLLAVFWGICVLVGLKMPLFSEAQPQLFTQTLSYLSTQLGIFSWAAIAVIACAMGTVSYRQQQDAYLSTTLRPLLRTQPNSAFELIVNALPRTATLFAFSGTFALYVLLIAGILVPQPLSSLTGLSLLSGIFFFLLVILTTNNFIKRKIYLFTINIRMPLLFRLICFLLLLTLLVIVLSLFLGSTFEKRPSMPGVVHAFLRHGWISNWRLFAIFWWLSWTPITAIFIAKLSRGRSLRSIILTVCALPMVLGILSYNDYLPLDKIPIWLSIVIALMGLFIFLAIISPDYAFDSIMQTYLPKPGVIKYRASDRFLINIFQFSALMICIYLATGIVLLGLLFFIFMLLLSVMLPAISAILLKKNTH

SEQ ID NO: 21670 - protein, 352 aa, Coxiella burnetii RSA 493
MKTKTTKKTIKKAAKKIKKPSKRKIKKTAKKSRPKKPIKASDHGLIFAKTKKETTEKEDAELANAKAKTKKRRETRSSDPTQIYLRELGFQPLLNAKEELKIARRVHKGDPKARKQMIEANLRLVVKIARHYVNRGLPFLDLIEEGNLGLLTAVEKFDPERGFRFSTYATWWIRQTIERAIMNQSRTVRLPIHVIKELNVYLRTAKKLTQEVDHEATPEDVAHLIDKPVQEIRRIMDLAPSATSIDVPISEDGQKSLVDTLADDNNIDPARLIQNVDLQDHIERWLAQLDERHREVVILRFGLHENEKGTLEAVGKAVGLTRERVRQIQIDALQQLRHILEMEGVTGEEVED

SEQ ID NO: 21671 - protein, 428 aa, Coxiella burnetii RSA 493
MTATITDINAHEILDSRANPTLEVRVTLSSQAYGCAAVPSGASTGEREAVELRDNDLERYGGKGVLQAVENVNGPIRDALLGQDPRSQEEIDRIMIELDGTENKANLGANAILGVSLAVAYAAANNADLPLYRYLGGDGGPFSMPVPMMNIINGGAHATNNLDFQEFMIVPVGAPTFAEALRYGAEVFHALKKRLVSRGLMSAVGDEGGFAPDLPNNEAAFELILEAIEDANYVPGKDIYLALDAASSELYQNGRYDFENNQLTSEEMIDRLTEWTKKYPVISIEDGLSENDWAGWKLLTERLENKVQLVGDDIFVTNPDILEKGIKKNIANAILVKLNQIGTLTETLATVGLAKSNKYGVIISHRSGETEDTTIADLAVATDARQIKTGSLCRSDRVAKYNRLLQIERELNDQAPYAGKEAFLFNRK

SEQ ID NO: 21672 - protein, 306 aa, Coxiella burnetii RSA 493
MTPFNETHFIIMLYQTIRDQLKKRAIAARAVQAGQKGMPAIKNIIAVASGKGGVGKSTTAVNLALALAEAGAEVGLLDADIHGPNQPLMLGVQKKPEMQAKKFVPIRKYGIQSISVGYLIDPKTPVIWRGPMVSQALQQLLYDTLWEDLDFLILDLPPGTGDIPLTLAKKAPIAGAVIVTTPQDVSLLDAGKALTMFKKLGITVLGIVENMALYTCPQCGHTEAIFGSGGGESMAAADNVPLLGRLPLHIAIRKNADAGTPLVMAEPESALASHYRTIAFALVEQLTLQPINYAVKFPTIVVEGGK

SEQ ID NO: 21673 - protein, 657 aa, Coxiella burnetii RSA 493
MQGGKNNNEEALLEIINNVPHYIFWKDKNLIFRGCNKMFAEQFGYKDQSGIIGKTDEDFPWSKELRKKYRQDDLSVIETGKPKLDYEESQVQADGSIKTVLVSKVPYRNKEGNIVGILGIYTDITKRKRMEESLRKANKVKSEFLANMGHDLRTPLTGIILIAEYLWKKQTEEKDKQLSKDLILAGKQLLHFINEVLEITNVEAGNIDYEKKSFSLKKLIDQVFAMLRPSFQQKQLAFYNDYDPHIPEVLIGSEIMIFRILMNLLGNSLKFTEEGQVTIQTKLANRSGNQVLIELIVSDTGIGIPKEEHKNIFAQFKRLTPSYASKYRGSGLGLFLVKTYAEALQGQVTLESEPGRGSRFICTIPLTVGKRKDLRSQKEKSYDAALTKLEELLEPELLPSIAKKSDLKKVPVLLVEDTPLAQKAIGIKLEELGCAVDLADNGEAAIKKASQNRYSLIFMDIGLPGIDGYEAAARIRAWEKEHHKSPTPIVALTAHVNEEGEQQCYKVGMNLVLHKPMLGQYGQRILNRFVNNERREIGSPASDAEKRNNNNKVIDWTSATRIFGNKAAAEKMFKLFLEELPRFHEDIKKAFEANDRKALAFHVHKLNGAACYAPTPRLQKILVDFESKLRSRSPIDLKPYYDKLEKELQAVLATANS

SEQ ID NO: 21674 - protein, 288 aa, Coxiella burnetii RSA 493
MSQFLTRVEERSLSIGSIGSYISWVNRIPLLSAEEEHDLANKFRQSNDLEAARKLVLSHLRFVVRIARGYSGYGLSQADLIQEGNIGLMKAVKRFDPQVGVRLVSFAVHWIRAEIHEFILKNWRIVKIATTKAQRKLFFNLRKHAKKRGWFSDHEAFALAEELNVSTKDVRQMEERLNSYDEAFDGADEESDSGTPSWGAPAHYLEDKRYNPALQLERSNWADDQEHRLHNAMQSMDDRSRDILYQRWLSEKKSTLHELAAQYAVSAERIRQLEKNAMQKIRTAMADE

SEQ ID NO: 21675 - protein, 429 aa, Coxiella burnetii RSA 493
MTQDYHIANINLADWGRKEIEIAETEMPGLMALRKKYKNAKPLKGARIAGCIHMTIQTAVLIETLMLLGAEVRWSSCNIFSTQDHAAAALAQKGIPIFAWKGETEEEYWRCIASTLEGPKGWTPNLLLDDGGDLTAHTLQKHPELCQNIRGVSEETTTGVHRLYRMLKEGSLKFPAINVNDSVTKSKFDNLYGCRESLIDSIKRATDVMIAGKRVVVCGYGDVGKGCAQSLRAYGATVYITEIDPICALQAAMEGYRVVTMDEMADSADIFVTATGNTDIITHEHMLKMKDQAIVCNIGHFDNEIDIASLQDYQWMNIKPQVDQVIFPDGKRLTVLAQGRLVNLGCATGHPSFVMSNSFTNQVLAQIELWQYPEKYPIGVYVLPKHLDEEVARLHLERVGGKLTTLTEKQADYIGVDPEGPFKSEHYRY

SEQ ID NO: 21676 - protein, 485 aa, Medicago truncatula
MSLTVEKTQAGREYKVRDLSQADFGRLEIELAEIEMPGLMSCRTEFGPSQPFKGARITGSLHMTIQTAVLIETLTALGAEVRWCSCNIFSTQDHAAAAIARDSAAVFAWKGETLQEYWWCTERALDWGPGGGPDLIVDDGGDATLLIHEGVKAEELYEKTGEVPDPSSTDNAEFQLVLTIIRDGLKTDPKRYRKMKDRLVGVSEETTTGVKRLYQMQASGTLLFPAINVNDSVTKSKFDNLYGCRHSLPDGLMRATDVMIAGKVGVVAGYGDVGKGCAVALKQAGARVIVTEIDPICALQALMEGFQVLTLDDVVSYADIFVTTTGNKDIIMVDDMRKMKNNAIVCNIGHFDNEIDMSGLENYPGVKRVTIKPQTDRWVFPETNTGIIVLAEGRLMNLGCATGHPSFVMSCSFTNQVIAQLELWNERKSGKYEKKVYVLPKHLDEKVAALHLGKLGAKLTKLSQSQADYISVPVEGPYKPAHYRY

SEQ ID NO: 21677 - protein, 485 aa, Medicago truncatula
MALLVETTTSGREYKVKDMSQADFGRLEIELAEVEMPGLMSCRTEFGPSQPFKGARITGSLHMTIQTAVLIETLTALGAEVRWCSCNIFSTQDHAAAAIARDSAAVFAWKGETLQEYWWCSERALDWGTGGGPDLIVDDGGDVTLLIHEGVKAEEVFEKTGQLPDPSSTDNAEMQIVLTIIRDGLKTDPKRYQKMKTRIVGVSEETTTGVKRLYQMQATGTLLFPAINVNDSVTKSKFDNLYGCRHSLPDGLMRATDVMIAGKVAVVCGYGDVGKGCAAALKQGGARVIVTEIDPICALQALMEGLQVLTLEDVISEADIFVTTTGNKDIIMVSDMKKMKNNAIVCNIGHFDNEIDMHGLETYPGVKRITIKPQTDRWVFPETKSGIIVLAEGRLMNLGCATGHPSFVMSCSFTNQVIAQIELWKEKTSGKYEKKVYVLPKHLDEKVAALHLGQLGARLTKLSKDQADYISVPVEGPYKPAHYRY

SEQ ID NO: 21678 - protein, 491 aa, Malus x domestica
MTSILMGYDIGVMSGASIYIEKDLKVTDTQIEIMIGVIEIYSLIGSAMAGKTSDWVGRRYTIVISGAIFFIGAILMGFSTNYTFLMCGRFVAGIGVGYALTIAPVYSAEVSPTSSRGFLTSFPEVFVNIGILLGYLSNYAFSFCPLDLGWRLMLGVGAIPSVGLAVGVLAMPESPRWLVMQGRLGEAKRVLDRTSDSKEESMLRLADIKEAAGIPEECNDDIVQVSGHSHGEGVWKELLVHPTPTVRHILIAAIGFHFFQQASGIDALVLYSPRVFAKAGITSTNQLLLCTVGVGLSKTVFTLVATFFLDRVGRRPLLLTSMAGMVGALVCLGTSLTIVDQHEGVRMTWAVILCLCCVLAYVGFFSSGIGPIAWVYSSEIFPLRLRAQGCGMGVAVNRLMSGILSMTFISLYKAITMGGTFFLYAAIGTVGWIFFFTMLPETQGRTLEDMEVLFGKFHKWRKANKLLEKKKRVAHGDIGTSDPDNRAHLLA

SEQ ID NO: 21679 - protein, 481 aa, Malus x domestica
MTSILLGYDIGVMSGASLFIKENLKISDVQVEIMNGTLNLYSLIGSALAGRTSDWIGRRYTIVLAGTIFFIGALLMGFAPNYAFLMFGRFVAGVGVGYALMIAPVYTAEISPASFRGFLTSFPEVFVNIGILLGYVSNYAFSKLPIHLNWRIMLGVGAFPSVILAVGVLAMPESPRWLVMQGRLGDAKRVLQKTSESIEECQLRLDDIKEAAGIPKESNDDVVQVSKRSHGEGVWKELLLHPTPAVRHILIAALGIHFFEQSSGIDSVVLYSPRIFEKAGITSYDHKLLATVAVGVVKTICILVATVFLDKFGRRPLLLTSVAGMVFSLSCLGASLTIVDQQHGKIMWAIVLCITMVLLNVAFFSIGLGPITWVYSSEIFPLQLRAQGCSMGVAVNRVTSGVISMTFISLYKAITIGGAFFLYAGIAAVGWVFFYMLYPETQGRTLEDMEVLFGKYHKWREANALLQKAKQVDGDDKGQVH

SEQ ID NO: 21680 - protein, 344 aa, Pseudomonas aeruginosa
MRSAGSLVGRPAVSISTGACGQRRHSLDQRLARIDQGHRHVEDAAQGLDLFLRTDAEAVHGHQGDALRAVLQYVTGGQLGQGGGLAHAGRADQCDHAPLLSRSISGVLIEPARCASSMRQACFGSSGPAMAACADTAAELSQYGECIGLPANLATEEGARALAAELSERLEHLDILVNNAGTTWGAPLESYPASGWEKVMQLNVTAVFSCIQQLLPLLKKGGSAQNPARVINIGSVAGLTSHGESAYAYGPSKAALHQLSRMLARELVKDHINVNVIAPGRFPSKMTRHIANDEQAMAEDTAVIPMGRWGREEEMSALAISLASAAGAYMTGNIIPIDGGFHLG

SEQ ID NO: 21681 - protein, 453 aa, Mycobacterium tuberculosis
MNELLHLAPNVWPRNTTRDEVGVVCIAGIPLTQLAQEYGTPLFVIDEDDFRSRCRETAAAFGSGANVHYAAKAFLCSEVARWISEEGLCLDVCTGGELAVALHASFPPERITLHGNNKSVSELTAAVKAGVGHIVVDSMTEIERLDAIAGEAGIVQDVLVRLTVGVEAHTHEFISTAHEDQKFGLSVASGAAMAAVRRVFATDHLRLVGLHSHIGSQIFDVDGFELAAHRVIGLLRDVVGEFGPEKTAQIATVDLGGGLGISYLPSDDPPPIAELAAKLGTIVSDESTAVGLPTPKLVVEPGRAIAGPGTITLYEVGTVKDVDVSATAHRRYVSVDGGMSDNIRTALYGAQYDVRLVSRVSDAPPVPARLVGKHCESGDIIVRDTWVPDDIRPGDLVAVAATGAYCYSLSSRYNMVGRPAVVAVHAGNARLVLRRETVDDLLSLEVRHHHHHH

SEQ ID NO: 21682 - protein, 453 aa, Mycobacterium tuberculosis
  unsure (1)..(453): unsure at all Xaa locations
XNELLHLAPNVWPRNTTRDEVGVVCIAGIPLTQLAQEYGTPLFVIDEDDFRSRCRETAAAFGSGANVHYAAKAFLCSEVARWISEEGLCLDVCTGGELAVALHASFPPERITLHGNNKSVSELTAAVKAGVGHIVVDSXTEIERLDAIAGEAGIVQDVLVRLTVGVEAHTHEFISTAHEDQKFGLSVASGAAXAAVRRVFATDHLRLVGLHSHIGSQIFDVDGFELAAHRVIGLLRDVVGEFGPEKTAQIATVDLGGGLGISYLPSDDPPPIAELAAKLGTIVSDESTAVGLPTPKLVVEPGRAIAGPGTITLYEVGTVKDVDVSATAHRRYVSVDGGXSDNIRTALYGAQYDVRLVSRVSDAPPVPARLVGKHCESGDIIVRDTWVPDDIRPGDLVAVAATGAYCYSLSSRYNXVGRPAVVAVHAGNARLVLRRETVDDLLSLEVRHHHHHH

SEQ ID NO: 21683 - protein, 568 aa, Homo sapiens
MGFLGFPGLYVSFLPLLPSLPLKVCFPTVSKRFLPEDKYRLAEEVALSVRGGSGTVSPRHSWAPQHGATGGLEKQQQERGSPANHNTKSKARKKLPLTMADSRRPCTLMGIYPHEPKHEKKVNKGATAAQTSYLMEDIRFLIQEFIVNKVRECKVSVRKPREAYEKSERNTVEHLKDNKADYKHDHIIKEWYPTFIDARGDLGGSAFSTCFLFSTFPRTDKCHVQIVPLCCRLAAEFTYYIIAACAPSKVFLSIKRIYYQAEVLAQPIVWITPCAFSHDHRTDVDYRPLPVAQRSLSPQAEGQAQAEGKASEGTYALDSESPVEKLEALSASLARAVVPITEEEAEVDEFPANGELAVQEEDHRKELEAQEKHKKLFEGLNTHQIVDWPGQQTSVIGRHYVEPQWLFDSVNARLHFPGAEYFPAMQLPLHSSPFVTEEEGDYIPSEKLKLLALQRGEDPGNLNESEEEEEEDNQGDGDEGGENEGESGSETEEKAWLAAPEEQRTEGKKPRVIAGHEKLEKQQQLAQEEESEARRLATMMMKKPEKYLYQKIMFDKRRKSQEAKKLPE

SEQ ID NO: 21684 - protein, 269 aa, Homo sapiens
MIPEPKGKEIVSLLERNITVTMYITIGTRNLQKYVSRTSVVFVSISFIVLMIISLAWLVFYYIQRFRYANARDRNQRRLGDAAKKAISKLQIRTIKKGDKETESDFDNCAVCIEGYKPNDVVRILPCRHLFHKSCVDPWLLDHRTCPMCKMNILKALGIPPNADCMDDLPTDFEGSLGGPPTNQITGASDTTVNESSVTLDPAVRTVGALQVVQDTDPIPQEGDVIFTTNSEQEPAVSSDSDISLIMAMEVGLSDVELSTDQDCEEVKS

SEQ ID NO: 21685 - protein, 165 aa, Homo sapiens [sequence omitted]

SEQ ID NO: 21686 - protein, 213 aa, Homo sapiens [sequence omitted]

SEQ ID NO: 21687 - protein, 544 aa, Homo sapiens
MRKCGGEKAIPSNALNSLLSKAAEKPDVSWDRKNNPGPWNKLSPKDQYKFYSVHMDYSKLKKEACPLYSCRTPVHSSHHDCSWGDEYHVAQLWGKKKKQRKPWCWYCNRDFGDEKILIQHQKAKHFKCHICHKKLYPGPGLAIHCMQVHKEIIDAVPNAIPGITDIELEIYGMEGIPEKDMDEGRQVLEQKTQESQKKKEQDDSDEYDDDDSAGSTSFHPQPVQLQQGYIPPVAQPGLPPVPGAPGMPLGIAPLMPGVPPLMPGMPPVMPAMPPGLHHQRKCTQSFFGENIMMPMGGIYHLDQEYTTWTRNTPPGPGIPPLMPGMSPVTQTQAVSAPGILNRPPAPTATVPAPQPPVTKPLFSSAGQAQAAVQGPVGTDFKPLNSTPEATTASPKPMFSAYTQSADSTTSTTNSTAAKPAASITSKPATLVTTNATTMPAYLPGAIPPYGQGPPTVPPYQSGPPRPPMGMRPPVMLQVSTCLALQIPAQLRLMDFILNQSSAPGYPGLCLRSSDEVKVSTADVLSKEIDDTSEKIQMEINMDVV

SEQ ID NO: 21688 - protein, 98 aa, Homo sapiens
MDVELTVEERNLLSVSYNNVIEARRAFWRIISIEQKEENKGEDKLKMIWEYQQMVETELNLICCHFLLAKAAFDDAIAELDTLSEGSYNDTMDFRHAG

SEQ ID NO: 21689 - protein, 432 aa, Homo sapiens
MDARNFQECSGSVSRAKGICRGAEGGLIDFIAEVDLTSALTRKITLKTPLISSPMDTVTEADVAIAMALMGDTGFIHHNCTPELQAKELRKVKKFEQGFITDPTVLSPSHTVGDVLEAKMRHGFSGIPITETGTMGSKLVGIVTSRDINFLAEKDHTTLLSEVMTPRLELVVAPACVTLKEANEILQRSKKGKLPIINDRNELVAIITGSDLKKNQDYPLASKDSQQAAAVGVDIIVLDSSQGNLVYQIAMVHYIKQKYPHLQVIGRNVVTAAQAKNLIDAGVDGLCVGMGCGSICVTREVMACGQPQGTAVYKEAKYARRFGVPIIANGSIQTMGHIVKALALGVSTVMMGSLLAITMEAPGEYFSDEVRLKKYWGMGSLDAMEKSSSSQKRYFSKGDKVKIVQGVLGSIQDKGSIQKFVPYLIVGIQHGC

SEQ ID NO: 21690 - protein, 456 aa, Homo sapiens
MAMRTRQLNGTCTSSVDMELFLHYSLIPSAQAVDMLRSQPRALEKRESTDVRTEARGDLSCRPLDFVGTFSNRWSYGITFGATANKVMFLFSEGYQPLQIPQWAQAFELLIGGIEVGLSHFPFFACLSSEFQLVSSILGFCYSDLTAWAVPCIPSSGEMMVGFHICVASPALEITLSPCISHQARRRPAGATEDEVARSAKKMDEIVQEKNTAGALGLLTELQNVLELLRSTGTGMLLNVSLKQSTDEEVTSLAKSFVKSWKTLPDEPSTEKDPNEKRIEPAMTSQNSKRNASNSVRMKYREMLAAALRTGDDCIEMGADEEELGSRIEEAVDPERGNTGMKYKNRVQSKISNLTDAKNPNLRKNASCGNIPPDLLARMSAEEMASDELKEMHKNLTKEAIREHQMAKTGGTQPDSLTCGKCKKNCTSTQVQACSVGEPMATFVDCNECGNQQKFC

SEQ ID NO: 21691 - protein, 505 aa, Homo sapiens
MGGLGKKNYERGSATNYITQNKAQKKLQLSLADFRQLCILKRIYPHEPKHKKKVNKRSTAAQTFYLIEDIRFLLHEPIVNKFWEYKVLIRKLLKAYRKSKNGTLRSLMPCETWTTPSPCASSFPPSHGLARAMCRPFTMEFMHYIIAASALPQGLPVHQRHLLPDMDYRVMATFTEFYSTLLGFINFHLYQWLNLHYPLKLEGQAQEEAKASEGTHALDSESSMEKMAALTASLARVVVPATEEEPEVDEFPANGEMSAQEEERRKELEGQEKHKKFSEGLKFFLNQGVPREALAFVISFWGEVSWDKSLCIGATYDITDSRITHKIVNWPGQQTSIIGRCYMQPQWVIDSVNARLLLLMAEYFPGKWEKYLYQKIMFGKRRKIREANKLAEKRKAHDEAVTSEKKAKKARLEWEHNGKTSINQMRSQPRLRWSGRCLPVHPTVTKGLSNRLTPTQTKNIPLGRSKEVKKQRCGGKIPNTLSFQEDSAGTLSGFLGSKSNQEDLN

SEQ ID NO: 21692 - protein, 234 aa, Homo sapiens
MTHTTLSFAEDFLAGGVAVAIPKMAVVPIEGVKLLLQALNFTFKDKNKQIFLGGVDKKTQFWHDFAGNLASGSAAGATSLCFVYPFGFAHTFLAADVGRPGGERGFRDLDDCLVKIYKSDGIKGLYQGFNVPVQGIVIYQAVYFSIYGTVKGMLPDPKNTRIVISWMMAQSITSICWSELKATDIMYTGTLDCWRKIARDEGDKAFFKGAWSNVLRGMGGAFVLVLCDEIKKYT

SEQ ID NO: 21693 - protein, 128 aa, Homo sapiens
MTGGKAGKDSGKAKTKAVSRCQRAGLQFPVGRIHLHLKSRTTNHGRVGATAAVYSAAILKYLTAEVLELAGNASKDLKVKRSTTGHLQLAIRGDEELDSLIKATIAGGGVIPHIHKSLTGKKGQQKTV

SEQ ID NO: 21694 - protein, 354 aa, Homo sapiens
MGSGISSESKESAKRSKELEKKLQEDAERDARTVKLLLLGAGESGKSTIVKQMKIIHKNGYSEQECMEFKAVIYSNTLQSILAIVKAMTTLGIDYVNPRSAEDQRQLYAMANTLEDGGMTPQLAEVIKRLWRDPGIQACFERASEYQLNDSAAYYLNDLDRITASGYVPNEQDVLHSRVKTTGIIETQFSFKDLHFRMFDVGGQRSERKKWIHCFEGVTCIIFCAALSAYDMVLVEDEEVNRMHESLHLFNSICNHKYFSTTSIVLFLNKKDIFQEKVTKVHLSICFPEYTGPNTFEDAGNYIKNQFLDLNLKKEDKEIYSHMTCATDTQNVKFVFDAVTDIIIKENLKDCGLF

SEQ ID NO: 21695 - protein, 384 aa, Homo sapiens
MATFVELSTKAKMPIVGLGTWRSLLGKVKEAVKVAIDAEYRHIDCAYFYENQHEVGEAIQEKIQEKAVMREDLFIVSKVHMAHLVWPTFFERPLVRKAFEKTLKDLKLSYLDVYLIHWPQGFKSLKKWYADVVFSKHQDPETLLNRTKCPDADSSKLFILYLQTGDDFFPKDDKGNMISGKGTFLDAWEAMEELVDEGLVKALGVSNFNHFQIERLLNKPGLKYKPVTNQNSLGTMQNRAGFPRDEDCLLLQVECHPYLTQEKLIQYCHSKGITVTAYSPLGSPDRPWAKPEDPSLLEDPKIKEIAAKHKKTTAQVLIRFHIQRNVTVIPKSMTPAHIVENIQVFDFKLSDEEMATILSFNRNWRAFDFKEFSHLEDFPFDAEY

SEQ ID NO: 21696 - protein, 965 aa, Homo sapiens
MWVRCALLVARDCGCAERVCPSVVRDRVCVVGAGKIHTKEKNIAHLLEMKYFKFNISLANAEFISQDSWLAWVGFVKVVKYKAYCKRYQVTFRRQCEGKTDYYAWKHLVVQDKNKSNTHKYRMIICVINTDTICEMAYAHIEWDMIVCAAYAHELPKYGVKVGLTNDAAACCTGLLLACRLLSRFGMDKIYKGQVEVTRDEYNVGSTDGQPGAFTCCLDAGLARTTTDNKVFGALRVLWMEVSLSLTVPNDSLSKGKPGPRKEQLPARGSLSRGVLGAFEVGSQGVEAAASPNGQYGPSWGLAAEGTEGARPQAPKRDLSYSRTDSHRDCSPVCHNMSLRGHLVPKKPSKEKQGQQKLDSKFYESWATALLTAIFPVLGILVLVESLLMNDPMRECILSTSGFSGPRARLLGVLALGGLPLHLGAPVIVMAWIVLALLFTRSRTRADPADVLPPGAFEKTRMHALPPPLGLTLDDGEVITTRLLTDASVQKVVVRISESSSCLHNGLLSGNGCEVHYRRARLFQDAQMPAQSPAYRGDLRAPVNALRIQNRSQLSPGGKIKWRQHRQLEGTHRKKSSTMFRKIHSIFNSSPQRKTAAESPFYEGASPAVKLIRSSSMYVVGDHGEKFSESLKKYKSTSSMDTSLYYLRQEEDRAWMYSRTQDCLQYLQELLALRKKYLSSFSDLKPHRTQGISSTSSKSSKGGKKTPVRSTPKEIKKATPKKYSQFSADVAEAIAFFDSIIAELDTERRPRAAEASLPNEDVDFDVATSSREHSLHSNWILRAPRRHSEDIAAHTVHTVDGQFRRSTEHRTVGTQRRLERHPIYLPKAVEGAFNTWKFKPKACKKDLGSSRQILFNFSGEDMEWDAELFALEPQLSPGEDYYETENPKGQWLLRERLWERTTGSLRSCPLSAQHEVFGRVENANCNTVNPLSTLPAGAVPVPNRPVASQGTGLRTLSELEFLCVG

SEQ ID NO: 21697 - protein, 522 aa, Homo sapiens
MFPWGLSCLSVLGAAGTALLCAGLLLSLAQHLWTLRWMLSRDRASTLPLPKGSMGWPFFGETLHWLVQGSRFHSSRRERYGTVFKTHLLGRPVIRVSGAENVRTILLGEHRLVRSQWPQSAHILLGSHTLLGAVGEPHRRRRKVLARVFSRAALERYVPRLQGALRHEVRSWCAAGGPVSVYDASKALTFRMAARILLGLRLDEAQCATLARTFEQLVENLFSLPLDVPFSGLRKGIRARDQLHRHLEGAISEKLHEDKAAEPGDALDLIIHSARELGHEPSMQELKESAVELLFAAFFTTASASTSLVLLLLQHPAAIAKIREELPDLSLAALGRLRYVDCVVKEVLRLLPPVSGGYRTALRTFELDVSAPCQPMASLLPPAACRLPPAACRGGAQGYQIPKGWSVMYSIRDTHETAAVYRSPPEGFDPERFGAAREDSRGASSRFHYIPFGGGARSCLGQELAQAVLQLLAVELVRTARWELATPAFPAMQTVPIVHPVDGLRLFFHPLTPSVAGNGLCL

SEQ ID NO: 21698 - protein, 407 aa, Homo sapiens
MSSLADYLISSGTSYVPEDGLTAQQLFTSTNGLTYNDFLILPGFIDFIADDEAKMLHGFSGIPLTETGTMGSKLVGIITSRDVDFLAKKEHATFISVTLKEANEILQRNKKGKLPIVSDRDELVAIIARTDLKKNRDYPLASKDSHKQLLCRAAVGTREDDECHLDLLTQAGVNVVVLDSSQGSSVYQITMVHYIKQKYPHLQVIGGNVVTAAQAKNLMDARVDGLHVGMGYGSICITQKVMACGWPQGTAVYKVAKYAQCFDCGARGQGPGPWSLHSDDGLLLATTTEAPGEYFFLERVQLKKYQGMGSLDAMEKSSSSQKRYFSKGDKVKIAQGVSGSIQDKGSIQKFVPYLIAGIQHSCQDIGARSLSVLWSMMYSGELKFEKQTMSAQIKGGVHGLHSYEKQL

SEQ ID NO: 21699 - protein, 310 aa, Homo sapiens
MTDLKQSHSVRLNDGPFMPVLGFGTYAPDHTPKSQAAEATKVAIDVGFRHIDSAYLYQNEEEVGQAIWEKIADGTVKREEIFYTIKLWATFFRAELVHPALERSLKKLGPDYVDLFIIHVPFAMKPGKELLPKDASGEIILETVELCDTWENQGDKHKLLELILNKPGLRYKPTCNQVECHPYLNQSKLLEFCKSKDIVLVAYSALGSQRDPQWVDPDCPHLLEEPILKSIAKKHSRSPGQVALRYQLQRGVVVLAKSFSQERIKENFQIFDFELTPEDMKAIDGLNRNLRYDKLQFAANHPYFPFSEEY

SEQ ID NO: 21700 - protein, 220 aa, Homo sapiens
MALSGVRSDTSSAAYKVQPQTCHPTIRHFQNTVYNEPEPSDQTGTREKSTSVSSPQRDRRRRRAGRGQGRRRGAAESPQRQGLRPELLALQPPRPEGPGRAERSRPEPRRTRDAELPAPPTSLSLVWAAQLGGSRPPAPPQHPRGLCGLSLLSSGLGPVVDGAEMVESVKKLAGMDVELTAEERNLLSVTYKNVIGARRASWRIISSLEQKEGTREEKTS

SEQ ID NO: 21701 - protein, 447 aa, Homo sapiens
MKGSPVPLTIPSGLSSASRNCSPGLSPGSALPPTPHQWFRTPDAFGISWSPRTSTRIMSRGSLPQNHEGTHMVYPGSSLIRGNDEIPRSPPVLQAGLSHRVLSQHGIKCLELILQEQPWRSPQTKAQSPSPVSIISVTSLSDKLPSKVIDIGLAAWGCKALNIVENEMPGLMHMWELYSASKPLEGNHSASCLHMTMEMAIHIGSLITLGAPAATSSSPWTMCWLPLPRLAFQFTPGRAKERRVPMVHRAVTVIQGWALNIILEDGGDLANLFHTKMMVNGILKVPAINVNDSLTKSEFNKLYGCWESLIDGIKWATVVMIAGKVAMVAGYGNVGKGCAQALWGFGAHVIITKIDPINALQAAMEGYEVTTMDEACQEGNIFITTTACVNIILGRHFEQMKDDAIVCNTGHFEVEINVKWLSENPWRRPSTWGISPDCPFKADHYRY

SEQ ID NO: 21702 - protein, 531 aa, Homo sapiens
MCSLASGATGGRGAVENEEDLPELSDSGDEAAWEDEDDADLPHGKQQTPCLFCNRLFTSAEETFSHCKSEHQFNIDSMVHKHGLEFYGYIKLINFIRLKNPTVEYMNSIYNPVPWEKEEYLKPVLEDDLLLQFDVEDLYEPVSVPFSYPNGLSENTSVVEKLKHMEARALSAEAALARAREDLQKMKQFAQDFVMHTDVRTCSSSTSVIADLQEDEDGVYFSSYGHYGIHEEMLKDKIRTESYRDFIYQNPHIFKDKVVLDVGCGTGILSMFAAKAGAKKVLGVDQSEILYQAMDIIRLNKLEDTITLIKGKIEEVHLPVEKVDVIISEWMGYFLLFESMLDSVLYAKNKYLAKGGSVYPDICTISLVAVSDVNKHADRIAFWDDVYGFKMSCMKKAVIPEAVVEVLDPKTLISEPCGIKHIDCHTTSISDLEFSSDFTLKITRTSMCTAIAGYFDIYFEKNCHNRVVFSTGPQSTKTHWKQTVFLLEKPFSVKAGEALKGKVTVHKSKKDPRSLTVTLTLNNSTQTYGLQ

SEQ ID NO: 21703 - protein, 329 aa, Homo sapiens
MSVTGFTITDEKVHLYHSIEKEKTVRHIGDLCSSHSVKKIQVGICLLLVELCERFTFFEVVCNMIPFCTIKLGYHNCQAAILNLCFIGTSILTPVFVRWLTDVYLGRNKLVYICLFLHFLGTALLSVVAFPLEDFYLGTYHAVNNIPKTEQHRLFYVALLTICLGIGGVRAIVCPLGAFGLQEYGSQKTMSFFNWFYWLMNLNATIVFLGISYIQHSQAWALVLLIPFMSMLMAVITLHMIYYNLIYQSEKPPIQNVHYAVAGNLFAALSVMIAGFFEIHRKHFPAVEQPLSGKVLTVSSMPCFYLILQYVLLGVAETLVNPAPQVNNA

SEQ ID NO: 21704 - protein, 532 aa, Mus musculus
MCSLAAGNGRGAELGPEPLELSDSGDDAGWEDEDADTEPAHGRQHTPCLFCDRLFASAEETFSHCKLEHQFNIDSMVHKHGLEFYGYIKLINFIRLKNPTVEYMNSIYNPVPWEKDEYLKPVLEDDLLLQFDVEDLYEPVSTPFSYPNGLSESASVVEKLKHMEARALSAEAALARAREDLQKMKQFAQDFVMNVDVRTCSSTTTIADLQEDEDGVYFSSYGHYGIHEEMLKDKVRTESYRDFIYQNPHIFKDKVVLDVGCGTGILSMFAAKVGAKKVIAVDQSEILYQAMDIIRLNKLEDTIVLIKGKIEEVSLPVEKVDVIISEWMGYFLLFESMLDSVLYAKSKYLAKGGSVYPDICTISLVAVSDVSKHADRIAFWDDVYGFNMSCMKKAVIPEAVVEVVDHKTLISDPCDIKMDGKHIDCHTTSISDLEFSSDFTLRTTKTAMCTAVAGYFDIYFEKNCHNRVVFSTGPQSTKTHWKQTVFLLEKPFPVKAGEALKGKITVHKNKKDPRSLIVTLTLNSSTQTYSLQ

SEQ ID NO: 21705 - protein, 395 aa, Mus musculus
MQASCNQLHDPPGTAHEDAAASPCGHSRSTEGSLHPGDVHIQINSGPKEYSENPSSRNPRSGVCTCAHGCVHGRFRSYSHSEARPPDDFATKSGEHGSGSFSEFRYLFKWLQKSLPYILILGIKLVMQHITGISLGIGLLTTFMYANKSIVNQVFLRERSSKLRCAWLLVFLAGSSVLLYYTFHSQSLHYSLIFLNPTLEQLSFWEVLWIVGITDFILKFFFMGLKCLILLVPSFIMPFKSKGYWYMLLEELCQYYRIFVPIPVWFRYLISYGEFGNVTTWSLGILLALLYLILKLLDFFGHLRTFRQVLRVFFTRPSYGVPASKRQCSDMDGICTICQAEFQKPVLLFCQHIFCEECITLWFNREKTCPLCRTVISECINKWKDGATSSHLQMY

SEQ ID NO: 21706 - protein, 499 aa, Caedibacter caryophilus
MENSQKSSFTAELRRVFWPIEWHENKKFLPMAAMMFCILFNYSTLRSIKDGFVVTGIGPEAISFLKTYVVLPSAVIMMVVYAKLCNIMSPQKVFYTIAWFFSLYLVFFAFVLYPYPEFFHPNHQTIEGLVIEYPNLKWFIRICGQWSIASFYAISELYGSMMLSLLFWQFANQITKTSEAKRFYSMFGLLGNFSLPLVAATLGYLLSSEINIVAEEHRFIPVICIVIFSNILGMFFYFWMNKNVLTDPRLYDSGEAAGKPKKKKTKLSLGESFKMIFTSKYLGLLVTLILAYGISINLVEGVWKAKLRELYPTKEAYTMFMGNFQAYQGVAAIIFMLVGSNILRRVSWATAAIFTPLMILVTGIGFFSFIIFDQTIGLYFAAFFGTGPLALAVIIGTAQNVLSKATKYSLFDSTKEMAHIPLDDEMKTKGKAAVDVIGGRFGKSGGGIIQSTFFILLPTYTFAEATPYFAGVFFVIVILWIFAVQGLSKEYQKLTTGEK

SEQ ID NO: 21707 - protein, 593 aa, Plasmodium berghei
MDKIYVKVHELKFVNNLERNSHYVKIYWDDKKYKSQTKDGGCYIFNETFLIPITNIYDQKDQIIYVEIWESNLLNKQCAYTFFTLNSIKIGQIIKENITFIEVLKKCTLGLSINIVRNQKDILFFNIKELLPTFQDQEIINAVWKNEDEASIIKQLINLNTIDGITNIGNYKNSQNYNETLQKPKENISIYKSGEEIENSYIPSSTPEYVSHYIYKGRRGENSSNYINKTKDTLFPTYLNNYAYNNNIKNVYDTPNGAHYSSNNNSGSNNAYSNFDHNINNSPKNNVPFSNSDNDKIFHYSRNYMPSPNSEKMLYFSCGNKKKALLIGIDYCGTQNELKGSINDAIITNELLIKKYNFYDSSMNILKLIDNQTNPNYRPTKRNILSALEWLVQDNNPGDIFFFFYSGHSYKKYDYTCIEKGGYNQTIVPCDFKTEGEIIDNDLHKYLIQPIEKNGVKLVSFIDCPNSEGILNLGYKYKLKKEKWKETYNPFHVLADVTQFSYSKINEFPTEINLLEHVLITNNIEALTYHYMIQSIHSYINLYNKKKKKKIFLMSSQKFNIDRKFDFNHILKNSNSELGQQKNIIKWKKNKKK

SEQ ID NO: 21708 - protein, 1220 aa, Homo sapiens
MAGAGGQHHPPGAAGGAAAGAGAAVTSAAASAGPGEDSSDSEAEQEGPQKLIRKVSTSGQIRTKTSIKEGQLLKQTSSFQRWKKRYFKLRGRTLYYAKDSKSLIFDEVDLSDASVAEASTKNANNSFTIITPFRRLMLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPVQKWGTEEVAAWLDLLNLGEYKDIFIRHDIRGAELLHLERRDLKDLGIPKVGHVKRILQGIKELGRSTPQSEV

SEQ ID NO: 21709 - protein, 419 aa, Homo sapiens
MSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTKEWFIIASFGLLSALTLCYMIIRATASLNANEVEWF

SEQ ID NO: 21710 - protein, 1164 aa, Homo sapiens
MAGAGGQHHPPGAAGGAAAGAGAAVTSAAASAGPGEDSSDSEAEQEGPQKLIRKVSTSGQIRTKTSIKEGQLLKQTSSFQRWKKRYFKLRGRTLYYAKDSKSLIFDEVDLSDASVAEASTKNANNSFTIITPFRRLMLCAENRKEMEDWISSLKSVQTREPYEVAQFNVEHFSGMHNWYACSHARPTFCNVCRESLSGVTSHGLSCEVCKFKAHKRCAVRATNNCKWTTLASIGKDIIEDEDGVAMPHQWLEGNLPVSAKCAVCDKTCGSVLRLQDWKCLWCKTMVHTACKDLYHPICPLGQCKVSIIPPIALNSTDSDGFCRATFSFCVSPLLVFVNSKSGDNQGVKFLRRFKQLLNPAQVFDLMNGGPHLGLRLFQKFDNFRILVCGGDGSVGWVLSEIDKLNLNKQCQLGVLPLGTGNDLARVLGWGGSYDDDTQLPQILEKLERASTKMLDRWSIMTYELKLPPKASLLPGPPEASEEFYMTIYEDSVATHLTKILNSDEHAVVISSAKTLCETVKDFVAKVEKTYDKTLENAVVADAVASKCSVLNEKLEQLLQALHTDSQAAPVLPGLSPLIVEEDAVESSSEESLGESKEQLGDDVTKPSSQKAVKPREIMLRANSLKKAVRQVIEEAGKVMDDPTVHPCEPANQSSDYDSTETDESKEEAKDDGAKESITVKTAPRSPDARASYGHSQTDSVPGPAVAASKENLPVLNTRIICPGLRAGLAASIAGSSIINKMLLANIDPFGATPFIDPDLDSVDGYSEKCVMNNYFGIGLDAKISLEFNNKREEHPEKCRSRTKNLMWYGVLGTRELLQRSYKNLEQRVQLECDGQYIPLPSLQGIAVLNIPSYAGGTNFWGGTKEDDIFAAPSFDDKILEVVAIFDSMQMAVSRVIKLQHHRIAQCRTVKITIFGDEGVPVQVDGEAWVQPPGIIKIVHKNRAQMLTRDRAFESTLKSWEDKQKCDSGKPVLRTHLYIHHAIDLATEEVSQMQLCSQAAEELITRICDAATIHCLLEQELAHAVNACSHALNKANPRCPESLTRDTATEIAINVKALYNETESLLVGRVPLQLESPHEERVSNALHSVEVELQKLTEIPWLYYILHPNEDEEPPMDCTKRNNRSTVFRIVPKFKKEKVQKQKTSSQPGSGDTESGSCEANSPGN

SEQ ID NO: 21711 - protein, 400 aa, Homo sapiens
MAWRRREASVGARGVLALALLALALCVPGARGRALEWFSAVVNIEYVDPQTNLTVWSVSESGRFGDSSPKEGAHGLVGVPWAPGGDLEGCAPDTRFFVPEPGGRGAAPWVALVARGGCTFKDKVLVAARRNASAVVLYNEERYGNITLPMSHAGTGNIVVIMISYPKGREILELVQKGIPVTMTIGVGTRHVQEFISGQSVVFVAIAFITMMIISLAWLIFYYIQRFLYTGSQIGSQSHRKETKKVIGQLLLHTVKHGEKGIDVDAENCAVCIENFKVKDIIRILPCKHIFHRICIDPWLLDHRTCPMCKLDVIKALGYWGEPGDVQEMPAPESPPGRDPAANLSLALPDDDGSDESSPPSASPAESEPQCDPSFKGDAGENTALLEAGRSDSRHGGPIS

SEQ ID NO: 21712 - protein, 676 aa, Danio rerio
MPVDSTSELLRHYEVYETIGSGGFAKVKLGRHKLTGEKVAIKIMEKKDLGDDLPRVKIEIEAMKNLSHQHVCRLYHVIETTSKIYMVLEYCPGGELFDYIIAKDRLSEEETRVFFRQIISALAYVHSQGYAHRDLKPENLLIDEDHNLKLIDFGLCAKPKGGLGFELLTCCGSPAYAAPELIQGKAYIGSEADVWSMGVLLYALLCGFLPFDDDNCMVLYRKITRGKYSNPHWLSPSSILLLNQMMQVDPKRRLTVKHLLDHPWAMRGYSTPVEWHSKYPLGHIDEDCITEMAVTFKQSKQRTIQLVSEWKYDQITATYLLLLAKKRQGRPVRLRAECPVIDIVCSPLQDMQLKKSLRFTEDDDGVHPVVLGSMVFPPDCYDDENPWTPLTPKNTHTTNTPRMKLYPETTEKWNEMAYSPVIEHSRPCRQKPERRDRTKENKENLAVPGTDGDVFALPAPRTPTSSRKVKSNRTVMTTPNHNNNKSSEVNKGAGSATKEGSRRREVEQQQNGQQGELNMLAFSPERRSRSLDLAGCQVDSGQKRKGGKVFGSLERGLDKVITMLTPSKKRGPRDGPRKIKAQYNVTLTNQTNADQVLNQILSILPEKNVDFVQKGYTLKCHTQSDFGKVTMQFELEVCLLQKPEVVGIRRQRLKGDAWVYKHPVEDILSSSSQWSA

SEQ ID NO: 21713 - protein, 100 aa, Homo sapiens
MAGGKAGKDSGKAKTKAVSRSQRAGLQFPVGRIHRHLKSRTTSHGRVGATAAVYSAAILEYLTAEVLELAGNASKDLKVKRITPRHLRRGMFYHLHPASC

SEQ ID NO: 21714 - protein, 407 aa, Zygosaccharomyces rouxii
MATHEEFIRTQVFGTVFEITNRYTDLNPVGMGAFGLVCSATDTLAGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKVHVHQFSIITDLLGSPPRDVIITICSEDTLKFVTSLPHRDPVPFQERFKAVEPDAVDLLGRMLVFDPKKRITAADALVHPYLAPYHDPTDEPIAEAQFDWDFNDADLPVDTWRVMMYSEILDFHKIGGSDGQIDTNAAFDDQVAAATAGPMLPLWLNSNININNSHPVNIQVQLLRHQQPRITVVYQ

SEQ ID NO: 21715 - protein, 103 aa, Homo sapiens
KIQALPTVPVTEEHVGSGLECPVCKDDYALGERVRQLPCNHLFHDGCIVPWLEQHDSCPVCRKSLTGQNTATNPPGLTGVSFSSSSSSSSSSSPSNENATSNS

SEQ ID NO: 21716 - protein, 2474 aa, Saccharomyces cerevisiae
MNKYINKYTTPPNLLSLRQRAEGKHRTRKKLTHKSHSHDDEMSTTSNTDSNHNGPNDSGRVITGSAGHIGKISFVDSELDTTFSTLNLIFDKLKSDVPQERASGANELSTTLTSLAREVSAEQFQRFSNSLNNKIFELIHGFTSSEKIGGILAVDTLISFYLSTEELPNQTSRLANYLRVLIPSSDIEVMRLAANTLGRLTVPGGTLTSDFVEFEVRTCIDWLTLTADNNSSSSKLEYRRHAALLIIKALADNSPYLLYPYVNSILDNIWVPLRDAKLIIRLDAAVALGKCLTIIQDRDPALGKQWFQRLFQGCTHGLSLNTNDSVHATLLVFRELLSLKAPYLRDKYDDIYKSTMKYKEYKFDVIRREVYAILPLLAAFDPAIFTKKYLDRIMVHYLRYLKNIDMNAANNSDKPFILVSIGDIAFEVGSSISPYMTLILDNIREGLRTKFKVRKQFEKDLFYCIGKLACALGPAFAKHLNKDLLNLMLNCPMSDHMQETLMILNEKIPSLESTVNSRILNLLSISLSGEKFIQSNQYDFNNQFSIEKARKSRNQSFMKKTGESNDDITDAQILIQCFKMLQLIHHQYSLTEFVRLITISYIEHEDSSVRKLAALTSCDLFIKDDICKQTSVHALHSVSEVLSKLLMIAITDPVAEIRLEILQHLGSNFDPQLAQPDNLRLLFMALNDEIFGIQLEAIKIIGRLSSVNPAYVVPSLRKTLLELLTQLKFSNMPKKKEESATLLCTLINSSDEVAKPYIDPILDVILPKCQDASSAVASTALKVLGELSVVGGKEMTRYLKELMPLIINTFQDQSNSFKRDAALTTLGQLAASSGYVVGPLLDYPELLGILINILKTENNPHIRRGTVRLIGILGALDPYKHREIEVTSNSKSSVEQNAPSIDIALLMQGVSPSNDEYYPTVVIHNLMKILNDPSLSIHHTAAIQAIMHIFQNLGLRCVSFLDQIIPGIILVMRSCPPSQLDFYFQQLGSLISIVKQHIRPHVEKIYGVIREFFPIIKLQITIISVIESISKALEGEFKRFVPETLTFFLDILENDQSNKRIVPIRILKSLVTFGPNLEDYSHLIMPIVVRMTEYSAGSLKKISIITLGRLAKNINLSEMSSRIVQALVRILNNGDRELTKATMNTLSLLLLQLGTDFVVFVPVINKALLRNRIQHSVYDQLVNKLLNNECLPTNIIFDKENEVPERKNYEDEMQVTKLPVNQNILKNAWYCSQQKTKEDWQEWIRRLSIQLLKESPSACLRSCSSLVSVYYPLARELFNASFSSCWVELQTSYQEDLIQALCKALSSSENPPEIYQMLLNLVEFMEHDDKPLPIPIHTLGKYAQKCHAFAKALHYKEVEFLEEPKNSTIEALISINNQLHQTDSAIGILKHAQQHNELQLKETWYEKLQRWEDALAAYNEKEAAGEDSVEVMMGKLRSLYALGEWEELSKLASEKWGTAKPEVKKAMAPLAAGAAWGLEQWDEIAQYTSVMKSQSPDKEFYDAILCLHRNNFKKAEVHIFNARDLLVTELSALVNESYNRAYNVVVRAQIIAELEEIIKYKKLPQNSDKRLTMRETWNTRLLGCQKNIDVWQRILRVRSLVIKPKEDAQVRIKFANLCRKSGRMALAKKVLNTLLEETDDPDHPNTAKASPPVVYAQLKYLWATGLQDEALKQLINFTSRMAHDLGLDPNNMIAQSVPQQSKRVPRHVEDYTKLLARCFLKQGEWRVCLQPKWRLSNPDSILGSYLLATHFDNTWYKAWHNWALANFEVISMLTSVSKKKQEGSDASSVTDINEFDNGMIGVNTFDAKEVHYSSNLIHRHVIPAIKGFFHSISLSESSSLQDALRLLTLWFTFGGIPEATQAMHEGFNLIQIGTWLEVLPQLISRIHQPNQIVSRSLLSLLSDLGKAHPQALVYPLMVAIKSESLSRQKAALSIIEKMRIHSPVLVDQAELVSHELIRMAVLWHEQWYEGLDDASRQFFGEHNTEKMFAALEPLYEMLKRGPETLREISFQNSFGRDLNDAYEWLMNYKKSKDVSNLNQAWDIYYNVFRKIGKQLPQLQTLELQHVSPKLLSAHDLELAVPGTRASGGKPIVKISKFEPVFSVISSKQRPRKFCIKGSDGKDYKYVLKGHEDIRQDSLVMQLFGLVNTLLQNDAECFRRHLDIQQYPAIPLSPKSGLLGWVPNSDTFHVLIREHREAKKIPLNIEHWVMLQMAPDYDNLTLLQKVEVFTYALNNTEGQDLYKVLWLKSRSSETWLERRTTYTRSLAVMSMTGYILGLGDRHPSNLMLDRITGKVIHIDFGDCFEAAILREKFPEKVPFRLTRMLTYAMEVSGIEGSFRITCENVMKVLRDNKGSLMAILEAFAFDPLINWGFDLPTKKIEEETGIQLPVMNANELLSNGAITEEEVQRVENEHKNAIRNARAMLVLKRITDKLTGNDIRRFNDLDVPEQVDKLIQQATSVENLCQHYIGWCPFW

SEQ ID NO: 21717 - protein, 112 aa, Azorhizobium caulinodans
MKIVMAIIKPFKLEEVRDALTGIGVHGLTVTEVKGYGRQKGHTEIYRGAEYAVSFLPKLKIEVAVPSDQVAKVVEAITASAKTGQIGDGKIFVFQIDHAVRIRTGETDADAL

SEQ ID NO: 21718 - protein, 334 aa, Ricinus communis
EGVQFGWALQLSLLTPYVQLLGIPHTWAAFIWLCGPISGMLVQPIVGYHSDRCTSRFGRRRPFIASGAAFVAIAVFLIGYAADLGHLSGDSLDKSPKTRAIAIFVVGFWILDVANNMLQGPCRALLADLSGTSQKKTRTANALFSFFMAVGNVLGYAAGAYTHLYKLFPFTKTTACDVYCANLKSCFFISIVLLLSLTVLALSYVKEKPWSPDQAVDNAEDDTASQASSSAQPMPFFGEILGAFKNLKRPMWILLLVTCLNWIAWFPFLLFDTDWMGREVYGGDSSGSAEQLKLYDRGVRAGALGLMLNSVVLGFTSLGVEVLARGVGGANRFW

SEQ ID NO: 21719 - protein, 241 aa, Populus balsamifera subsp. trichocarpa
MEYQNESLESSPLRKLGRGKVEIKRIENTTNRQVTFCKRRSGLLKKAYELSVLCDAEVALIVFSSRGRLYEYSNDSVKSTIERYKKASADSSNTGSVSEANAQYYQQEAAKLRSQIGNLQNSNRHMLGEALSSLSVKELKSLEIRLEKGISRIRSKKNELLFAEIEYMQKREVDLHNNNQLLRAKISENERKRQSMNLMPGGADFEIVQSQPYDSRNYSQVNGLQPASHYSHQDQMALQLV

SEQ ID NO: 21720 - protein, 238 aa, Populus balsamifera subsp. trichocarpa
MAYQNEPQESSPLRKLGRGKVEIKRIENTTNRQVTFCKRRNGLLKKAYELSVLCDAEVALIVFSSRGRLYEYSNNSVKSTIERYKKACADSSNNGSVSEANAQFYQQEAAKLRSQIGNLQNSNRNMLGESLSALSVKELKSLEIKLEKGIGRIRSKKNELLFAEIEYMQKREIDLHNNNQLLRAKIAENERKRQHMNLMPGGVNFEIMQSQPFDSRNYSQVNGLPPANHYPHEDQLFS

SEQ ID NO: 21721 - protein, 313 aa, Ceratopteris richardii
MAMPCSDIDLLDSDNDNVDDQHISLELRQVHEDTDDGSHDEPRELSLLNHESNLCKIVNSKGKGAEAGNSLLPSTGTSRGKIQIRRIENTTSRQVTFSKRRNGLLKKAHELSVLCDAEIALIIFSSTGKLFEYSSSRGIKKILERYKRCSGILQDVGGTVIRDVEYWKQEAERLKERLTYMEEIQRNMLGESLGSLQIKDLQNLEAKLDSGLYKIRGAKTQLMARQVQELQKKEQILLQQNEALRAKLAELSCLQAPVSGLTTATTSQDVQESSSGRGSRQRETSLSAAETTLQLASHNEQTFLLRAVPHMRL

SEQ ID NO: 21722 - protein, 388 aa, Bos taurus
MGCLGNSKTEDQRNEEKAQREANKKIEKQLQKDKQVYRATHRLLLLGAGESGKSTIVKQMRILHVNGFNGDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQDDYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELLGGHHHHHH

SEQ ID NO: 21723 - protein, 269 aa, Picea mariana
SGVPPFWAETQQGIFDAVLRGYIDFDSEPWPSISESAKDLIRKMLTSNPAERLTAHGVLCHPWICKDGVAPDQALDPAVLSRLKQFSAMNKLKKMALMVIAESLSEEEIAGLREMFEAMDTDNSGSITFDELTAGLKRYGSNMKESEIRALMDAADVDNSGTIDYAEFIAATFHLNKLEREEHLFAAFSYFDKDASGYITVDELQQACLEHNLTDVRIDEIIREVDQNNDGRIDYNEFVAMMRKGNGAIGRRTMRNSLNFSRKDNLPIG

SEQ ID NO: 21724 - protein, 89 aa, Picea mariana
TLREDEPEKYQFQFSEYHKKGIEPENIEELYKKVHAAIRADPTIKYTEKHVPKVQKHYLTRKLTYEERKNKLIARLNALNAGADEEDDE

SEQ ID NO: 21725 - protein, 290 aa, Rana rugosa
AKDFLAGGVAAAISKTAVAPIERVKLLLQVQHASKQITADKQYKGIMDCVVRIPKEQGFVSFWRGNLANVIRYFPTQALNFAFKDKYKKIFLDNVDKRTQFWRYFAGNLASGGAAGATSLCFVYPLDFARTRLAADVGKAGADREFKGLGDCLAKIFKSDGLKGLYQGFNVSVQGIIIYRAAYFGIYDTAKGMLPDPKNTHIFISWMIAQTVTAVAGFASYPFDTVRRRMMMQSGRKGAEIMYSGTIDCWKKIARDEGSRAFFKGAWSNVLRGMGGAFVLVLYDELKKYI

SEQ ID NO: 21726 - protein, 290 aa, Rana rugosa
AKDFLAGGVAAAISKTAVAPIERVKLLLQVQHASKQITADKQYKGIMDCVVRIPKEQGFVSFWRGNLANVIRYFPTQALNFAFKDKYKKIFLDNVDKRTQFWRYFAGNLASGGAAGATSLCFVYPLDFARTRLAADVGKAGADREFKGLGDCLAKIFRSDGLKGLYQGFNVSVQGIIIYRAAYFGIYDTAKGMLPDPKNTHIFISWMIAQSVTAVAGFASYPFDTVRRRMMMQSGRKGAEIMYSGTIDCWKKIARDEGSRAFFKGAWSNVLRGMGGAFVLVLYDELKKYI

SEQ ID NO: 21727 - protein, 290 aa, Rana rugosa
AKDFLAGGVAAAISKTAVAPIERVKLLLQVQHASKQITADKQYKGIMDCVVRIPKEQGFVSFWRGNLANVIRYFPTQALNFAFKDKYKKIFLDNVDKRTQFWRYFAGNLASGGAAGATSLCFVYPLDFARTRLAADVGKAGADREFKGLGDCLAKIFRSDGLKGLYQGFNVSVQGIIIYRAAYFGIYDTAKGMLPDPKNTHIFISWMIAQTVTAVAGFASYPFDTVRRRMMMQSGRKGAEIMYSGTIDCWKKIARDEGSRAFFKGAWSNVLRGMGGAFVLVLYDELKKYI

SEQ ID NO: 21728 - protein, 248 aa, Anthurium andraeanum
MTAKAKRGAAVAAEARVAKKRVVKLNKGPWTAEEDQKLVEYVDAHGDRKWTSLPTKAGLNRCGKSCRLRWLNYLRPGIKRGNISEAEEDMIIRLHNLIGNRWSLIAGRLPGRTDNEIKNYWNTHLSKKPLTISDLNDKLNDDGGSRSDVDEPPSSGQSQGPLDSRRPAEPRISEASNEVAFNVDELVNLPAILDFDDLLDSGSCSDGIITSSQIFWTPNFSAHDQQDISDFDDLGMLMDIMDYVICPP

SEQ ID NO: 21729 - protein, 1430 aa, Mus musculus
MTVFRQENVDDYYDTGEELGSGQFAVVKKCREKSTGLQYAAKFIKKRRTKSSRRGVSREDIEREVSILKEIRHPNVITLHEVYENKTDVILILELVAGGELFDFLAEKESLTEEEATEFLKQILSGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYDFEEEFFRNTSTLAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSSYDVNQPNKHGTPPLLIAAGCGNIQMLQLLIKRGSRIDVQDKGGSNAIYWASRHGHVDTLKFLNENKCPLDVKDKSGETALHVAARYGHADVVQLLCSFGSNPDFQDKEEETPLHCAAWHGYYSVAKALCEVGCNVNIKNREGETPLLTASARGYHDIVECLAEHGADLNASDKDGHIALHLAVRRCQMEVIKTLLGHGSFVDFQDRHGNTPLHVACKDGSAPIVVALCEASCNLDISNKYGRTPLHLAANNGILDVVRYLCLMGANVEALTSDGKTAEDLAKAEQHEHVAGLLARLRKDTHRGLFIQQLRPTQNLQPRIKLKLFGHSGSGKSTLVESLKCGLLRSFFRRRRPRLSSTNSTRFPPSPLAAKPTVSVSINNLYPGCENVSVRSRSMMFEPGLTKGMLEVFVAPSHHLHCSTDDQSTKAIDIQNAYLNGVGDFSVWEFSGNPVYFCCYDYFAANDPTSIHIIVFSLEEPYEIQLNQVIFWLSFLKSLVPVEEPIAFGGKLKNPLRVVLVATHADIMNIPRPAGGEFGYDKDTSLLKEIRNRFGNDLHVSNKLFVLDAGASGSKDIKVLRNHLQEIRSQIVSGCSPMTHLCEKIISTLPSWRKLNGPNQLMSLQQFVYDVQDQLNPLASEDDLRRIAQQLHSTGEINIMQSETVQDVLLLDPRWLCTNVLGKLLSVETPRALHHYRGRYTMEDIQRLVPDSDVEELLQILDAMDICARDLSSGTMVDIPVLIKTDSLQRSWADEEDEVMVYGGVRIVPVEHLTPFPCGIFHKVQVNLCRWIHQQSAEGDADIRLWVSGCRIANRGAELLVLLVNHGQGIEVQVRGLETEKIKCCLLLDSVCSTIETVMATTLPGLLTVKHYLSPQQLREHHEPVMVYQPRDFFRAQTLKESSLTNTMGGYKESFSSITCFGCHDVYSQASLGMDIHASDLSLLTRRKLSRLLDPPDPMGKDWCLLAMNLGLPDMVAKHNVNNRASRDFLPSPVHALLQEWTSYPESTVGILISKLRELGRRDAADFLLKASSVFKINLDGNGQEAYASSCNSGTSYNSISSVVSR

SEQ ID NO: 21730 - protein, 506 aa, Homo sapiens
MTSKPHSDWIPYSVLDDEGRNLRQQKLDRQRALLEQKQKKKRQEPLMVQANADGRPRSRRARQSEEQAPLVESYLSSSGSTSYQVQEADSLASVQLGATRPTAPASAKRTKAAATAGGQGGAARKEKKGKHKGTSGPAALAEDKSEAQGPVQILTVGQSDHAQDAGETAAGGGERPSGQDLRATMQRKGISSSMSFDEDEEDEEENSSSSSQLNSNTRPSSATSRKSVREAASAPSPTAPEQPVDVEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVSIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 21731 - protein, 536 aa, Streptomyces avermitilis MA-4680
MTVPPSFLRPLSAAFAMLLLLVLAPALLVLRAAPPAQALDNGLARTPPMGWNDWNAFGCNVTEQLVKQTADYLVSSGLKGAGYQYVNIDDCWMTSARNSVGQLVPDPVKFPDGISGTAAYVHSKGLKLGIYESAGTATCQGYPGSLGHEQTDADSFASWGVDYLKYDNCNHQNVPDQQRYTAMRDALVNTGRPIVYSLCNWGLASVWTWGAGVGNSWRTTDDINVNFSTVVSIYKANVKLAPYAKPGAWNDPDMLEVGNGMSFTEDRSHFSLWSEMAAPLIAGTDLRKASAATLFLYGNKDVIAVDQDSLGKQGTEVSSSGGLHVLTKPLANGDVSVVLFNENSSAATITTSATAAGLPAASSYRLDNLWSHVVSSTGGSISASVPGHGSVMYRVSVGSGTSAGSTHPLVGASSNRCLDAYDNQTAPGTKIEIWDCGGANQAVTITAAGELRLYGGTQCLDAYDNGTTSGTKVQLYTCNGGANQKWSLNPNGTVTGTQSGLCLDVTGGDQASGNVNGTALELWTCNGGANQQWRLG

SEQ ID NO: 21732 - protein, 466 aa, Streptomyces avermitilis MA-4680
MSVSVPSSLPSALPPSVPALPPSDPQTLSRLLGDTDGLSVWPRSARPEADGDVCVGGVSLTEAADRFGTPVYVLDEQEVRERCRTYRTAFPEADVVYAAKAFLCRAMAHWVQEEGLGLDVCSAGELALAVTTGFPPEKIVMHGNAKSPEDLRTALRLGVGRIVVDSASEIARLAAITPCDTRQKVMVRVVPGIAAGGHTKIRTGTDDQNFGLSLTDGSAQHAITRILDQPHLELVGLHCHIGSQIAAVKPYVAAVRRMVGLMARVRDQHGVILPQLNIGGGHAIAYRPGDETMNVGVLAGRVRAELEDGCARARLPVPRLTIEPGRAVVGPAGVAVYRVLAVKRTGEHTFVAVDGGMSDNPRPALYGVRYAPRLIGRPSSAPSRFVTVVGRHCEAGDVLADGVALPGDVRPGDLLAVPAAGAYHLSMTSGYNLVGRPPVVAVSDGIARVLVRRESLDDMSRRDVGL

SEQ ID NO: 21733 - protein, 513 aa, Streptomyces avermitilis MA-4680
MHVHHGARRPGATRVTLLTEGTYPHSHGGVSVWCDQLVGGMPDIDFDVIAVTGTGREPIVWDIPGHVSRVAAVPMWGPAPEGRAPRGRRRNRLASAYEQFLTALLDPCAEDRFGTALYVMARAAADGMLSPFLRGDRAISILTAVWNRPGLAVREARPTLHDAITATALLEHALRPLATPLPRDGVAHAVSGGVAALPGLAALERHGVPLLVTEHGVYLRERYLGYRTAPYRWPVKAVVLGFFRLLAEETYLRAALITPGNRYNRLWEEQGGADPESIRTVYNGVDPAAFPPAGPEPDAPTLSWAGRVDPIKDLETLIRAFALVRSQLPEARLRLFGGTPRGGEAYRERCEALAAELGHAEAVTFEGRVDDIKDAYAAGNVVMLSSISEGFPFTLIEAMSCGRATVSTDVGGVREAVGDTGLVVPPRDPAAMAAAALKLLGDPERRRSMGEAARLRVIEQFTLRQTVDTFRSIYLELSAPGRTTRRDPWTPDADAGLSTTAGPAAARMGSLAG

SEQ ID NO: 21734 - protein, 264 aa, Streptomyces avermitilis MA-4680
MHIDLKGRTALVTGSTQGIGAAIAVGLARAGARVGVNGRSRERVESAVASLAVEAPGADLVAVTADVATEEGAAAVEDALPQVDILVNNLGIFGAKDPLEITDDEWRRYFEVNVLAAVRLTRMFLPGMAERGWGRVQYLASDSAVAVPAEMIHYGMSKTALLAVSRGFAKQAAGTGVTVNSVIAGPTHTGGVEDFVYELVDREVPWDEAQRTFMRERRPQSLLQRLIEPEEIANMVVYLSSEQASATTGGALRVDGGYVDSILP

SEQ ID NO: 21735 - protein, 608 aa, Streptomyces avermitilis MA-4680
MGSSSYAVIPGAAPRSGRRSIRAVLVLALTAGVATVVPAAQADTSTPAAAPVAAKPYMGWSSWSMQSSKYPGLNPDGDYSYLTEANVLKQTDALASKLKKYGYDHVNIDAGWWMDKNWKTQFDQYGRQTPDPVRFPHGMKSVADHIHSKGLKAGIYLPVGLEKGAYGDGKTPISKAPGCTTADIVYSDLRTTNGWDNAYKIDFDKSCAQKYIDSQAQMFADWGYDFLKLDGVGPGSFKSGDNYNNVADVAAWQKAIAATGRPIHLELSWSLDIGHAADWKKYSNGWRIDTDIECYCNTLVTWENSVNDRWDDAPAWSSKAGPGGWNDLDAIDVGNGEMDGLTKAERQSYMTLWAINKSPLFTGDDLTKLDSYGVSLLTNKEVIAVDQNTSPVARPVTPVGDQQVWGTKNADGSYTVALFNLGDSPASVTAHWASFGFTGNASVRDLWNKTNLGTHKNKITEALPAHGSRLFTIKPGGGTLATTGYEAEAAANTLSGNASVGGCDACSGGKKVGNLYTGGKLRINDITVKKDGIYTVKVAYVSGDPRSVTVLSNSGNGTSLKFPSTGDWSTAETVSVQLALKAGSNTITFDSGSGYAPDIDRIVVPQSV

SEQ ID NO: 21736 - protein, 1424 aa, Streptomyces avermitilis MA-4680
MNSKTAEAESRTPGDQELRQLLAGLTAVRDGDFGTRLPDDTDGLLGEIATVFNGMIDQLSVFTSEVTRVAREVGTEGTLGGQAEVPGVSGTWADLTDSVNAMAGNLTTQVRDIAQVATAVAKGDLSQKIDVPARGEILELKETVNTMVDQLSAFADEVTRVAREVGSEGRLGGQAQVPGVGGVWRDLTDSVNLMAGNLTAQVRNVAQVTTAVAKGDLSQKITVDARGEILELKNTINTMVDQLSAFADEVTRVAREVGTDGRLGGQADVKDVRGTWRDLTDSVNFMAGNLTAQVRSIAQVATAVAKGDLSQKITVDARGEILELKDTINTMVDQLSAFADEVTRVAREVGTAGNLGGQATVRGVSGTWKDLTDNVNVMASNLTGQVRSIAQVATAVARGDLSQKITVEAKGEVAALADVINTMVDTLSAFADEVTRVAREVGTEGRLGGQAHVPNVAGTWKDLTDNVNSMANNLTGQVRNIALVTTAVANGDLSKKIDVDARGEILELKTTINTMVDQLSSFAAEVTRVAREVGSEGRLGGQAEVEGVSGTWKRLTENVNELAGNLTRQVRAIAEVASAVAEGDLTRSITVDASGEVAELKDNINSMVGSLRETTRANQEQDWLKSNLARISGLMQGHRDLAVVAELIMEELTPLVSAQYGAFYLAEETGRGTQLRLIGSYGYPDDTQRPDRIPLGRSLVGQAARNRRPITVDDLPPAYVTISSGLGQISPTALKVLPIVVDEQVLGVIELASVTRFTQIHEDFLGQLMETIGVNVNTIVANGRTDELLGESQRLTAELQSRSEELQVQQDELQRSNAELEEKATLLATQNRDIEAKNLQIEQARQELEARAQQLSLASKYKSEFLANMSHELRTPLNSLLILAQLLAQNPSHNLTPKQVEYAGIIHSAGSDLLQLINDILDLSKVEAGKMDISPERVALRRLLDYVEATFRPMTSQKSLEFTMSTAPGVPVDLLTDDSRLRQVLRNLLSNAVKFTERGGVGLHIEPAVDQNIPAAVHRGGAVVAFHVKDTGIGIPEQQLETIFGAFQQADGTTSRKYGGTGLGLSITREIAHLLGGAVTVDSTPGQGSTFTLYLPVARADFEELAQGAQPGEASQGDGAADHPRGSQALTGAGGPTHRRRRILVVEERPRGLLTLVAESTVANLTRGHHGGDPREVIDVTTTVDAQEAAGALAAEPCHCVVLELGMSGGEASRFLDALDGDPALASVPVLVHNGQRADVTLDPALRSRSAARSLEIFSSLDELRERIALHLSAEEPGDVLPLVRPEKPQPEQTLVVDGTFTGRTVLVVDDDARNLFALSGILELHGFKVLHAENGRKGVDTLLAHPEICLVLMDVMMPEMDGYAATTEIRSMSQYTDLPVVAVTAKAMPGDREKALQSGASDYVTKPVDANDLIACVRRWLSA

SEQ ID NO: 21737 - protein, 290 aa, Streptomyces avermitilis MA-4680
MSRANTRRRKGETTVRIHHLNCGSMRTIDTDAGSLPAVCHCLLVETDRDGLVLVESGIGTADVARPEQNLGADFLGRAQPVLDLAETALHQVTGLGFRPEGVRHIVLSHLDLDHAGGLSDFPWAKVHLTEAEHRAAMAAPGAHPEDRVRYRPAQWAHRPHWVTYPEAQGDPWFGFDAVRPLDGLDAEILLVPLGGHTRGHSAIAVRDTGRWLLHCGDAYYFHREIDPDDPRGHPGMDILQQITEVDRPLRLGNHARLRELVRRHGDEVEVFSAHDPWELARHVPLGSARP

SEQ ID NO: 21738 - protein, 251 aa, Streptomyces avermitilis MA-4680
MTETFVPPTRFAVPGRIAVSNRAAAVWQTATLTEIRRETPHAATFRFAVPGWQGHLPGQHLMLRLTAEDGYGAQRHYSIASPPEDAGHIELTLDHVEGGEVSGWFHTVAEPGDEVQVRGPLSGFFAWPGDRPALLIGAGSGVVPLMSMVRHHRAQGSTVPLRLLVSARSPQELIYAREYGDETTPVFTRDAAAGVPVGRMSAAHVAPLLDRAPPGGWEAYVCGSNGFAEHASRLLVEAGQPVHRIRIERFG

SEQ ID NO: 21739 - protein, 260 aa, Streptomyces avermitilis MA-4680
MAGLDLTGRTAVVTGASRGIGLAIAQAIAAAGGNVVLTSRSQEAADAAAARVGGTAVGVGAHAVDEEAARRCVDLTLERFGSLDILVNNAGTNPAFGPVIDQDHGRFAKTFDVNLWAPVLWTGLATRAWMGEHGGAIVNTASVGGMAFEANIGLYNASKAALIHLTKQLALELSPKVRVNAVAPGVVRTKLAESLWKEHEQAVSAATALGRIGEPADIASAVAFLVSDAASWITGETMVIDGGQLLGDALPFREGAGIGL

SEQ ID NO: 21740 - protein, 266 aa, Streptomyces avermitilis MA-4680
MNAPLVLPGPHATSLDLGGRTALVTGAAGGIGRACALRLAAAGAKVRAVDRDPEGLDTLAEAARGLAGTVEPQVLDLTDLDAAELSAAGTDVLVNNAGLQLVRPIEEFPPEAFHTVLTVMLEAPFRLIRGALPHMYGQGWGRIVNVSSVHGLRASAFKSAYVAAKHGLEGLSKTAALEGAPHGVTSNCVNPAYVRTPLVEKQLVDQAAAHGIPEERVLSEVLLRDSAVKRLIEPAEVAEAVAYLCSPQASFITGTSLALDGGWTAH

SEQ ID NO: 21741 - protein, 407 aa, Streptomyces avermitilis MA-4680
MVRGRPSESRRSIALVHWAFPPTVGGVESHLADYAGRLTRRGYQVTLLTGEARPQPVDRVEILTHPLLRLAEYHHAALGENSRTGRWLTPVEQRRAAELHEWLARVVDARDIRIVHGHNLHHFSPVPALALNRLREQSGTTLLHTYHSVWPEDPWTAQFCRSWDGHYVVSDYLAFACRTHLGIRARRTYLGIATDRFRSLPPPRSDGPHTVLLPARLIPNKGAELAVRMLDTLRRTGLSVRLVLTSPQEVVDWHEEQQGFLDRLNRLIDGLGLRPHVDLVPTPKELMPRLYARAHVVVYPSDYPEPLGLAPLEAMSAGRPVVVTATGGLPEAVLHDRTGYVVTPGDLEQLSDRVRRLLLDPALSKRLGREGRRHVERQFNLDTYVDKMCANYSALLDERVEGLPRIG

SEQ ID NO: 21742 - protein, 682 aa, Streptomyces avermitilis MA-4680
MRHPYARTTRTTRTTRTTRRRVVGALTAGLLCTAGLAAPALAAPAAGPVSPRPADSLALTPPMGFNNWNSTGCRPEFNEDMVKGTADIFVEKGLKDAGYQYVNLDDCWALPARDSNGKLVPDPARFPGGIKAVADYVHSKGLKLGIYTSAGTKTCNEAGFPGALGHEYSDAQQFADWGVDYLKYDNCNNQGVDAKLRYTTMRDALKATGRPIVYSLCEWGENKPWEWASDVGQLWRTTGDISDSWGSMLSILKQNLPLAPYAGPGHWNDPDMLEVGNSGMTDTEYRTHFSMWSIMAAPLLIGSDLRKASAATFDILDNKEVIAVDQDPLGKQGTVLSSEGGRWAVTKEMKDGSRAVALFNETDSAQRITTTAQAVGLPKAHAYTLRDLWQHRSYNTAGTISATVPAHGTVLVRVSADAAWAKNPPAVELGVDGSPLLEAGRTVALTSALTDLGRTPAKRVSVTLSGPRGWRVRATSPTTAGTVPTGRSLRTKWKVTAPDGTAAGSYDLTLKATYRSPTGVRAETLVPLAASVVPAPPSGVSYLGDLPWMSTTNGWGPVERNTSNGESAAGDGRPITVDGVVHAKGIGVHAESTIAYYTGRSCETVTADVGVDDEQDTNGSVTFEIWADGTRVASTGVLTTAMPARPLSADVTGAQVVRLVVTDGGNGITSDHADWADAKLSC

SEQ ID NO: 21743 - protein, 237 aa, Streptomyces avermitilis MA-4680
MSSQGQKVAVITGASQGIGAALVDAYRKLGYAVVATSRTIAPVNDAGVLTVQGDIAYPATAERVISTGVERFGRIDTLVNNAGVFVAKPFTDYTQDDYATVTGVNLAGFFRITQLALEHMLSQGGGHIVNVTTSLVDNADSNVPSVLASLTKGGLQSATKSLAIEYATRGIRSNAVSPGVIKTPMHSEETHEALAALHPVGRMGEQSDIVDAVIFLENAPFVTGEILHVDGGQSAGH

SEQ ID NO: 21744 - protein, 231 aa, Streptomyces avermitilis MA-4680
MSTLGTTSVVFDLDGTLVDSEPNYYEAGRHLLAEQGVTDFTWADHEQYVGISTQESLELWKERYGVEAPLDDLLADMNRRYLALARASTPVYPEMRKFVELLAGEGVPMAVASGSSPEAIEAILTGTGLASWLTTVVSADEVARGKPAPDVFLEAARRLGVSPADCVVLEDAAPGAAAAHAARMRCIAIPYVAAQADDPAFATAGLLVRGGQTEFTARAAYEWLARSTPSS

SEQ ID NO: 21745 - protein, 488 aa, Streptomyces avermitilis MA-4680
MPDLFIDGEWVRGATGTTREVVNPFDATVVRSVDEGDATDVDRAVTAARRAFHAADWAAAPTQRRADVLFRVAEYLLRDIEEIARDETLNTGKTLAEARIDVKDVSNAFRYFAEMAGKDAGRVVDAGPDVLSRVVHEPVGVCALIAPWNYPLLQASWKVAPALAAGNTFVLKPSEITPLTTIAMMRLIEEAGAPPGVANLVLGAGATVGSAMTVHPEVDLVSFTGGLGTGRRIMESAAREVKNIALELGGKNPNVVFDDADFEAAVDHTLDASFLHSGQVCSAGSRLLVQDSWHDRFVRELADRASRIRLGNGLDPHTESGPLSSAEHRAKVEKYIDLGRSEGARLVTGGRRPDDPDLAHGFFLLPTIFDDCDRSMRIVQEEVFGPVVTVETFRTEDEAVELANDTRYGLAAGVWTGEASRAQRVAARLRHGTVWINDFHPYLPQAEWGGYGQSGVGRELGPTGLREYQEIKHIYQNLSPGPSGWFKG

SEQ ID NO: 21746 - protein, 632 aa, Streptomyces avermitilis MA-4680
MTMLENIRGPRDLKALSEAELGELAEEIREFLVHAVARTGGHLGPNLGVVELSVALHRAFESPVDRILWDTGHQSYVHKLLTGRQDFSKLRSKGGLSGYPSREESEHDVIENSHASTVLGWADGLAKARQVQGEKGHVVAVIGDGALTGGMAWEALNNIAAAKDRPLIIVVNDNERSYSPTIGGLANHLATLRTTDSYEKVLAWGKDVLLRTPVVGNTLYESLHGAKKGFKDAFAPQGMFEDLGLKYVGPIDGHDMKAMESAFRRAKRFHGPVLIHCLTEKGRGYEPALAHDEDRFHTVGVMDPLTCEPLAPSNGPSWTSVFGDEIVRIGEEREDVVAITAAMLHPVGLNKFAEKFPGRVWDVGIAEQHAAVSAAGLATGGLHPVVAVYATFLNRAFDQLLMDVALHRCGVTFVLDRAGVTGVDGASHNGMWDMSILQVVPGLRIAAPRDADQLRAQLREAVAVDDAPTLLRFPKESVGPAIPAVDHVGGMDVLHRFPESPQVLLVAVGVMAPVCLQAAELLEARGIGCTVVDPRWVKPVDPSLPGLAAEHRLVAVVEDNSRAAGVGAAVALALSDAEVDVPVRRFGIPEQFLAHAKRAEVLADIGLTPVEIAGRISAGLATKEELSKEKQE

SEQ ID NO: 21747 - protein, 278 aa, Streptomyces avermitilis MA-4680
MSTKVPPITLNNGVEMPQLGFGVWQVPDDEAERAVATALEAGYRSIDTAAIYGNEEGTGKAIATAGIPRADLFVTTKLWNSDQGYDSTLRAFDVSLEKLGLDYIDLYLIHWPLPTRGQFVETYKAFEKIYADGRAKAIGVSNFLPEHLRTLIDATSVIPAVNQIELHPHLQQHAAREFHAEHGIATEAWSPLGSGKGLLEVPAIVAIARKHERTPAQVVLRWHIQLGNIVIPKSVTPSRIKENIEVFDFSLDDEDIAAISALNEDRRLGPDPATFDMG

SEQ ID NO: 21748 - protein, 616 aa, Streptomyces avermitilis MA-4680
MNTRQLTELGQQLRVDSVRAADAASSGHPTSSMSAADLMAVLLAHHLRYDFDRPAHPGNDRFILSKGHASPLLYAAYKAAGAIDDAELLTFRELGSRLEGHPTPRRLPWVETATGSLGQGLPVGVGIALSGKRLERTGYRVWVLCGDSELAEGSVWEAAEHAGYEHLDNLTAIVDVNRLGQRGPTRHGHDLDAYARRFQAFGWHTIEIDGHDVDAVDRAYGEAESTSGQPTVILARTLKGKGVAAVEDREGLHGKPLPDAEEAIAELGGVRELRIEVQDPPAARVLHAVAAPGQVELPRYDKGDEVATRDAYGQALTALGGAREDVVAIDGEVGDSTRSEYFAKEYPDRYFECYIAEQQMVAAAVGLAARGWVPYAATFAAFLTRAHDFVRMASISGAGINLVGSHAGVSIGQDGPSQMGLEDLAMFRSVYDSTVLYPCDANQTAKLVAAMAGLDGVRYLRTSRGASPVLYGPDEEFPVGGSKVLRSSGEDRLTLVAAGVTVHEALAAADSLAEAGIRARVIDLYSVKPVDRDTLRQAAEDTGCLLTVEDHREEGGIGDAVLDAFLDGRPVPRLVRLAVRTMPGSASPAEQLHAAGIDAESIATAARLLVEQAVVR

SEQ ID NO: 21749 - protein, 301 aa, Streptomyces avermitilis MA-4680
MSSIAVPGALAPRRAWLTDLPVLLVAVVWGASYLAAKDITTARTVIAVLVLRFGVVLPVLVIAGRRSLRALSAAQWRGAALLGLILSGIFLLETYGVVHTSATNAGLIISLTMIFTPLAEAAVTRARPPRAFLAAAGVSVLGVVLLTQGGGFTRPSLGDLLMLLAALARTVHVLAMSRVKSVQGADALPLTTVQLGAAVAVFAVLSTGTDATVWGTAAGFGAREWGGLLFLAAFCTLFAFCVQMWAVRRTSPSRVSLLLGTEPLWAAAAGITLGGERLGALGLMGGVLVLAGTAWGRRAAG

SEQ ID NO: 21750 - protein, 313 aa, Streptomyces avermitilis MA-4680
MTRSTTLAEALAAAPVVLDGGLSNQLESAGHDLSDELWSARLLAERPEAITEAHLAYFEAGADVAITSSYQATFEGFAKRGIPEERAAELLGLSVGLAREAAVRARADGVTRPLWVAASVGPYGAMLADGSEYRGRYGLTVAELEAFHRPRLEVLAAAGPDVLALETVPDADEAEALLRAVRGLGVPAWLSYSVSGDRTRAGQSLEEAFAPAAEADEVIAVGVNCCAPEDVDGAVETAARVTGKPVVVYPNSGETWDAGARAWSGRSTFTAEQVTGWRRAGARLIGGCCRVGPAAITSIAGTLGEQGRARPTE

SEQ ID NO: 21751 - protein, 658 aa, Streptomyces avermitilis MA-4680
MFPPPRSTGRSFGRRLRIAAVRALVLALTAAATLLFVQPAPAQAAVTTRQITVPSAPMGWASWNSFAAKIDYSVIKKQVDAFVAAGLPAAGYTYINIDEGWWQGTRDSAGNITVDTAEWPGGMSAITAYIHSKGLKAGIYTDAGKDGCGYYYPTGRPAAPGSGSEGHYDQDMLQFSTWGFDFVKVDWCGGDAEGLDAATTYKSISDAVGRAAATTGRPLTLSICNWGYQNPWNWAAGQAPLWRTSTDIIYYGNQPSMTSLLSNFDQTLHPTAQHTGYYNDPDMLMVGMDGFTAAQNRTHMNLWAISGAPLLAGNDLTTMTSETAGILKNPEVIAVDQDSRGLQGVKVAEDTTGLQAYGKVLSGTGNRAVVLLNRTSAAHDITVRWSDLGLTNASATVRDLWARQNVGTSATGYTASVPAGGSVMLTVTGGTEAAGGAYAATSTGRYTGVTAASTGLNVVDVAYTNNTSSARTATLQVNGQTATTVSFPPTGASAGTVSVEVSLSKGSANTLALSGGPATEGITVRPLPGTNGALVTGKQSGRCADIYNNTITNGTQAELWDCNGGPNQSWTYTSRKELVLYGNKCLDAYNLGTTNGTKVVIWDCNGQANQKWNINSDGTITNVNAGLCLDAYNAATANGTSLVLWSCGTGDNQKWTVT

SEQ ID NO: 21752 - protein, 642 aa, Streptomyces avermitilis MA-4680
MPLLTRIRGPRDLDRLSLEQLDQLAEEIRTFLVDAVSKTGGHLGPNLGVVELTIALHRVFDSPKDRVLFDTGHQSYVHKLLTGRQDFSKLKMKGGLSGYPSQAESEHDVIENSHASTVLGWADGLAKANQVLERDDHVVAVIGDGALTGGMAWEALNNIAAAKDRPLVIVVNDNERSYAPTIGGLANHLATLRTTDGYERFLARGKDLLERTPVVGRPLYETLHGAKKGLKDFIAPQGMFEDLGLKYVGPIDGHDIEALESALARAKRFGGPVIVHCLTEKGRGYQPALQDEADRFHAVGKIHPDTGLPIASSGADWTSVFGEEMVKLGQERKDIVAITAAMLQPVGLDKFAKVFPKRVYDVGIAEQHAAVSAAGLATGGLHPVFAVYATFLNRAFDQVLMDVALHKCGVTFVLDRAGVTGTDGASHNGMWDMSILQVVPGLRLAAPRDADQVRAQLREAVDVDDAPTVVRFSKGAVGPAVPAVGRIGGMDVLREPGTDAPDVLLVSVGALAPMCLEIAGLLDKQGISATVVDPRWVKPVDEAMAPLAERHRVVVTVEDNSRVGGVGSAIAQALRDAGVDVPLRDFGIPPRFLDHASRGEVMAEIGLTAPDIARQVTGLVSKLDGRFERPTAEIDSVEPARD

SEQ ID NO: 21753 - protein, 273 aa, Streptomyces avermitilis MA-4680
MAEKRVVIVTGGGTGIGEATARLLREGGHHVVISGRRAEPLRRLERETGALACPSDVGDPDAADGLVRTALAAYGRLDGLVLNAGIGRGGAVGDVSLEDWHDVMRTNVTGPLLLLRAAIPHLLDTKGAVVAVASVSALRNGASNVPYATSKAALLQLCRSVAVDYGRQGVRANIVCPSWVRSEMADRRMARFAEEADLKDGSVESAYEEATRFLPLGRPGEPREIAEAISWLLSPAASYVNGSVLTLDGGATALDPGTLAFDFHVAPRGDAEL

SEQ ID NO: 21754 - protein, 275 aa, Streptomyces avermitilis MA-4680
MKRREKCRRLTRRNNRRRRSREGTQTVASLEGKTALVTGGRTGLGFGIATALVERGANVVITSRTEDELRKAAAALGEERALGVAGDARDPEHQRIAVETAVDRFGSLDLLVNNVGGTERTARRLVDVDLASYRRTVEINLMSALTWVQTAWHGWLGEHGGAIVNISSIAGELAVPDGTAYGTAKAALNHFTRQMANELAPAVRVNGVASGTVLTDFTRANVEGREDKVIGSIPLRRLGEPADVGAAVAFLLSDEASWITGHTLVVDGGRLLHNR

SEQ ID NO: 21755 - protein, 246 aa, Streptomyces avermitilis MA-4680
MATPGTDGRVALVTGASGALGAAVARVLDHRGYRLALHYTNGEDQARKVAAKLSGPSTLVRADVADWAATRDMVDRVRAELGGISVLVNTGAIRRDGLMATQSVDDWTRTVAVNLIGTFHTCRAALPDMLRGRWGRIINVVSPAGLLGSRGQTAYSASKAGVLGMTRSLALECGRFNVTVNALSPGLMATALTEEVPAEVRATLVARTAFGRMGTPDEVARGIELLLDADYMTGQVLSIDGGMSIS

SEQ ID NO: 21756 - protein, 512 aa, Streptomyces avermitilis MA-4680
MSASTSRTLPPEIAESVSVMALIERGKAEGQIAGDDVRRAFEADQIPATQWKNVLRSLNQILEEEGVTLMVSAAEPKRTRKSVAAKSPAKRTATKTVAAKTVTAKKATATAAPAVPVGDDPAEDASAKKAAAKKTTAKKAVAKKTVAKKTAAKKTTGKKDDVELLDDEAVEETAAPGKAGEEPEGTENAGFVLSDEDEDDAPAQQVAAAGATADPVKDYLKQIGKVPLLNAEQEVELAKRIEAGLFAEDKLANADKLAPKLKRELEIIAEDGRRAKNHLLEANLRLVVSLAKRYTGRGMLFLDLIQEGNLGLIRAVEKFDYTKGYKFSTYATWWIRQAITRAMADQARTIRIPVHMVEVINKLARVQRQMLQDLGREPTPEELAKELDMTPEKVIEVQKYGREPISLHTPLGEDGDSEFGDLIEDSEAVVPADAVSFTLLQEQLHSVLDTLSEREAGVVSMRFGLTDGQPKTLDEIGKVYGVTRERIRQIESKTMSKLRHPSRSQVLRDYLD

SEQ ID NO: 21757 - protein, 1829 aa, Streptomyces avermitilis MA-4680
MESGAATRGTKTRAKGGQSLSNQRKPRTGTTAVDTAALNRLLAALVSMRDGNFRKRLTVSGDGVMSEIAAVFNEVAERNLHLTGELARVRRMVGREGKLTERLESGACEGSWAAAIDNSNALVDDLARPVSEVSRVLSAVAEGDLSPRMELRAQAADGNGHPLRGEFLKVGRTVNNLVDQLSSFTDEVTRVASEVGTEGKLGGQARVRGMSGSWKDLTDSVNTMAYRLTAQVRDIALVTTAVAKGDLSRKVTVHVAGEMLELKNTVNTMVDQLSSFSSEVTRVAREVGTEGELGGQAQVPGVAGVWKDLTDSVNLMAGNLTAQVRGIAQVTTAVANGDLSQKVTVSARGEVAQLAETINQMTETLRTFADEVTRVANEVGGEGRLGGQANVPGAAGTWKDLTDSVNTVFRNLTTQVRDIAAVTTAVANGDLSQKVTVDVAGEMLELKNTVNTMVDQLSSFGAEVTRVAREVGVEGELGGQAQVPGAAGTWKDLTDSVNTAFRNLTGQVRNIAQVTTAVANGDLSQKVTVDVSGEMLQLKNTVNTMVDQLSSFADQVTRMARDVGTEGRLGGQARVDGVSGTWKELTDSVNFMAGNLTSQVRQIAQVTTAVARGDLSQKIDVDARGEILELKNTINTMVDQLSAFADQVTRVAREVGTEGRLGGQAQVPGVAGVWRDLTDSVNGMAGNLTAQVRNIAQVATAVARGDLSQKIDVDARGEILELKNTLNTMVDQLSNFAEQVTRVAREVGTEGMLGGQAEVQGVSGTWKDLTQSVNFMANNLTIQVRNIAEVTTAVAKGDLSKKITVDAKGEILELVTTVNTMVDQLSSFAEQVTRVAREVGTEGILGGQAHVPGVTGIWKDLSNNVNLMANNLTMQVRNISQVAAAVANGDLTRTVTIEARGEVAQLADTFNTMVKTLSSFADQVTKVAREVGTDGILGGQAHVPGVAGTWKDLTESVNGMASNLTGQVRNIAMVTTAIAKGDLTKKIDIDARGEILELKTTINTMVDQLSSFAEEVTRVAREVGTEGQLGGQARVRDVDGTWRDLTESVNEMAGNLTRQVRAIARVATAVTRGDLNLKIDVDASGEIQELQDYINKMIANLRDTTIANKEQDWLKGNLARISALMQGRRDLDDVASLIMSELTPVVSAQHGAFFLAMPLVDAREGGAEQEDAYELRMCGSYGYSMGSMPTSFRPGEALIGTAAQEKRTILVENAPSGYLKISSGLGEAPPAQVIVLPVLFEGNVLGVIELASFTPFTQIQKDFLNQIAEMIATSVNTISVNTKTEVLLKQSQELTEQLRERSAELENRQKALQASNAELEEKAELLAQQNRDIEVKNTEIEEARQVLEERAEQLAVSMRYKSEFLANMSHELRTPLNSLLILAKLLADNADSNLTPKQVEFAETIHGAGSDLLQLINDILDLSKVEAGKMDVSPTRIALVQLVDYVEATFRPLTAEKGLDFSVRVSPELPATLHTDEQRLLQVLRNLLSNAVKFTDSGAVELVIRPAGADVPVAIREQLLEAGSLRDADAGLIAFSVTDTGIGIAASKMRVIFEAFKQADGTTSRKYGGTGLGLSISREIARLLGGEIHAASEPGRGSTFTLYLPLHPSELPPQGYAQMAPTMEVGELLASEPELSAPDIETPAEVKSYRDTQNGPAALFRRRRRAVTAAEERTALPGRPAQGQEQWVGAGQQEPAPQPRRGIRFDGEKVLIVDDDIRNVFALTSVLEQHGLSVLYAENGREGIEVLEQHDDVTVVLMDIMMPEMDGYATTTAIRRMPQFAGLPIIALTAKAMKGDREKAIESGASDYVTKPVDPDHLLTVMEQWMRAE

SEQ ID NO: 21758 - protein, 394 aa, Streptomyces avermitilis MA-4680
MILGSTGSIGTQAIDLVLRNPDRFRVTGLSAAGGRVGLLAEQAHRLRVSTVAVAREDVVPVLREALTAQYGPGEPLPEILAGADAATQLAASDCHTVLNGITGSIGLAPTLAALEAGRTLALANKESLIVGGPLVKALAKPGQIIPVDSEHAALFQALAAGTRADVRKLVVTASGGPFRGRTKAELANVSPEHALAHPTWAMGPVITINSATLVNKGLEVIEAHLLYDIPFERIEVVVHPQSYVHSMVEFTDGSTLAQATPPDMRGPIAIGLGWPERVPDAAPAFDWTKASSWEFFPLDNDAFPSVGLARHVGQLAGTAPAVFNAANEECVDAFLNGTLPFNGIMETVTRVVEEHGTPRTGTSLTVADVLEAETWARARARELTVQTATAEARA

SEQ ID NO: 21759 - protein, 280 aa, Streptomyces avermitilis MA-4680
MPQHTSGSDRAAIPPAARDGGSVRPPAPSTLDELWRSYKATGDERLREQLILHYSPLVKYVAGRVSVGLPPNVEQADFVSSGVFGLIDAIEKFDIGREIKFETYAITRIRGAMIDELRALDWIPRSVRQKARNVERAYATLEARLRRTPTEGEVATEMGIAVDELHSVFSQLSLANVVALEELLHVGGEGGDRLSLMDTLEDTAADNPVEVAEDRELRRFLARAINTLPDREKTVVTLYYYEGLTLAEIGNVLGVTESRVSQIHTKSVLQLRAKLASFGR

SEQ ID NO: 21760 - protein, 112 aa, Streptomyces avermitilis MA-4680
MKLITAVVKPHRLDEIKEALQAFGVHGLTVTEASGYGRQRGHTEVYRGAEYTVDLVPKIRIEVLAEDDDAEQLIDVVVKAARTGKIGDGKVWSIPVDTAVRVRTGERGPDAL

SEQ ID NO: 21761 - protein, 470 aa, Streptomyces avermitilis MA-4680
MTSTAQAPGAREAHPEHLGHVIFIAAAAAMGGFLFGYDSAVINGAVEAIRSKYDIGSATLAQVIAIALIGCAVGAATAGRIADRIGRIRCMQIAAVLFTASAIGSALPFALWDLAFWRVIGGFAIGMASVIGPAYIAEVAPAAYRGRLGSFQQAAIVIGIAISQLVNWAILNAAGGDQRGKLLGLEAWQVMLGVMVVPAVLYGLLSFAIPESPRYLIEAGKDARAREVLEEVEGKEIDLDARVEEIRLAMYREEKPSFKDLLGGTFFFKPIVWVGIGLSVFQQFVGINVAFYYSATLWQSVGVDPTDSFLYSFTTSIINIIGTVIAMIFVDRVGRKPLAIIGSVGMVIGLALEAWAFSYDLVDGKLPATQGWVALIAAHVFVLFFALSWGVVVWVFLGEMFPNRIRAAALGVAASAQWIANWAITASFPSLADWSLSGTYIIYTVFAALSIPFVLKFVKETKGKALEEMG

SEQ ID NO: 21762 - protein, 463 aa, Streptomyces avermitilis MA-4680
MSRSAHPAGPRHADVLPEGHYSAPAADLNALDPKVWSHTVSRGDDGVVRVGGIDVKQLAEEFGTPGYFLDEADFRERARAWRTAFGHDADVFYAGKAFLSRAVVRWLHEEGLNLDVCSGGELATALSAGMPADRIAFHGNNKSEEEIRTAVEAGVGRIVLDSFQEIVRVAHIAQSLGKRQRAQIRVTVGVEAHTHEFIATAHEDQKFGIGLADGQAAEAVRRALALDGLELVGIHSHIGSQIFDMAGFEVAARRVVKLLAEVRDEHGVELPEIDLGGGLGIAYTSEDDPREPHEIAKALSEIVTRECEAAKLRTPRISVEPGRAIVGPTAFTLYEVGTIKPLDGLRTYVSVDGGMSDNIRTALYDAEYSVALVSRASDAEPMLVRVVGKHCESGDIVVKDAFLPADLAPGDLIAVPATGAYCRSMASNYNHALRPPVVAVHDGEARVIVRRETEEDILRLDVG

SEQ ID NO: 21763 - protein, 533 aa, Streptomyces avermitilis MA-4680
MDVLPLLLLVAGSAAVAGAARRTPVPAPLLLVAAGLIASYIPGVPEYTLDPEVVLPLVLPPLLYTAASDSSYLDLRAQLRPVALLSIGYVLFATLVVGWAAYLLVPGLPLPAALVLGAVVAPPDAVAATAVARRVGLPSRITTILQGESLVNDATAITAYKVALAAAVGEGATWAHGVGEFLLAAVGGVAVGLLLMVPLHWLRTHLKEALLQNTLSLLIPFVAYGLAEWAHASGVLAVVVVALYLGHRNYEVDFATRLQEEAVWKMVAFVLESAVFALIGLQLQVVLKGLGEYRGVDAAWYAVAVFLVVVLARFVWVYPATFLPRLLSARIREREENPTWKAPFIIGWAGMRGVVSLAIAFSIPLTVHGQGKGPFPGRNLILFLTFTTVIGTLVVQGLTLPPLIRLLRLPGRDAQAETLAEANAQAQASRVAELRLNDLLDDERNALPPPLADRLRDVLERRRNAVWERLGAVNPVTGESVDDTYRRLSREMIAAERSVFVRLRNGRYIDDEMLRTLLRRLDLEEAAAFREAT

SEQ ID NO: 21764 - protein, 377 aa, Streptomyces avermitilis MA-4680
MATEDAVREALATVNDPEIQRPITELGMVKSVEIGADGAVAVTVYLTVSGCPMRETITTNVTKAVSAVEGVTRVDVTLDVMSDEQRRELATALRGGQAEREVPFAKPGSLTRVYAVASGKGGVGKSSVTVNLAAAMAADGLKVGVVDADIYGHSVPRMLGADGRPTQVENMIMPPSANGVKVISIGMFTPGNAPVVWRGPMLHRALQQFLADVYWGDLDVLLLDLPPGTGDIAISVAQLVPNAEILVVTTPQQAAAEVAERAGSIAVQTHQKIVGVVENMAGLPCPHCDEMVDVFGTGGGQSVADGLTRTTGATVPVLGSIPIDVRLREGGDEGKPVVLTDPDSPAGSALRAIAGKLGGRQRGLSGMSLGITPRNKF

SEQ ID NO: 21765 - protein, 276 aa, Streptomyces avermitilis MA-4680
MTPRLSGKTAVITGAARGLGRATAVAFAREGADLMLLDLAADLPGVPYPLGSESQLAHTAELCREQGVAASTARLDVRDLDAVEAAMATTRERFGRIDVLVNNAGIAAPSGKAAHEIDEREWQLMIDVDLSGAWRTIRAVGGHMAEQRSGSIINIASTAGLVGYRHFAGYVAAKHGLVGLTKAVALDYAPLKVRVNALCPGSVRDDSQVEGRMLSEIARCLDVPVAEHEETFVQAQPMNSLIEPEDIASAAVWLASDESRQVTGSVLAVDGGFTAR

SEQ ID NO: 21766 - protein, 344 aa, Streptomyces avermitilis MA-4680
MTENHQLPSELEVPSEAPDRNLALELVRVTEAAAMAAGRWVGRGDKNGADGAAVRAMRTLVSTVSMNGVVVIGEGEKDEAPMLFNGERVGDGTGPECDIAVDPIDGTTLTAKGMTNAIAVLAAADRGTMFDPSAVFYMDKLVTGPEAADFVDINAPVSVNIRRVAKAKRSMPEDVTVVILDRPRHDGIIKEIRETGARIKLISDGDVAGSILALREGTGIDLLLGIGGTPEGIISACAVKCLGGTIQGKLWPKDDEERQRAVDAGHDLDRVLFTDDLVSGENVFFVATGITDGELLRGVRYRAETATTESIVMRSKSGTVRQIRSEHRLSKLRAYSQIDFDRAK

SEQ ID NO: 21767 - protein, 509 aa, Streptomyces avermitilis MA-4680
MAGQQARQAGQTQRTIHVGGEWREADSRATREILDPADAKPFAVVAEGDERDADAAVAAARRAFDSGEWPHTPVAERAALLRRVADLLVRDRESLGLLESRDAGKTLEEGRVDIDCVADAFRYFADLVVGEGGGRVVDAGSPDIHSVVVHEPVGVCAMITPWNYPLLQASWKIAPALAAGNTFVIKPSEITPLTTAALVDLLVEAGAPAGVANIVTGPGHTVGARLAEHPDVDLISFTGGLASGTKVAQAAAVSVKKVALELGGKNPNVVFADACATDEDFDTAVDQALNAAFIHSGQVCSAGGRLIVEESVRERFVAELVRRAGRIRLGRGTEDGVECGPLVSEQQRDKVEGYVASALSEGAVLRTGGRRPEPSDVRPAAGYFFEPTVLDQCHRGMKVVREEVFGPVLTVETFRTEDEAVALANDTEYGLAGAVWTSDAGRARRVAGRLRHGTVWINDFHPYLPQAEWGGFGKSGVGRELGPAGLAEYRETKHVYQNLAPKPVRWFAG

SEQ ID NO: 21768 - protein, 498 aa, Streptomyces avermitilis MA-4680
MASSLTKDSVTPGTPGSEKTFFGHPRGLATLFMTEMWERFSYYGMRALLPLYLVAPGGLHLSAATATAIYSVYVSLVYLLALPGGWFADRVLGPRKTVAVAGLIIMLGHLTLALPTSGTFFAGLGLVAIGSGLLKANISTMVGHLYDGPDDPRRDGGFTLFYIGINLGAFAAPLIIGTVGENVNWHLGFALAALGMALGLAQYLLGSRHLSARSSDVPTPLSAEEKAATLRKSAMWAAVAVVFYAIVGFSGHYTLNWLLVPITVAGLIIPVMVIARIKRDKALDRVEQSKMSAYIWFFVAAAVFWMIYDQGGSTLSIFADSSAENTIFDWHFPVSWYQSVNPVLIMALAPVFAWLWLALNRRGKEPSTATKFASGLLLIGASFFLFLAPLAIADGGHKAAAMWLVAIYFVQTVGELTVSPVGLSVTTKMAPAKYASQMMGVWFLAVTAGDATTGLLSIAGVDLNKTGIVALQATLAAVAGVAVWMYRKKVKELMGDVH

SEQ ID NO: 21769 - protein, 428 aa, Streptomyces avermitilis MA-4680
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLKTKGLSTGLGDEGGFAPNLESNRAALDLIIEAIKQAGYIPGEQIALALDVAASEFYKDGKYEFEGKSRSAAEMTEYYEELVSAYPLVSIEDPLYEDDWAGWKVITDKLGDKVQIVGDDLFVTNPERLARGIEEGSANALLVKVNQIGSLTETLDAVELAQRNGFKCMMSHRSGETEDVTIADLAVAVNCGQIKTGAPARSDRVAKYNQLLRIEEILDDAAEYAGRSAFPRFRSAN

SEQ ID NO: 21770 - protein, 247 aa, Streptomyces avermitilis MA-4680
MNSTRTVLITGAGTGIGRATARAFAAEGARVVAVGRREAPLAETTEGHPGITPLPADVTAEDAPARIIDTVLDTHGRLDVLVNNAAIVGTESLATYTRTSIEPLLATNLIAPVLLTQAALPALTESRGVIVNVSTSVGQRAWPGNSLYAATKTALELLTRSWAVELAPRGIRVSAVAPGAIATPIGRHSGFTPEQSAAIREWQLAHTPLGRIGRPEEVAWAITRLAAPDASFVTGVVLPVDGGAVLT

SEQ ID NO: 21771 - protein, 454 aa, Streptomyces avermitilis MA-4680
MTKRDVAALFGNRFLTEPAPSQTFPEEGMTATDTMRLLDEDLVMEGDPQRNLATFVTTWMEPEAQRIIAENLHRNFIDHAEYPISAEIEQRCVRMLADLFHAPGKTTGCRTQGSSEAIMLGALSLKWKWRERRQAANLPADRPNLVFGGDVHVVWEKFCRYFDVEPRIVPLAEDKYTIGPEDVEPHIDENTIGVVAVVGTTFTGHKDDVVGIDKLLRDVRKERDLDIPIHVDGASGGFVWPFLYPDSKWDFRLEQVRSINVSGHKYGLVYPGIGWLVFREESDLAKDLVFYENYLGKTDATFTLNFSTGASMVLAQYYNFVRLGRQGYTYVMETMQKNAHALADNLRSSGRFEVIGSDLEQLPLVAFRLAGEHAYDESDIAWQLSAERGWMVPAYTLPPNAERVKILRALVKETLSREQIERLTQDIADACATLDHKGGTTEVERAQIKRGTGY

SEQ ID NO: 21772 - protein, 313 aa, Streptomyces avermitilis MA-4680
MSEQSRSTPGDKVAPGDKVAPGDQAAPGDKVAPGDKVAPGDKVAPGDKVAPGDKAAPGDKVAPGDQAAPGDKVALVTGGSRGIGRAVVARLASDGYDIGFCYRSDDQAAALVEKEVRELGRRVLSRRVDVTDRTQVREFVTAAEEELGPASAVVTSAGITRDSPLVLMPDEDWDAVLRTNLDGTYNLCRAVAFPMIKRGGGAVVTLSSVAGVAGNAGQTNYSASKSGIIGFTRSLAKEGGRHGIRANSVAPGFIDTDMTSELPPKVAKEMLGRIPLKRFGRPEDVAALVAFLLSSEAAYITGQVFQVDGGIAL

SEQ ID NO: 21773 - protein, 331 aa, Streptomyces avermitilis MA-4680
MATRAVARRKSAAGGTDAASSVRAVGGEIADRDLVGMYLDEIARTPLLDAAKEVELSQIIEAGVFARQILDGEEEPRAEATREELESLVADSERAKDVFIKSNLRLVVAVARRYPRSGLPLLDLIQEGNAGLVRAVEKFDYRKGFKFSTYATWWIRQAITRSIADQSRTIRLPVHLVEELGRIRRVQREFNREHGREPEPAEIAAELDSNPARVTDVLDWARDPVSLNMHVDDEGETQFGDLLEDTSAVSPEQSVLTLLRSEELDDLIGRLDQRTASIIKMRYGIDDGRERTLTEVGKEHGLTRERIRQIEKHALLELKKLARSTGFDAAA

SEQ ID NO: 21774 - protein, 258 aa, Streptomyces avermitilis MA-4680
MGKLDGRVVLISGAARGQGEQEARLFVEEGAKVVVADVLDDQGEALAKEIGARYVHLDVGREDDWQAAVTVAKDAYGHIDGLVNNAGILRFNDLVGTPLAEFQQIVQVNQVGVFLGIKTVAPEIEAAGGGTIVNTASYAGLTGMAYVGAYTATKHAIVGLTRVAALELAAKKIRVNAVCPGAIDTAMSNPSQLDPGADPEETARALSELYGRLVPLGRIGRPEEVARLALFLSGEDSSYITGQPFVIDGGWLAGVSVI

SEQ ID NO: 21775 - protein, 349 aa, Streptomyces avermitilis MA-4680
MRGVVFDGKQTQVVDDLEIREPGPGEVAVAISAAGLCHSDLSVVDGTIPFPVPVVLGHEGAGVVEAVGSGVTHVRPGDHVALSTLANCGACAECDRGRPTMCRKAIGRPQQPFARGGRPLYQFAANSAFAERTVVKAVQAVRIPKDIPLPSAALIGCGVLTGVGAVLNRARVEHGDSVLVIGTGGIGLNVLQGARIAGALTIVAVDANPAKEAVARQFGATHFLTSTEGVRDILPTGADHAFECVGRAALIRQAVDLLDRHGQAVLLGVPPATAEASFLVSSLFLDKSILGCRYGSSRPQRDIALYADLYREGRLLLDELVTATYPVEDFEKAAADAHEGRVARAVLTF

SEQ ID NO: 21776 - protein, 345 aa, Streptomyces avermitilis MA-4680
MTNTATTPSYQRYQQLPIIDLSAADRGPQARALLHAQLHSAAHDVGFFQLVGHGVTQAETDELLRAMHAFFALPEADRLAIDNVNSPHFRGYTRTGDERTGGSRDWRDQLDIGAERPVRTPGPGEPAYWWLEGPNQWPAALPELRTAALAWIDKLSAVAQRLLHELLTAIGAPAGFYDPVFGEHAHPHLKLVRYPGSAGDGADQGVGAHKDYGFLTLLLQDQVGGLQVQREDGLFHEVPPLPGAFVVNLGELLEVATNGYLLATNHRVVSPPGATERFSVPFFYNPRLDARVEPLPFPHASTAPGVTDDPANPLFAEYGLNELKGKLRAHPLVAARHHAELLTPA

SEQ ID NO: 21777 - protein, 464 aa, Streptomyces avermitilis MA-4680
MEGAPRRPDRHARSEEERHVSQYASRLGRRSPAAPTRRRMLRKPRRVAMLSVHTSPLHQPGTGDAGGMNVYIVELAQRLAAINIEVEIFTRATTAALRPTVELSPGVLVRHVDAGPYEGLAKEDLPAQLCAFTHGVMQAWAGHRPGYYDLVHSHYWLSGHVGWLAAQRWGTPLVHAMHTMAKVKNAALAEGDTPEPAARVIGEMQIVAAADRLIANTSEEADELVRHYEAERGKVAVVHPGVNLDRFRPADGRAAARARLGLPQDALIPLFAGRIQPLKAPDVLLRAVAVLLDERPELRSNLVVPVVGGPSGSGLAKPEGLQKLAARLGIADVVRFRPPVGQEQLADWFRAASVLVMPSYNESFGLVAIEAQAAGTPVLAASVGGLPVAVADGRTGFLVQGHDPAAYARVLRDFADDPALSARMGRAAARHAECFGWDTAASATADVYTAAMQAHRRRVRSHHG

SEQ ID NO: 21778 - protein, 574 aa, Streptomyces avermitilis MA-4680
MEGLRDRDPARIGAYTLLARLGAGGMGQVYLGRSPGGRLVAIKVIRDEITDHPEALARFRREVETAGAVRSAYTANLIDASLDAAPYWLATEYVSGPTLGGAVTERGPFPPDSARRLFAALAEALASVHGYGVTHRDLKPQNVILSGQGPLLIDFGIARNTTDTALTQTGLAPGTPGFTAPEVLTHNQVTSAADVFALGATIANAATGRPPFGSGPAHAVSYRAVHEDIDVDGVDPELAALIQACVAKDPVERPGLETVIARCAVTSALTEDPFYRPLAGTGDTAPPDLPAAVAAGLVPVGHGMATPPAHRPTVGPGYVPTLAPVTPPPAAARGWRRPLVAGIVGAVVLAAASIVAWQVLPDDRGSAKGGGGASGSPSSSSSAGAASQKVPAYIENDRISRDNWTLSDNPDDAANGIGKCAQIGAVSAPEELQYSARDADDPQLAYVKEKAKISFRFKYAELKNKKPEPYYVSVGVKPPHDIDSETGKPYEVMAANKTIGYSSKPVDIYKHWKSGGTIELTYPDDFQQHWKGETLDAIPVTHDPGDWTAVFYHVKGSPTDYESFGCTGFRGGQG

SEQ ID NO: 21779 - protein, 142 aa, Streptomyces avermitilis MA-4680
MRLALTEAVRAAESADVPVGAVVLAPDGSVIARGHNEREATGDPTAHAEVLAVRRAAERLGRWRLSGCTLVVTLEPCTMCAGALVQSRVDRVVYGARDEKAGAAGSLWDVVRDRRLNHRPEVIEGVLADECAGLLTEFFRER

SEQ ID NO: 21780 - protein, 565 aa, Streptomyces avermitilis MA-4680
MFEARHTMDAPTTTSADNGTSGGTGGAGWFTPRKQPETPQGGGQEAPEGSRLAAMRPVGRPSAGEGTEQQRIPPTEEAVVAPTQPMSGEPLRSLPDPAAPAPARHLGATLTEETRPAPAPIAASQPESAHEALRPLAGQPQFGQPQSGPVQPQPAAALPERGIPQREPGPPEPGSPRPGPDPQVPTPGPAPGPEASPDAVLIRRTMAEVGPVAGKVTSYFYALLFVRHPDLRSLFPAAMDTQRDRLLKALLTAAEHIDNTEVLVAYLQNLGRGHRKYGTRPEHYPAVGECLIGALSRYASGIWDEETEAAWVRAYTTISQVMIDAAAADELRAPAWWYAEVVSHDLRTPDIAVITVRPDQPYPFLAGQYTSLETPWWPRIWRHYSFASAPRSDGLLSFHVKAVPAGWVSNALVHRARPGDIIRLGPPAGSMTVDHTTESGLLCLGGGTGIAPIKALVEDVAEHGERRPVEVFYGARRDHDLYDIDTMLRLQQSHPWLSVRPVVDQRAHLQLPDVIREYGPWNEYDAYLSGPPGMIRSGVDALRGIGIPPDRIRHDSVEELVAAGD

SEQ ID NO: 21781 - protein, 334 aa, Streptomyces avermitilis MA-4680
MTTVALKPATMAQALTRALRDAMAADPAVHVMGEDVGTLGGVFRVTDGLAKEFGEDRCTDTPLAEAGILGTAVGMAMYGLRPVVEMQFDAFAYPAFEQLISHVARMRNRTRGAMPLPITIRVPYGGGIGGVEHHSDSSEAYYMATPGLHVVTPATVADAYGLLRAAIASDDPVVFLEPKRLYWSKDSWNPDEPGTVEPIGRAVVRRSGRSATLITYGPSLPVCLEAAEAARAEGWDLEVVDLRSLVPFDDETVCASVRRTGRAVVVHESGGYGGPGGEIAARITERCFHHLEAPVLRVAGFDIPYPPPMLERHHLPGVDRILDAVGRLQWEAGS

SEQ ID NO: 21782 - protein, 325 aa, Streptomyces avermitilis MA-4680
MAEKMAIAKAINESLRKALESDPKVLIMGEDVGKLGGVFRVTDGLQKDFGEERVIDTPLAESGIVGTAIGLALRGYRPVVEIQFDGFVFPAYDQIVTQLAKMHARALGKIKLPVVVRIPYGGGIGAVEHHSESPEALFAHVAGLKVVSPSNASDAYWMMQQAIQSDDPVIFFEPKRRYWDKGEVNVEAIPDPLHKARVVREGTDLTLAAYGPMVKVCQEAAAAAEEEGKSLEVVDLRSMSPIDFDAVQASVEKTRRLVVVHEAPVFLGTGAEIAARITERCFYHLEAPVLRVGGYHAPYPPARLEEEYLPGLDRVLDAVDRSLAY

SEQ ID NO: 21783 - protein, 323 aa, Streptomyces avermitilis MA-4680
MPAVTVENPLTLPRVVASADAVARPVLAVTTAPSGFEGEGFPVRRAFAGINYRHLDPFIMMDQMGEVEYAPGEPKGTPWHPHRGFETVTYILDGIFDHQDSNGGGGTITNGDTQWMTAGSGLLHIEAPPESLVMSGGLFHGIQLWVNLPAKDKMMAPRYQDIRGGQVQLLSTPDGGALLRVIAGELDGHQGPGITHTPISLVHATVAPGAEVTLPWREDFNGLAYVLAGRGSVGTDRRPVHTGQTAVFGAGSSITVRADEKQDANTPDLEVVLLGGQPIREPMAHYGPFVMNTREELQQAVEDFQKGRLGTIPAVHGMAEGGL

SEQ ID NO: 21784 - protein, 801 aa, Streptomyces avermitilis MA-4680
MAGLSTPHQFDHPTALAAAVLTDDNRVIVMVIGVVALAALVVAGILVRQVLAAGEGTDSMKKIAAAVQEGANAYLGRQMRTLGVFAVVVFFLLMLLPADDWNQRAGRSVFFLIGALFSATTGYTGMWLAVRSNVRVAAAAREATPAEGEPEKDLTAVSHKAMKIAFRTGGVVGMFTVGLGLLGASCVVLVYAADAPKVLEGFGLGAALIAMFMRVGGGIFTKAADVGADLVGKVEQGIPEDDPRNAATIADNVGDNVGDCAGMAADLFESYAVTLVAALILGKAAFGDSGLAFPLIVPAIGVLTAMIGIFAVAPRRADRSGMSAINRGFFVSAVFSLALVAVAVYVYLPGKYADLDGVTDVAIRAKDGDPRILAMVAVAIGIVLAALIQQLTGYFTETTRRPVRDIGKSSLTGAATVVLAGISVGLESAVYTALLIGLGVYGAFLLGGTSIMLALFAVALAGTGLLTTVGVIVAMDTFGPVSDNAQGIAEMSGDVTGAGAQVLTDLDAVGNTTKAITKGIAIATAVLAASALFGSYRDAITTAANDVGEKVSGAGAPMNLMMDISQPNNLVGLIAGAAVVFLFSGLAINAVSRSAGAVVYEVRRQFREHPGIMDYTEQPEYGRVVDICTKDALRELATPGLLAVLAPIAIGFTLGVGALGAYLAGAIGTGTLMAVFLANSGGAWDNAKKLVEDGHHGGKGSEAHAATVIGDTVGDPFKDTAGPAINPLLKVMNLVALLIAPAVVKFSYGEDKNLGVRIAIAVLSILVIVGAVYISKRRGIAVGDEGNAERVTKSADPAVVS

SEQ ID NO: 21785 - protein, 470 aa, Streptomyces avermitilis MA-4680
MPLHKGPVKSDERPMSFNPFFGEANPVSGMTEAPPKHRLADGPLPPSTAYQLVHDELMLDGNARLNLATFVTTWMEPQAGVLMAECQDKNMIDKDEYPRTAELEKRCVAMLADLWNAPDAGAAVGCSTTGSSEACMLAGLALKRRWARRNADRYPARDVRPNLVMGINVQVCWEKFCNFWEVEMRQVPLEGERYHLDPGAAAELCDENTIGVVGILGSTFDGSYEPIAELCAALDALQERTGLDIPVHVDGASGAMIAPFLDEDLVWDFRLPRVASINTSGHKYGLVSPGVGWALWRDSEALPEELVFRVNYLGGNMPTFALNFSRPGAQVVAQYYTFLRLGREGFRAVQQTTRNVARSLAERVAALGDFHLLTRGDELPVFAFTTAPEVASYDVFDVSRRMREHGWLVPAYTFPPNREDLSVLRVVCRNGFSTDLAELFVEDLSRLLPDLRRQARPQTHDKDAATGFHH

SEQ ID NO: 21786 - protein, 333 aa, Streptomyces avermitilis MA-4680
MHSSTERSPGSLRTSYAQQVATVALTALAPASWGTTYAVTTELLPPGHPLFAGLMRALPAGLLGLAITRVPPRGDWWWKAAVLGVLNIGALFPLLFLAAERLPGGVAATLSATQPLLVAGLAIAVLRDRPTAWRWTWGAIGVIGVGLVVLGPQARLDGVGVLVGLGGTAAMVGGVVLTKRWGRPAEVGPLTLAGWQLTAGGLLLLPLTLAIEGVPQRIDAGAVGGYLWLGSMGGLIAYTLWFRGIGKLPVGVSAPLVLLSPLVATLVGIVLGESLGLPQTLGFVLALAALLATQLNAPNVFGRIARGGPAEDPIPDRIPDPSREDQIRGGRIR

SEQ ID NO: 21787 - protein, 324 aa, Streptomyces avermitilis MA-4680
MSDARTPRIPTVDLRPWLSGDPDARARIARTVDDALRTAGFLLVTGHGVDPSLRTRIRVAARAFFTLPAETKQRYAARVGGRGWLGPGAEANGYSEGTETPPDLKESLTFATHEPFEDPETNAEWYAPNVWPAEAPELREPCEEYLAEMAGLEDRLLTLLGEALGLEPDFFTKHMTHPTYGFNINWYPGTEVTGDPAPGQFRIGPHTDFGTVTILDRQAGKGGLQVYTDDGGWADAPFDPAAFTINIGDLMARWTGDRWRSGRHRVLPPPADAPAEELMSLVYFGECTPGTLVESVPAPVGRVAYEPVDSHTYLREKLNSITVD

SEQ ID NO: 21788 - protein, 502 aa, Streptomyces avermitilis MA-4680
MTANVDGVPAKFATLGLTYDDVLLLPGASDMAPDQIDTASHVSKNVRVNIPLLSAAMDKVTEARMAIAMARQGGVGVLHRNLSIEDQANQVDLVKRSESGMVTDPITVHPDATLAEADAICAKFRISGVPVTDGNGKLLGIVTNRDMAFETDRSRQVREVMTPMPLVTGKVGISGNDAMQLLRRHKIEKLPLVDDAGILKGLITVKDFTKAEKYPNAAKDAEGRLLVGAAVGVAGDAFERAQALIEAGVDFIVVDTAHGHSRLVGDMVAKIKSNSGGVDVIGGNIATRDGAQALIDSGVDGIKVGVGPGSICTTRVVAGIGVPQVTAIYEASLAAKEAGVPVIGDGGLQYSGDIAKALVAGADTVMLGSLLAGCEESPGELLFINGKQFKSYRGMGSLGAMQSRGEQRSFSKDRYFQEGVASDEKLVPEGIEGQVPYRGPLSAVVHQLVGGLRQSMFYVGGRTVPELQDNGRFVRITSAGLKESHPHDIQMTVEAPNYSRSK

SEQ ID NO: 21789 - protein, 374 aa, Streptomyces avermitilis MA-4680
MTEIEIGRGKRGRRAYAFDDIAVVPSRRTRDPKEVSIAWQIDAYRFELPFLAAPMDSVVSPATAIRIGELGGLGVLNLEGLWTRYEDPQPLLDEIAELDADTATRRLQEIYAAPIKEELIGQRIKEVRDSGVVTAAALSPQRTAQFSKAVVDAGVDIFVIRGTTVSAEHVSGAAEPLNLKQFIYELDVPVIVGGCATYTAALHLMRTGAAGVLVGFGGGAAHTTRNVLGIQVPMATAVADVAAARRDYMDESGGRYVHVIADGGVGWSGDLPKAIACGADSVMMGSPLARATDAPGRGHHWGMEAVNEELPRGKKVDLGTVGTIEEILTGPSHIPDGSMNIFGALRRAMATTGYSELKEFQRVEVTVADAQHKR

SEQ ID NO: 21790 - protein, 485 aa, Streptomyces avermitilis MA-4680
MTTVDNRQDFKVADLSLAEFGRKEITLAEHEMPGLMSIRKEYAEAQPLAGARVTGSLHMTVQTAVLIETLVALGAEVRWASCNIFSTQDHAAAAIAVGPNGTPDNPQGVPVFAWKGETLEEYWWCTEQALTWPNTPTGGPNMILDDGGDATLLVHKGVEYEKDGKVPSVDTAESDEHRVILELLHRTITDGSQKWTQLASEIRGVTEETTTGVHRLYEMHRDGTLLFPAINVNDAVTKSKFDNKYGCRHSLIDGINRATDVLIGGKTAVVCGYGDVGKGCAESLRGQGARVIVTEIDPICALQAAMDGYQVTTLDEVIDKADIFVTTTGNKDIIMASDMAKMKHQAIVGNIGHFDNEIDMAGLAQIPGIVKDEVKPQVHTWKFPDGKVLIVLSEGRLLNLGNATGHPSFVMSNSFADQTLAQIELFTKPDEYPTDVYVLPKHLDEKVARLHLDSLGVKLTTLRPEQAAYIGVEVEGPFKSDHYRY

SEQ ID NO: 21791 - protein, 299 aa, Streptomyces avermitilis MA-4680
MYDYDLLVVGSANADLVIGVERRPAAGETVLGSDLVVHPGGKGANQAVAAARLGARTALLARVGDDAHGRLLLDSQRRAGVDTVGVLVGGAPTGVALITVDPSGDNSIVVSPGANGRLAPRDVRAADSLLRSAAVVSAQLEIPLESVVEVVRNLAPGTRFVLNPSPPRPLPEEVLAACDPLIVNEHEARVIAGGELDGSPEDWAAALLALGPRSVVVTLGAEGALVASAEGTARVPSVRVDAVDTTGAGDAFTAALAWRLGLGESLVRAAAYAARVGASAVTRSGAQASFPTAEEVAAL

SEQ ID NO: 21792 - protein, 369 aa, Streptomyces avermitilis MA-4680
MTKNGSTRAPLIALTALAPVSWGSTYAVTTEFLPADRPLFTGLMRALPAGLLLLALARVLPRGAWWWKSAVLGALNIGAFFPLLFLSAYRLPGGMAAVVGSVGPLFVAGLAAALLSERPTVRTLLTGIAAALGVSLVVLKAAGALDPLGVLAALAATASMSTGTVLTKRWGRPAGVGPLALTAWQLTAGGLLIAPIALLVEGTPPALDGRAIGGYLYLALANTAVAYWLWFRGIGRLTATQVTFLGPLSPLTAAVIGWAALGQALTPVQLAGMAVAFGATVFGQLRPRAQDRRRHRETTAVPLDAGPNSNAATTAPGAAAVPGAPTATAAPSVPTATAAPTVPGATAAPSAPTAPTATTATTATTPNGS

SEQ ID NO: 21793 - protein, 1383 aa, Streptomyces avermitilis MA-4680
MSENSATRVLEDGQIRASDLRPLLAAMTAARDGIFTRVPETGHGLVAELSTAFNQIMDRNAHFNSEVQRVRRELVRHGRLDERLSASPGQGYWAARVSDVNQLLDALVAPAANATRVLDAVAGGDLTQRVDLHDGNRQLRGDLRRLGRAVNKMVDQLSLFTGEVTRVAREVGTEGRLGGRAKVQGLSGSWRDVTEAVNTMASRLTAQVRDIALVTTAVARGDLTRTVTVEATGELLELKLTVNTMVDQLSAFADEVTRVAREVGTEGQLGGRAQVRGVSGVWKDLTDNVNFMASNLTSQVRNIAQVTTAVANGDLSQKITVDAQGEILELKSTINTMVDQLSAFADEVTRVAREVGTEGNLGGRAQVRGVSGVWKDLTDNVNFMADNLTSQVRNIALVSTAVAQGDLGKKITVEAKGEILELKSTINTMVDQLSAFADEVTRVAREVGTEGNLGGQAQVRGVSGVWKDLTDNVNFMALNLTSQVRNIAQVTTAVANGDLSKKITVDARGEILELKDTVNTMVEQLRAFADEVTRVAREVGTDGRLGGRAQVLGVSGVWRDLTDNVNYMADNLTSQVRNIAQVATAVAQGDLSKKIDVDARGEILELKTTINTMVDTLSSFSSEVTRVAREVGSEGQLGGQARVEGVYGTWKRLTTNVNELALNLTTQVRAIAEVASAVAQGDMSRSISVETRGEVAELKDNINLMVANLRETTRAKDWLESNLARLAALMQGHRDLMEVADLILRELTPLVNAQYGAFFLADPDEDGASLRTTVPAKGLAFIAGYGSAHSVTVDTGGMPVHGLVRQAAREKKRILVEEAPPDYIKINSGLGEAAPASVVIIPILFEDKLLGVIELASFSRFSDVHLAFFDQFVNTIGVAINTIIANSRTESLLGESQRLAIQLQDRSDELQSQQAELQRSNAELEEKAALLATSSQYKSEFLANMSHELRTPLNSLLILARLLSDNPDGHLSDQEVQFATTIHRSGSDLLQLINDILDLSKIEAGRMDVRPKKLPLIKLLDYVHATFRPLTIDRGLAFDVAVGEDVPREMYSDEQRLQQILRNLLSNAIKFTASGRVELRVGRVKDPEHRYTREDSEEVIAFAVSDTGIGIAPEKLPVIFEAFQQADGTTNRKYGGTGLGLSISREIAGLLGGRIIAESVPGKGSTFTLYVPVVSPGHAATGPAPEERPLPTPEQLSTESYITHDPEDSWPAPTKLEEWQVGRAGQVLPGRRVLIVDDDIRNVFALTHVLGRVGMPVLYAENGREGIETLERNPDVELVLMDIMMPEMDGYETISVIRRTPRWAGLPIVALTAKAMPGDREKSIARGANDYVPKPVDVDQLLTVVCALLDPEGADAEERDDFAEPTDPGPVTSGEPAVPPLTE

SEQ ID NO: 21794 - protein, 112 aa, Streptomyces avermitilis MA-4680
MKLITAIVKPYRLDEVKTALQELGVHGLTVTEASGYGRQRGHTEVYRGAEYRVDLVPKVRIEVVVEDADSDAVIDAIVKAAQTGKIGDGKVWSVPVETVVRVRTGERGPDAL

SEQ ID NO: 21795 - protein, 479 aa, Streptomyces avermitilis MA-4680
MLTTLLRDSRALAALAVPLILTQLAQVALTTTDTVMMGLLGTRELAAGGLALVIFNQLRTMGVGLVTSVGNQIAAAGARAEQAEQAEAERTAGRDDDGRGHAQEEAHEEMRGIVRASLALATLAGLAGAVLMILIGQALPWLGQDAAVADRAQTMLFALAPGLLPCLWFQAIRQFTVGMRRPQALLRITVASVAVNAGLNWVLIHGTWGLPRMGLTGVGVATSSVYVLTCIALYVSARKDGALAPLLALDVMKADPAVLRRLLRLGLPIAATYGSEAGFFSLTALMAGSFGPAALAAHTAVNQLVYIVFQVAVGLSHAASINVSRELAVGRYEDAGRIKNTALACAAAVMTVVGVVYLTLPELVLAPFLESGSGQALTIATHLLVVTAFLQFFDCAQNIGVGLLRGLDDTRSGFRITLIGYWAVGLPAAWLLAYALELDTLGIWLGLLTGLATTAVLLLRRYAQSLTTRSARHTPLTAT

SEQ ID NO: 21796 - protein, 916 aa, Streptomyces avermitilis MA-4680
MSENKDPQVADVAESGVAGVKFVYDFTEGNKDLKDLLGGKGANLAEMTNLGLPVPPGFTITTEACKTYLDSGEEPAALRDEVSAHLDALEAKMGKKLGQADDPLLVSVRSGAKFSMPGMMDTVLNIGLSDKSVQGLAKQAGDDRFAWDSYRRLIQMFGKTVLGVDGELFEDALEAAKAAKKVTIDTDLEAADLKRLVTKFKKIVKTEAGRDFPQDAREQMDLAIHAVFDSWNTDRAKLYRRQERIPHDLGTAVNVCSMVFGNLGPDSGTGVAFTRDPASGHQGVYGDYLQNAQGEDVVAGIRNTVPLAELEQIDKKSYDQLMQIMATLENHYKDLCDIEFTIERGQLWMLQTRVGKRTAGAAFRIATQLVDQGLIDEAEALQRVNGAQLAQLMFPRFDDQAKVEQIGRGIAASPGAAVGKAVFDSYTAIKWSRSGEKVILIRRETNPDDLDGMIAAEGILTSRGGKTSHAAVVARGMGKTCVCGAEELEVDTKRRRMTAPGGVVVEEGDVVSIDGSSGKVYLGEVPVVPSPVVEYFEGRMHAGADDADELVAAVHRIMAFADRKRRLRVRANADNAEDALRARRFGAQGIGLCRTEHMFLGDRRELVERLILADTDAEREESLKELLPLQKKDFIELFEAMDGLPVTVRLLDPPLHEFLPDITELSVRVALAESRKDSNENDLRLLQAVHRLHEQNPMLGLRGVRLGLVIPGLFTMQVRAIAEAAAERKAAKGDPRAEIMIPLVGTVQELEIVRDEADQVIAEVQAATGTELKLAIGTMIELPRAALTAGQIAEAAEFFSFGTNDLTQTVWGFSRDDVEASFFTAYLEKGIFGVSPFETIDKDGVGKLVRDAAVAGRATRPDLKLGVCGEHGGDPESVHFFHEVGLDYVSCSPFRIPVARLEAGRAASQSAGSDHR

SEQ ID NO: 21797 - protein, 389 aa, Streptomyces avermitilis MA-4680
MQTQTLAQTDISAENAEPDAETDVIAAVPAQSRAAHHPETETEPTAPPEPDEPPAGAVESVDVVETVELVEAPEPPAPRARSNDTGGPSSDLFRQYLREIGRIPLLTAAEEVELARRVEAGLFAEEKLSSTPDLDSQLGLDLDKLVVMGRMAKRRLIEANLRLVVSVAKRYVGRGLTMLDLVQEGNLGLIRAVEKFDYARGYKFSTYATWWIRQAMSRALADQARTIRVPVHVVELINRVVRVQRRMLQERGYEPTPEEVAAHLDLPGERVSEVLRLAQEPVSLHAPVGEEDDVALGDLIEDGDATSPVESAAFLLLREHLDAVLSTLGERERKVVQLRYGLADGRPRTLEEIGRIFGVTRERIRQIESKTLNKLRDHAFADQLRGYLD

SEQ ID NO: 21798 - protein, 491 aa, Streptomyces avermitilis MA-4680
MTAEAMEAGPQEGSAADGDVPLRIALLTYKGNPFCGGQGVYVRHLSRELARLGHRVEVIGSQPYPVLDEGLPGLSLTELPSLDLYRQPDPFRTPGRGEYRDWIDALEVGTMWTGGFPEPLTFSLRARRELRARRGDFDVVHDNQTLGYGLLGDVGAPLVTTIHHPITVDRQLELDAAEGWQRKASVRRWYAFTRMQKRVARRLPSVLTVSGTSRQEIVDHLGVSQDHVHVVHIGADTDLFSPDPAVPQVPGRIVTTSSADVPLKGLVFLIEALAKVRTEHPGAHLVVVGKRAEDGPVAQAIERYGLHGAVEFVKGISDAELVALVRSAEVACVPSLYEGFSLPAAEAMATGTPLVATTGGAIPEVAGPDGETCLAVPPGDAGALAAGLSRLLGDPALRTRLGSAGRERVLARFTWAKAAEGTAAHYREAIARSTAPAGAGRTAVAVGTATAAGPVKAAGAMKAAGAGTADGAAAEEAEEIVVSDRESRATC

SEQ ID NO: 21799 - protein, 358 aa, Streptomyces avermitilis MA-4680
MRAAVLHEIGQDKLEVLDDVESVGFGPGRVRIRVRATGLCHSDLSAMSGVLPQPAPFVPGHEGAGEIVEVGEGVSHLKPGDRVVVCWLPACGVCPACKRGQSQLCLAGFMNAGTPNFRRPGGDVFGFAGTGTFAEEVVVDAGSAVPIPDDVPFDIAALIGCGVTTGLGAALNTADVAAGSSVAVIGCGGVGISAVQGARLKGAAEIVAVDPVASRRESALRFGATQAVSPDELAAAKQAVTGGEGFDYVFEVVGRSATARTAYENTRRGGTLVVVGAGALDDFLQLNMFELFFDEKRILPSMYGGGDVLRSYERTIALWRAGRIDLEGLITHRVPLAEINEALDQMRTGTALRTCIEI

SEQ ID NO: 21800 - protein, 400 aa, Streptomyces avermitilis MA-4680
MLSEQSAATVRATLPAVGAAVGEITARFYDRLFAARPELLRDLFNRGNQAAGTQRQALAGSIAAFATYLVEHPDERPDAMLDRIAHKHASLGIAPGQYAVVHEHLFAAIAEVLGDAVTPEVAAAWDEVYWLMANALIAIERRLYAQHENTGDTGGRRPWRVVERVDETADVAAFRLRPADGRPLPDFRPGQYVSVRVELPDGARQTRQYSLVGAPGSPELRIAVKRVHGGTTPDGEVSNHLHARVREGSVLELSAPYGDLALEATDVPLLLASAGIGVTPMIAMLEHLALTGHRAPVTVVHADRSPAEHALRADHEAYAAKLADAAVHFWYEHPEPGHPADRTGLVDLTGVPVSAGTRAYLCGPLPFMRAVRTQLIEKGVAPADIHYEVFGPDLWLARES

SEQ ID NO: 21801 - protein, 531 aa, Streptomyces avermitilis MA-4680
MLTVDQLALLFVLLLGAVVSVPVGDRFGLPAPVLMTLLGIGLAVADFVPNVDIPPDLILPALLPPLLYAAVRRTSWRQFTANKRPIFLLAVALVFVTTAVVALVAGAIVPGLPIAAAVALGALVAPPDPVAATAVAGQLGLPRRLVSILEGEGLFNDVTAIVLYHVAIAAAVSGTFSLPNAVLDLVLSAVVAVAVGLALGWAANRLMDLLDDVTLQIGLTLLVPYASYVLAEELHGSGVLAVLTTALFLAEYATDADDVMTRLAGHTFWNVVDTLVTGVAFGLIGLELHNALRTASGRWGEMLGWAAAIVAVVVLVRLAYLLPATWLTKRLHAKRDYDEEIPTSWRETVVMWWAGMRGVASAALALAIPLKMDDGSPFPDRDEIVFIAFGVIMGTLVLQGLTLPWLVKRLGVRADTGSEKAFEKALAIRAAKAAKRRLREIEDVEELPEELSEQLLRRAFDIGARISPDLGDEERREAHEQRVRRMKRVRRIQGEMMSAARHEVLAARSEPGADPEIVDRVLRHLDVRSLR

SEQ ID NO: 21802 - protein, 263 aa, Streptomyces avermitilis MA-4680
MTDVEAPVYVSGHGLLQGRTAVVTAAAGAGIGGATARRFLEEGARVLISDAHTRRLKEYEAELAREFEGAAVAALPCDVTDEDQVRALFDTAVRLHGGLDIVVNNAGLGGTSDLVDMTDEQWSNVLDVTLNGTFRCTRAALRLLREQPGGGVIVNNASVVGWRAQAGQAHYAAAKAGVMALTRCAAMEAAGYGVRVNAVAPSLAMHPHLVKVTTPELLEELTGREAFGRYAEPWEVANVIVFLASGYSSYLTGEVVSVSSRHA

SEQ ID NO: 21803 - protein, 314 aa, Streptomyces avermitilis MA-4680
MNAPGAGALLVVGDVVTDVVARHRGPLASGTDTAAAIRTVPGGAGANVACWAAHWGWADVRLLGRVGADGAAWHERELTASGVRPRLVVDPDVPTGTVICLVDTGASAERTFLTDSGASLRLAPGDWSNALLDGVVRLHLSGYLLFSEQSRALVAAALESARARGVPVSLDPASAGFLAELGVDRFLALIEGVDVLLPSRDEACLLTGLPDPADAAAKLSRHVPLVVAKQGAEGALVAEAGAVRARVPATPATPRDTTGAGDAFTGAFLAALLVGVEPAQAAAEGCRAGAAAVAGVGGRPPSGTRQNRGAVKLD

SEQ ID NO: 21804 - protein, 239 aa, Streptomyces avermitilis MA-4680
MSRSVLVTGGNRGIGLAIARAFAEAGDKVAITYRSGEPPATLTDLGCLAVKCDITDTEQVEQAYKEIEDQHGPVEVLVANAGVTKDQLLMRMSEEDFTSVLDTNLTGTFRVVKRANRGMLRAKKGRVVLISSVVGLLGSAGQANYAASKAGLVGFARSLARELGSRNITFNVVAPGFVDTDMTKVLTEEQRKGIVGQVPLGRYAQPEEIAAAVRFLASDDASYITGAVIPVDGGLGMGH

SEQ ID NO: 21805 - protein, 359 aa, Streptomyces avermitilis MA-4680
MVRAAVLPAVGAPLEITGIELPEPGPGQVRVRLAAAGVCHSDLSLSDGTMRVPVPAVLGHEGAGTVVSVGEGVTQVSPGAGVVLNWAPSCGRCHACSLGEVWLCADALTGAGTVYARRTDGSDLYPGLNVAAFAEETVVPAACVLPVPDGVPLTDAALLGCAVLTGYGAVHHSAKVQPGETVAVFGVGGVGLATLQAARIAGASKIVAVDVSPEKESLARRAGATDYLVASENTAREIRGLTDKQGVDVAVECVGRAVTIRTAWDSTRRGGRTTVVGIGGKDQQVVFNALEIFHWGRTLSGCVYGNSDPAKDLPVLAEHVRAGRLDLGALVTERIALDGIPAAFDNMLAGKGGRALVVF

SEQ ID NO: 21806 - protein, 336 aa, Streptomyces avermitilis MA-4680
MSTPPFTPAPRRRAELLAAGAAAVTVVLWASAFVSIRSAGAAYSPGALALGRLLAGVLALGVICLVRGEGLPPRAAWPGIVMSGLLWFGCYMVVLNWGEQQVDAGTAALVVNIGPILIALLGARLLGDALSPRLLAGMAVSFAGAVAVGLSLSGEGGSSVLGVVLCLLAAAGYAGGVVAQKPALGSASALQATTFGCLVGAVGCLPFAGQLVHEAAAAPVSATLNMLYLGVFPTALAFTTWAYALARTTASRMGATTYAVPALVVLMSWLVLDEVPGPLTLAGGLLCLAGVAVSRSRPRGRTTAPVPEDTAPAPAPEPAPRPAPDPVPRPAPEPRA

SEQ ID NO: 21807 - protein, 252 aa, Streptomyces avermitilis MA-4680
MSHPLFDIAGRTALVTGSSRGIGRALARGLLEAGCTVVLNGRDGDRLTAAAAELPGDVRTAAFDVTDGPSVAAGIAEVEERVGPLDILVNNAGIQLRAPLLEFTDSDWHRILNTNLTSAFLVGREAARRMTERGHGKIVNICSLQSEVVRPGIAPYAATKGALKMLTKGMCADWGPYGVQVNGLGPGYIETELTRPLVEDEEFSAWVRHRTPAGRWGRTEDLVGGVLFLASPAADFVSGQVLYVDGGMTSVL

SEQ ID NO: 21808 - protein, 250 aa, Streptomyces avermitilis MA-4680
MPKKGSRPDRPSRRCARMTSTVPALGTRSAEGSALQAVLLDMDGTLVDTEGFWWDVEAEVFAALGHPLDESWRHVVVGGPMARSAGFLIEATGADITLAELTVLLNDGFEARIGRTLPLMPGAARLLAELAAHEIPTALVSASHRRIIDRVLTSLGSQHFALTVAGDEVARTKPFPDPYLLAASGLGAEPARCAVIEDTATGVAAAEAAGCRVVAVPSVAPIAPAARRTVVTSLEEVDLPFLRGLMTEMR

SEQ ID NO: 21809 - protein, 263 aa, Streptomyces avermitilis MA-4680
MTEATEQTSCRRLVGRTAVITGAGSGIGLATARRLASEGAHVVCGDIDEVSGKAAADEVGGTFVQVDVTDAEQVEALFRTAYDTYGSVDIAFNNAGISPPDDDSILETGLEAWKRVQEVNLTSVYLCCKAAIPYMRRQGRGSIINTASFVARMGAATSQISYTASKGGVLAMSRELGVQFAREGIRVNALCPGPVNTPLLQELFAKDPERAARRLVHIPVGRFAEADEIAAAVAFLASDDSSFVNATDFLVDGGISGAYVTPL

SEQ ID NO: 21810 - protein, 433 aa, Streptomyces avermitilis MA-4680
MARQTDRAAGMDMAMMRLRREDPRVVGSFRLHRRLGAGGMGVVYLGSDRRGQRVALKVIRPDLAEDQEFRFRFAREVSAARRIRGGCTARLVAADLDADRPWFATQYVPGPSLHDKVAEEGPLSAADVAAVGAALSEGLVAVHEAGVVHRDLKPSNILLSPKGPRIIDFGIAWATGASTLTHVGTAVGSPGFLAPEQVRGAAVTPATDVFSLGATLAYAATADSPFGHGSSEVMLYRVVHEEAHLNGVPDALAPLVRACLAKDPEERPSTLQLSLRLKEIAAREAQGIADVRPPAQRGEPDRPSGRLAEQYAEQRTQRRPQGAPGTPPPRTGGGPRSGSRPTPAPRNSTRSGSRPAPRSGAGRSSPRTTGTGRRPANPRLLRQRLFVFVVVTLLVALGIAAAQGCQGPARGLDDGGVRKDVRQEQSYEPWRGI

SEQ ID NO: 21811 - protein, 405 aa, Streptomyces avermitilis MA-4680
MWGDPVDKPKVVLGVSGGIAAYKACELLRRLTESGHDVRVVPTGSALHFVGAATWSALSGNPVSTEVWDDVHEVPHVRIGQHADLVVVAPATADMLAKAAHGLADDLLTNTLLTARCPVVFAPAMHTEMWEHPATQENVATLRRRGALVIEPAVGRLTGVDTGKGRLPDPTEIFEVCRRVLARGAARPDLAGRHVVVSAGGTREPLDPVRFLGNRSSGKQGYALARTAAARGARVTLVAANTGLPDLAGVDVVQVGTAVQLREAVLKAASDADAVVMAAAVADFRPATYATGKIKKKDGQEPEAIVLVRNPDILAEISADRPRPGQVVVGFAAETDDVLANGRTKLARKGCDLLVVNEVGERRTFGSEENEAVVLGADGSEIPVPYGPKEALAETVWDLVVPRLG

SEQ ID NO: 21812 - protein, 483 aa, Streptomyces avermitilis MA-4680
MQHVRFLNDIKPPYDLTYDDVFMVPSRSAVGSRQGVDLTSPDGTGTTIPLVVANMTAIAGRRMAETVARRGGLVVIPQDIPIEVVTEVVSWVKGRHLVLDTPIVLVPHQTVADALALLPKRAHNAGVVVDEDGRPVGVVTDTDLTGVDRFTQLSEVMSRDLLLLDADIEPREAFNKLDGANRRYAPAVDRDGRLAGILTRKGALRATLYTPATDADGRLRIAAAVGINGDVAGKAKQLLDAGVDTLVIDTAHGHQESMISAIRTVRALDPQVPIAAGNIVAADGVKDLVEAGADIIKVGVGPGAMCTTRMMTGVGRPQFSAVMECAAEAKKYGKHVWADGGVRHPRDVAMALAAGASNVMIGSWFAGTYESPGDLQQDADGRLYKESFGMASARAVRNRTSEESAYDRARKGLFEEGISTSRMFLDPGRPGVEDLIDSIIAGVRSSCTYAGANSLEEFTEKAVVGIQSAAGYAEGKPLHASWS

SEQ ID NO: 21813 - protein, 507 aa, Streptomyces avermitilis MA-4680
MAARAAGRRPCLTRTTPQEAIVPDLFIDGEWRAALDGRTREIRCPADGSLVGVVDEAGGKDTAEAIAAARRAFDEGPWPWLPAADRGDLLLRVADLLVRDRAKLARAESLDTGKRFVESEYDIDDIVNCFRYFGRLAAAESGRVIDTGSASTDSRVVYEPVGVCALITPWNYPLLQTAWKVAPALAAGNTFVLKPSELTPHTAIHLMRLLQEAELPPGVANLVLGAGPEAGAPLADHPDVDLVSFTGGLHTGRRLMAAAAGTVKKVALELGGKNPNIVFADADFDTAVDMALTAVFLHSGQVCSAGARLLVEDSLHDRFVDEVVRRAAEIRLGGPFDERAQTGALISAAHRAKVEAYVAKGLDEGAVLRCGGRRPEGLDEGFFYLPTVLDECTSGMSVIQDESFGPVLTVERFTGEAEAVRLANDTVYGLAGAVWTTDEAKAQRVVSRLRIGTVWINDYHPYVPQAEWGGYKQSGFGRELGPSGLAEYREAKHIWRNTDPSPQGWFA

SEQ ID NO: 21814 - protein, 363 aa, Streptomyces avermitilis MA-4680
MVVPHEVRAVVAVKKGAPVEVQTIVVPDPGPGEVLVAVQACGVCHTDLHYREGAITDDFPFLLGHEAAGTVEAVGAGVTDLAPGDYVVLAWRAPCGSCRSCRRGRPWYCFDSRNATQPMTLLDGTPLSNALGIGAFAEKTLVAAGQAVKIDPAARPEAAGLIGCGVMAGYGAAVNTGKVGRGDTVAVIGCGGVGNAAIAGACLNGAMKVIAVDIDDKKLDQAEKFGATHTVNSRGTDPVEAVRALTDGFGVDIAIDAVGRPETYKQAFYMRDHAGTLVQVGVPDPEMKIDLPLIDLFSRGGALKSSWYGDCLPSRDFPFLIDQYLYGLLDLNAFVSETISLEQVEEAFAKMHRGEVLRSVVVL

SEQ ID NO: 21815 - protein, 556 aa, Streptomyces avermitilis MA-4680
METTLRGVGVSHGVAIGEVRHMGTAVLEPPAKQIPAEDAEREQGRAHKAVDAVAADLIARGNLAGGEAQAVLEAQALMAQDPELMADVERRIAVGSTAERAVYDAFASYRALLAGAGEYLAGRVADLDDVRNRIVARLLGVPMPGVPDSDEPYVLIARDLAPADTALLDPTLVLGFVTEEGGPTSHSAILARALGVPAVVALPGAGEIGEGIVIAVDGSTGEIFVNPSPEKKEQLEAAAAERKAALSASTGPGATSDGHKVPLLANVGGPADVPAAVEAGAEGVGLFRTEFLFLDDSKNAPSEEKQVEAYRQVLEAFPEGRVVVRVLDAGADKPLEFLTPADEPNPALGVRGLRILLEHPDVLRTQLTALAKAAEGLPVYLEVMAPMVADRTDAKAFADACREAGLQAKFGAMVEIPSAALRARSILQEVEFLSLGTNDLAQYTFAADRQVGAVSRLQDPWQPALLDLVALSAEAAKAEGKSCGVCGEAASDPLLACVLTGLGVTSLSMGAASIPYVRATLAKYTLAQCERAAAAARAADTAEEARNAAQAVLSGE

SEQ ID NO: 21816 - protein, 253 aa, Streptomyces avermitilis MA-4680
MTALPELSGKVALITGASRGIGYGVAEALVARGDRVCITGRNEDALKEAVEALGAERVIGVAGKAHDEAHQAAAVERTMEAFGRVDYLVNNAGTNPVFGPIADLDLNVARKVFETNVVSALGFAQQTWKAWQGENGGAIVNIASVAGVSASPFIGAYGISKAAMINLTLQLAHEFAPKVRVNAIAPAVVKTKFAQALYEGREAEAAASYPLGRLGVPSDIGGAAAFLTSAQSDWITGQTLVVDGGIFLNAGVG

SEQ ID NO: 21817 - protein, 383 aa, Streptomyces avermitilis MA-4680
MRVGLLTREYPPDVYGGAGVHVEFLARELRSLTDLAVHCWGEGGAGGVVRHRPWTALDGANDALRTFSVDLSIAAALEGRELVHSHTWYAHLAGHLGKLLHGIPHVMTAHSLEPLRPWKAEQLGGGYALSGWAERTAIEAADAVIAVSGAMREDILTCYPTLDPAKVRVVHNGIDTTLYRPDHGTDVLARIGLDADRPFVLFVGRITRQKGVPQLLRAVRDIDASAQVVLCAGAPDTPEIDQEFRDLFQELSRVRAGVHWIPQMLPRPDVIQLLTHAAVFVCPSVYEPLGIVNLEAMACGTAVVASRVGGIPEVVDDGRTGVLVPVDEDFEASLAHALDSVLGDPEAARRMGEAGRERAVREFGWDAVARRTVHLYEEVLKQG

SEQ ID NO: 21818 - protein, 268 aa, Streptomyces avermitilis MA-4680
MTSPYGLEGRVAVVTGASRGIGRAVAEAFAAAGAHVCVTARDADGVRRAAEELGGVGLAGSVADPAHPRELTELALAAFGRLDVVVNNAATNEPYGPLMDADPDRWREAFTINVEAPLRLVQCAWRAWMGEHGGAVVNICTEGAGHVGPNVGAYGTTKAALLHLTRQLAGELAPKVRVNSVSPGLVRTELARFVWEHGEDELAAGLPLGRIGHPADIARAVVWLASDAAEWITGADLLVDGGTRVRTAYSADGYAVQERLRSYAPPHS

SEQ ID NO: 21819 - protein, 251 aa, Streptomyces avermitilis MA-4680
MTDFEGLKALVTGGASGIGRATAELLAARGAQVAVLDLDPSGVDKPLFGHRADVTDDSSVREAVAAAVSDLGGLDVLINNAGIGAQGTVEDNDDAQWHRVLDVNVLGIVRTTRAALPLLRASAHAAIVNTCSIAATAGLPQRALYSASKGAVLALTLAMAADHVREGIRVNCVNPGTVDTPWVGRLLDAAPDPAAERAALEARQPTGRLVSAAEVAGAIAYLAGPLSDATTGTALAVDGGMQGLRLRPVGQ

SEQ ID NO: 21820 - protein, 408 aa, Streptomyces avermitilis MA-4680
MTVPTPAVRDRIRTLAPGELPAYVYDLAELRAHAAGVRAALPERVELYYAAKANPEPEILAALAPYVDGYEVASGGELAHVAQAVPGRPLAFGGPGKTPDEVAAALAGGVQRFHVESEYELHMLAEQARRVTPGTRVAVLPRFNLPVRDGSLAGSALAMGGRPTPFGLDPAQAGTVLRLLTDGTYPHLELRGVHAHLASGLEAPEQLAVAETVVGWATDMAGEHGVGLGEVNVGGGMTVDYAAPERRFDWVTYGKGLARLAHAHPELTLRIEPGRALTAYCGWYATEVLDVKRSHGEEFAVVRGGTHHLRTPATKGHDQPCSVLPVDGWPHPWPRPAAEAERVTLTGQLCTPKDVLARQVPAGGLRAGDRVAFALAGAYAWNISHHDFLMHPRPGFHFLLPDRGDGEP

SEQ ID NO: 21821 - protein, 321 aa, Streptomyces avermitilis MA-4680
MSNLDREAVPTLCGGRGFVVAEPVRELLSPRKVKLGESTEVRRLLPNLGRRMVGAWCFVDHYGPDDIADEPGMQVPPHPHMGLQTVSWLHEGEVLHRDSTGSLQTIRPRELGLMTSGRAISHSEESPKSHARFLHGAQLWVALPDSHRHTDPRFEHHAELPVVTAPGLQATLILGEVDGATSPGTTFTPIVGADLSLASGADVRLPLEPDFEYAVLSMSGEAHVDGVPVLPGSMLYLGCGRSELPLRAESDAGLMLLGGEPFEEELVMWWNFIGRSNEDIAQARSDWMAGSRFGEVVGYDGAPLRAPELPPVPLKPRGRVR

SEQ ID NO: 21822 - protein, 124 aa, Gossypium herbaceum
IEKVVSSIKAMKPKIVTVVEQEANHNGPVFLDRFTEALHYYSTLFDSLEGSGVAPPSQDLAMSELYLGRQICNVVACEGMDRVERHEPLTQWRTRMETAGFSPVHLGSNAYKQASMLLALFASG

SEQ ID NO: 21823 - protein, 124 aa, Gossypium barbadense
IEKVVSSIKAMKPKIVTVVEQEANHNGPVFLDRFTEALHYYSTLFDSLEGSGVAPASQDLAMSELYLGRQICNVVACEGMDRVERHEPLTQWRTRMETAGFSTVHLGSNAYKQASMLLALFASG

SEQ ID NO: 21824 - protein, 124 aa, Gossypioides kirkii
IEKVVSSIKAMKPKIVTVVEQEANHNGPVFLDRFTEALHYYSTLFDSLEGSGVAPPSQDLAMSELYLGRQICNVVACEGMDRVERHEPLTQWRTRMETAGFSPVHLGSNAYKQASMLLALFAGG

SEQ ID NO: 21825 - protein, 90 aa, Gossypium herbaceum
TKFSQPRSGNSSGAGLGLAICRRFVNLMGGHIWIESEGLDKGCTVTFLVKLGICSNPDDSAIHQASSQVRAYHGSADLSGQKPILRDHGH

SEQ ID NO: 21826 - protein, 90 aa, Gossypium raimondii
TKFAQPRSGNSSGAGLGLAICRRFVNLMGGHIWIESEGLDKGCTVTFLVKLGICSNPDDSAIHQASSQVRAYHGSADLSGQKPILRDHGH

SEQ ID NO: 21827 - protein, 90 aa, Gossypium barbadense
TKFAQPQSGNSGGAGLGLAICRRFVNLMGGHIWIESEGLDKGCAVTFLVKLGICSNPDDSAIHQASSQVRAYHGSAHLSGQKPILRDHGH

SEQ ID NO: 21828 - protein, 90 aa, Gossypioides kirkii
TKFAQPRSGNSSGAGLGLAICRRFVNLMGGHIWIESEGLDKGCTVTFLVKLGICSNPDDSAIHQASSQVRAYHGSADLSGQKPVLRDHGH

SEQ ID NO: 21829 - protein, 508 aa, Oryza sativa (japonica cultivar-group)
MQMQQRRKPPPAAAPVAAKQPSPRRTPGPLSFAGALLSLLVVATFLYINDHGNMMPPHASPDPDLRLLQEAAHQKVNSILLSRHAPAPPPRTNTNTSSSDQHLRLINIPMSSDLDLELGGNSTSSSGVEIQFEQQQQQEEKNLRGCELYKGRWVYDAAGREAPLYRESECGFLTEQVTCMRNGRRDDSYQRWRWQPEGCDLPSFDARALLERLRNKRMMFVGDSLNRNQWESMVCLVQSAIPYGQKTLTKFVNNGSLNVFRAHEYNATVEFYWAPFLVQSNSDDPQVHSVRDRVIAWRSIAKHAANWKGVHYLVFNTYIWWLNNFQIKVLKSRGAPFAGSGGWSSRYALVDRAIAYREVLKTWAKWVDRRIDPNKTHVFFMAMSPNHFMPEAWGGSAGAVKCAMETQPIVNRTSGGLDIGTDWRLHGVARGVLRSMRRVGVRFVDITALSELRKDAHTSVHTLRQGKLLTPEQQADPRTYADCIHWCLPGLPDTWNHFLYAHIVAHAA

SEQ ID NO: 21830 - protein, 134 aa, Oryza sativa (japonica cultivar-group)
MAGRGKAIGSSAAKKATSRSSKAGLQFPVGRIARFLKAGKYAERVGAGAPVYLAAVLEYLAAEVLELAGNAARDNKKTRIVPRHIQLAVRNDEELSRLLGAVTIANGGVMPNIHNLLLPKKAGSSAKAAAADDE

SEQ ID NO: 21831 - protein, 433 aa, Aeromonas hydrophila [sequence omitted]

SEQ ID NO: 21832 - protein, 432 aa, Enterococcus hirae
MSIITDVYAREILDSRGNPTIEVEVYTESGAFGRGMVPSGASTGEYEAVELRDGDKARYGGKGVTKAVDNVNNIIAEAIIGYDVRDQMAIDKAMIALDGTPNKGKLGANAILGVSIAVARAAADYLEVPLYHYLGGFNTKVLPTPMMNIINGGSHADNSIDFQEFMIMPVGAPTFKEALRMGAEVFHALAAILKSRGLATSVGDEGGFAPNLGSNEEGFEVIIEAIEKAGYVPGKDVVLAMDAASSEFYDKEKGVYVLADSGEGEKTTDEMIKFYEELVSKYPIISIEDGLDENDWDGFKKLTDVLGDKVQLVGDDLFVTNTQKLSEGIEKGIANSILIKVNQIGTLTETFEAIEMAKEAGYTAVVSHRSGETEDSTISDIAVATNAGQIKTGSLSRTDRIAKYNQLLRIEDQLGEVAEYKGLKSFYNLKAA

SEQ ID NO: 21833 - protein, 429 aa, Bacteroides fragilis [sequence omitted]

SEQ ID NO: 21834 - protein, 422 aa, Bartonella henselae [sequence omitted]

SEQ ID NO: 21835 - protein, 440 aa, Schizosaccharomyces pombe [sequence omitted]

SEQ ID NO: 21836 - protein, 546 aa, Chlamydophila caviae GPIC
MQSSEMKPFSRLRAYFCPIYRSEFPKFIPLFWLAFFVGFNYCLLKSMKDTLVVVGSDAGAEVIPFLKVWGIVPGAVIVTMIYGWLSSRCPRDTVFYSFIGTFLGFFFLFAVVIYPMGDALHLHSLADRLQELLPKGLRGFIVMIRYWSYSLYYVMSELWSSVVLSTLFWGLANEVTSVREAGRFYALINTGLNLSSVFAGEISYWMGKHSFFIYPFVKDKWHEVMMNLTILIVLAGLCMIWLYRKVHFLTQHTYNFSTAFAPSEAPPQVEESVASVKAKKKTKTKAKSLFLYLIRSRYLLGLAIIVLSYNLVIHLFEVVWKDQVSQIYSSHVEFNSYMSRITTLIGIVSVCAAIFLTGQSIRKWGWTVGALTTPIVMLVTGVLFFAAVFAVKRDVMIFGGFFNMAPLAIAAWIGGMQNVFSRAAKFTFFDQTKEMAFIPLPNDQKNYGKAAIDGVVSRIGKSGGSLIYQGLLIIFSSVAASLNVIAVVLLLIMVVWIAVVAFIGREYNIKEASAVAESSKADAIASNATISRTTVENSNKEEVATL

SEQ ID NO: 21837 - protein, 644 aa, Chlamydophila caviae GPIC
MTSQVSSILSQISSPTDLKKFSLAELSLLAEQMRHKIISVLTNTGGHLASNLGIIELTIALHYVFSSTEDKFIFDVGHQAYPHKLLTGRNTEEFDRIRHDGGLSGFTSPSESIHDLFFSGHAGNALSLALGMAKATEDSRTHILPILGDAAFSCGLTLEALNNISSNLSKFIVVLNDNNMSISQNVGVMSKNLSRWIHHPKFNLFSRKIEKWLTKIPRYGNSISRRSHKLSICLKSLFCPIPIFEQFNLAYMGPVDGHDIKRLISVFQTARDLPFPVLIHVYTTKGKGLEIAQENPEKYHGVTANFNSSKENKFLPTIKPQLTYPDIFGQTVCTLGEAFPNLHIVTPAMSLGSRLEAFKEKFPNRFIDVGIAEGHAVTFSAGIAKAKSPVICSIYSTFLHRALDNVFHDVCLQGLPVILAIDRAGLAYGDGCSHHGIYDLSFLRAMPNMVICQPRSAVVFQQLLQSSLQWNMPVAIRYPNIAATQRDPIATDVHMHRDPGVGEILSQGEDVLILGLGHMCNTALSIKLQLLTHGISATVVDPVFVKPFDNNLFSILLMHHSKVIIIEEHSIRGGLASEFNDFLATYSFKVDVLHFGIPDAFFAHGDKESLLKRVGLDTESMVKRILTHFNFRTKTSPSNKLSIV

SEQ ID NO: 21838 - protein, 257 aa, Chlamydophila caviae GPIC
MKTQNTQNISEIWELYWETQEIEYRDTLIDFYLHLVKCVVHRLISGMPSHVKTEDLYASGVEGLVRAVERFDPEKSRRFEGYALFLIKAAIIDDLRKQDWVPRSVHQKANKLSEAMDTLRQSLGREPTDGDLCEYFQISQQELSGWFISARPALIISLNEERPSLSDGESGVALEERIPDERAETGYDIVDKKEFSSFLANAIEGLEEKERKVMALYYYEELVLKEIGKILGVSESRVSQIHSKALIKLRAALSAFI

SEQ ID NO: 21839 - protein, 533 aa, Chlamydophila caviae GPIC
MTQTAEKPFGKLRSFLWPIHMHELKKVLPMFLMFFCIAFNYTVLRDTKDTLIVTAPGSGAEAIPFIKLWLVVPCAVVFMLIYAKLSNILSKPALFYTVITPFLLFFALFPTVIYPFRHILHPTDFADKLQTILPQGLMGCVAMLRNWTFAAFYVLSELWGSVMLSLMFWGFANEITKISEAKRFYALFGVGANIALLASGRSIIWASKLRASATGNTDPWGLSLYLLMSMVILSGGVIILCYWWMNKCVLTDPRFYDPKELNKSKKSKPKMSMKESFAYLARSPYMLLLALLVICYGVCINLVEVTWKSQLKMQYPNANEYSQFMGNFSFWTGVVSVIVMLFVGGNVIRKFGWLTGALVTPVMVLLTGVLFFALVIFRDQASGIVATLGTTPLMLAVMVGAIQNILSKSTKYALFDATKEMAYIPLDQEQKVKGKAAIDVVAARFGKSGGSLIQQSLLVVCGSIGAMTPYLAIALFLIIAVWLVSATKLNKLFLIQSAIKEQELAGEEAAAASEVASSSTTIQGTPAVENASS

SEQ ID NO: 21840 - protein, 379 aa, Chlamydophila caviae GPIC
MKHLAILGSTGSIGQQTLKIIRSLPHLFKVVALASYGNNKDVFFEQIREFSPSIVSVYDEQSYFEISKEFPNIEVFLGEEGLLAAATAGEVDTIVAASSGVVALPAIIEAMKLGKTLALANKEVLVSAGEIIKEIAKQYQTRILPIDSEHNALYQCLEGKNTSEVKKLVLTASGGPLLYKSKEDLSRVTIRDVLKHPIWNMGAKITVDSSTLVNKGLEIIEAYWLFGLENAEIDAVVHPQSLIHGMVEFQDGTVLSVMNPPSMLFPIQHALTAPKRYPAPHKGIDFSVKQTLEFFPVDEERFPSIGLARQVLREKGSSGPFLNAANEVLVQRFLTEEIAWCDILDKLTRLMENYRVSSCSSLDDVFAVDKEARALAQEI

SEQ ID NO: 21841 - protein, 248 aa, Chlamydophila caviae GPIC
MNNVLLGKKAIVTGGSRGIGFAIAKLFIEQGADIEIWGINDEGGKKAAEELSRIGRPATFAKVDVSNNESVKDAAQNFISAHGSVDILVNNAGITRDNLLMRMSEEEWSSVINTNLNSLYYVCSAVIRSMIKARSGSIINISSIVGLMGSPGQTNYAAAKAGIIGFSRALAKEVAARNVRVNCIAPGCIDTDMTKVLNDNLKTEWLKNVPMGRMGSPEEIANAALFLASPLSSYVTSQVLSVDGGMAY

SEQ ID NO: 21842 - protein, 357 aa, Chlamydophila caviae GPIC
MREALTFDDVLLVPQYSEVLPQDTCLASSVSESLSLTIPILSAAMDSVTELSMATAMSVAGGLGIVHKNMDVNAQVAVVKQIKSQSASSVVGGAVGIGQQGLERAEALVEAGIDALVVDTAHGHSKLVLDTAFTLKKNYPVTLIVGNIVSKAAALCLAEIGVDAVKVGIGPGSICTTRIISGVGLPQLTAIMDVSEALRDSSVRVIADGGMRYSGDIVKALAAGAHCVMLGSMLAGTDEAPGEIVQINERAYKMYRGMGSLGAMKKGSAERYFQESNAKKFVPEGVEGLVPYKGSLHDVLYQILGGIRSGMGYLGARNLEELRQNAVFSRITHSGRSESHIHNLQHIQHAPNYLISK

SEQ ID NO: 21843 - protein, 157 aa, Chlamydophila caviae GPIC
MDIEKDIFFMNQALKEARQAYDQDEVPVGCVIVKDNKIIARGHNTTEKFQDPTAHAEILCIGAAAQYLENWRLVDTVLYCTLEPCLMCAGAIQLARIRRIVWAAPDLRLGAGGSWINVFTAKHPFHQVECFSGICREESEQLMKQFFIEKRKEKNEK

SEQ ID NO: 21844 - protein, 301 aa, Chlamydophila caviae GPIC
MSIFLVFFTAFIWSSSFAFSKLAMEVSAPLFVTGSRMLVAGLVLAAIVLWKKGSLKLPKQVYVPVLILALVGFYLTNVCEFVGLQNLSSSKACFIYGLSPFISALFSYIQLRETVTVKKIAGLSLGLVGYLFYLFFGGSNSTETWSWQLGVPELLLLLATCLSAFGWTLLRKIEKNSSLSVMAINAYAMLISGVLSLGHSMVVETWNPIPVSNGVVFVQAVFCLVLFSNLISYNLYAKLLRKYSSTFLSFCNLVMPLFSAFYGWLLLGESLSGSLLMAVVFMVVGCRLIYHEEFRQGYIVS

SEQ ID NO: 21845 - protein, 424 aa, Chlamydophila caviae GPIC [sequence omitted]

SEQ ID NO: 21846 - protein, 572 aa, Chlamydophila caviae GPIC
MLMNTQNGQATEAAHEEEAQKKLEELVSLAKDQGFITYEEINEILPMSFDTPEQIDQVLIFLTGMDIQVLNQADVERQKERKKEAKELEGLAKRTEGTPDDPVRMYLKEMGTVPLLTREEEVEISKRIEKAQVQIERIILRFRYSSKEAISIAQYLINGKERFDKIISEKEVEDKAHFLKLLPKLVTLLKEEDLYLESLLLALKQGNLSKQEIAKLNDNLEKCRIRTQAYLRCFHCRHNVTEDFGEVVFKAYDSFLQLEQQINDLKVRAERNKFAAAKLDAAKRRLHKREVAAGRTLEEFKKDVRMLQRWMDKSQEAKKEMVESNLRLVISIAKKYTNRGLSFLDLIQEGNMGLMKAVEKFEYRRGYKFSTYATWWIRQAVTRAIADQARTIRIPVHMIETINKVLRGAKKLMMETGKEPTPEELAEELGLTPDRVREIYKIAQHPISLQAEVGEGGESSFGDFLEDTGVESPAEATGYSMLKDKMKEVLKTLTDRERFVLIHRFGLLDGKPKTLEEVGSAFNVTRERIRQIEAKALRKMRHPIRSKQLRAFLDLLEEEKTTSGKAKNFKGK

SEQ ID NO: 21847 - protein, 752 aa, Homo sapiens
MSSRTVLAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTSQKYNEVTATYLLLGRKTEEGGDRGAPGLALARVRAPSDTTNGTSSSKGTSHSKGQRSSSSTYHRQRRHSDFCGPSPAPLHPKRSPTSTGEAELKEERLPGRKASCSTAGSGSRGLPPSSPMVSSAHNPNKAEIPERRKDSTSTPNNLPPSMMTRRNTYVCTERPGAERPSLLPNGKENSSGTPRVPPASPSSHSLAPPSGERSRLARGSTIRSTFHGGQVRDRRAGGGGGGGVQNGPPASPTLAHEAAPLPAGRPRPTTNLFTKLTSKLTRRVADEPERIGGPEVTSCHLPWDQTETAPRLLRFPWSVKLTSSRPPEALMAALRQATAAARCRCRQPQPFLLACLHGGAGGPEPLSHFEVEVCQLPRPGLRGVLFRRVAGTALAFRTLVTRISNDLEL

SEQ ID NO: 21848 - protein, 187 aa, Mus musculus
MAADISQWAGPLCLQEVDEPPQHALRVDYAGVTVDELGKVLTPTQVMNRPSSISWDGLDPGKLYTLVLTDPDAPSRKDPKFREWHHFLVVNMKGNDISSGTVLSDYVGSGPPSGTGLHRYVWLVYEQEQPLSCDEPILSNKSGDNRGKFKVETFRKKYNLGAPVAGTCYQAEWDDYVPKLYEQLSGK

SEQ ID NO: 21849 - protein, 219 aa, Schistosoma japonicum
MSRYSQSQRLNLGTIFNFRDLDKNVQVHLKNVYSTLSVGLIISCVGAYLFQINSFLQSMVTSLMILSFIISLGSSLFIYFTQHSRETLHSRLGAFFLFSFSTGIGFGPLFQVLSIISPDTIPTALLGTALIFVSFTLAALFTRKRYYIYLGAALMSAVSLLTTFSFMNLFIRSPAIYEAELYIGLAIFCAFVVFDTQLIVEKRRNGDTDFCVAHIGFIY

SEQ ID NO: 21850 - protein, 163 aa, Schistosoma japonicum
MPSIKLASSDGEVFDIDVAIAKQSVTIKTMLDDLGIEEQGDEEPVPLPNVNAGILRKVIQWCTYHKDDPPPQEDDENKERRTDDIPSWDQEFLRVDQGTLFELMLAANYLDIRGLLDVCCKTVANMIKGKTPEEIRKTFNIKCDFTPQEEEQVKKENEWCEEK

SEQ ID NO: 21851 - protein, 196 aa, Schistosoma japonicum
MAEKAEDLYLPNAVLLRIIRESLPERTLVSREARSAISKSASSFILYVTSLASVHSEKAKRKTLTGNDILAALKEMEFDHFIPALKEFLDKYREQVVAKKTTKRMQNESEEDTSVNKLPKIASTSSTSNSKFLDNDPKVVDSLDVDDNSIVAEDDDEEDEKEQEAEEEENENVDVEVANEEAKAMNTTHPEVDDIT

SEQ ID NO: 21852 - protein, 300 aa, Schistosoma japonicum
MGNQLFNSCQYSEAVQCYTSAINQQPSISSYYSNRALCYIQMQEYSKVLSDCRKAIDLDRNNLKAHFFAGQAYLGLNQYEEALAKLVHAHNLALEQHRNFGDDITSVIRLARRKRFEAMDEDRKKEEISLQAYLNKLIVEDAARQKQAIFHKTSNRTSDSLSNVKSTEGVSLDSLSDEDIKNVENISPQHQEIISKIDSTAQKYIAELNELFCKVDERREKREIPDYLCGRISFDLMRDPVITPCGITYDRPSIISHLRQVGHFDPVSRQPLVEDQLVPNLSMREVVQAFLNENPWAETF

SEQ ID NO: 21853 - protein, 221 aa, Schistosoma japonicum
METPATSSTSKSDIPKTSKASGSSIDRPNQPNTSDKTSDNNGTTGSFECNICLDSARDAVVSMCGHLFCWPCLHRWLETSESRTVCPVCKAAISSDKVIPLYGRGADHTQDPRTKIPPRPAGRRTEPEPGIGSLGSTWGGLFGGSDGGNFRMSVGIGAFPFGFLSTTFNLGSNGSSGNSHNANGINNRGIPPDNFWGADSETMSKICLFIAIFFIGWLLIA

SEQ ID NO: 21854 - protein, 128 aa, Schistosoma japonicum
MTERAKTKAKPRRRQRHVHPVPGLQFPVARVHRLLRKGNYAERVGAGAPVYLAAVLEYLTAEILELAGNAARDNKKTRIIPRHLQLAVRNDEELNKLLGGVTIAQGGVLPNIQAVLLPKKTEKAVKAK

SEQ ID NO: 21855 - protein, 156 aa, Schistosoma japonicum
MSGRGKARKAAGGKKHTKSNRAGLVISVSRVHRYMKKGRYARRTSIAASVYMSAVIEYLVAEVNELSGNAAKANKRKTITPRHIMLGVRNDAELNELLKHVHISHGGVLPCIHPALLKRKGVLTNSPGQGGAAISGTGLSSRQASSGIASSAMVAS

SEQ ID NO: 21856 - protein, 216 aa, Schistosoma japonicum
MSSSDEISWISWFCGLRGNEFFCEVQEDYIQDRFNLTGLSEQVPEYRDALDMILDLETDTSDNPENTDLIEQAAEMLYGLIHSRFILTNRGICFMVAKWQHGDFGYCPRVYCESQPCLPIGLSDVPGEATVKIYCPKCQDVYTPKSTRHHHTDGAYFGTGFPHMLFLVHPDYRPKRATKQFTARLFGFKIHPLVINYNIKRANYVMPDDRFPKGHE

SEQ ID NO: 21857 - protein, 225 aa, Schistosoma japonicum
MGAVSQTNCNFAGSHVGVSIGEDGPSQMGLEDLAMFRTVINSTVFYPSDAVATERAVELAANTMGICYIRTGRPNQPVIYSPEESFCIGKGKVVRTAGSTGDHLTVVASGITLTEALKAADILASENINIRVIDPFTIKPIDNELLAKAVNETSSKVLTVEDHVPEGGIGDAVSEALSHWGVEHTVHRLAIKEVPRSGKPEELLAKYGVDSSAIIHAVKALLGKK

SEQ ID NO: 21858 - protein, 313 aa, Schistosoma japonicum
MGRRNSENNDRRTEQFRKLFIGGLTPLTTEAKLKDFYSQWGEIVDVVVMKDGRTNRSRGFGFITYKEPEMVDAAQANRPHEIDGKTVEAKRAMPREDSNSPESHMTVTKLFVGGLKKDVTHEELREYFSKYGNITECEVVAWKESGESRGFGFVTFDDYDPVDKAILYKPHHIGSSRADVKKALSKEQINTMKKKQESRIDYNNNYGGGGYGPMGGGYGGYEGGYGGSYGGGPYGGYGSNGGGSGGAYGGGNYGGGWGPNHMNGDGPGWGQGGMGDGFGHYGNQQNYAGGPMRGGPPGGYQRNAPYGGGYGRR

SEQ ID NO: 21859 - protein, 299 aa, Schistosoma japonicum
MAIVKLVKNKAYFKRFQVKFKRRREGKTDYYARKRLIWQDKNKYNTPKYRLVVRFTNKDIICQIIYARIDGDRVLCSAYAHELPRYGVKVGLTNYAAAYCTGLLCARRVLKQLGLDGLYAGAEKVDGQEYHVESVGGNKSPFRCHLDVGLARTSSGANIFGALKGAVDGGLDIPYSPSRFPGYNQESKEYKPEVHRARILGHHVAEYMKQLQEENESDYQRQFSKYIKHGITADKIEEMYLSAHAAIRSDPSHIAHEKKEIQPKRFNRKKMSYKQKKERVRQKKALYLSQLKKEIAAVE

SEQ ID NO: 21860 - protein, 304 aa, Schistosoma japonicum
MVRLSRSEWKAGYFKKLEKHLSEFDKCFIVNVDNVRSKQMQQIRMALRGNAELVLGKNTLMRKVIQKQMNQDSNLEKILPHIRDNVGFVFTNGDLSEVRKTIENNRVEAPAKAGAIAPCDVVVPAQNTGLGPEKTAFFQALSIPTKIARGAIEIINDVHLVRKDEKVGMSEATLLGMLKIHPFSYGLVIKQIFDQGCVYDPAVLDITPEMIIEKFAAAVRNIACLSLALDYTTLCSLPHVFANGFKNLLAISLMTDYSFKEAEKIKEFMEDPSKFTAVTTQVAAEVPATSAKVVETSAPAEGSI

SEQ ID NO: 21861 - protein, 294 aa, Schistosoma japonicum
MPGINCLDISRMSPERIVTGGNDKTAVVFDLSTAQVISILKGHNKKVTQVVYHPSEELVFTGSPDTSLRVWGVEQGQCASIIRAHKGPVTGLSIHATGDYLLSCSSDGQWAFSDLRHGRVLVRISAVDKSGNIQALTCSQFHPDGLILGTGTADGEVKIWDVKERRNVANFAHGSGVNQPVTAVAFSENGYYLATSGADSQVKLWDLRKLKNFKTLIPGEDQPSSYEINDVEFDQSGSYLAIAGTDVRVYLCKQWDQLISFNAHTAPATGVRFGENATTVISASRDRSVKVFGT

SEQ ID NO: 21862 - protein, 267 aa, Schistosoma japonicum
MDFVRPGIKDIKHVLVVTSGKGGVGKSTIAAQVAINLWNNKFRVGVLDIDFCGPSIPRILGLENSKIHTCAEGWLPVYADGQTRRFAVMSIGFLLDNPDSSVIWRGPRKGSMVGEFLNSVCWGNIDYLIIDTPPGTSDEHITVLEHLQKFTSNVDVGIIIVSTPQRVSLCDVRREIGFCIKTNIKVIGLIENMSGYVCPNCTQCTNVFSYGGAEALAVEKNVQFLGRLPIDPGLTVACDRAGDFESKIYTSENTRRLTEKILSVLSI

SEQ ID NO: 21863 - protein, 113 aa, Schistosoma japonicum
MSGVYRALVSVVDKRVPTGLKPIWDHPAGPKTIFFWAPTFKWLLVIAGLADINRPVQNVSLYQSAALAATGLIWSRYSMVIIPKNYNLLSVNAFVALTGLYQLARIAKHEYAK

SEQ ID NO: 21864 - protein, 176 aa, Schistosoma japonicum
MAEEKGKPKGRMNAYALFLQSMRADHKKKHPNATLDFKSFSKECSEQWKNLSAKEKKKFKDLAEKDKERYRCEMEHYEPPADEGRSKKRKRDPDAPKKGLSAFFLFCNDERPKVKSENPDWKVSEVAKELGRRWEHCKNKAKYESLAQVEKERYEKAMEKYKAGKKPKTEDSESDD

SEQ ID NO: 21865 - protein, 134 aa, Schistosoma japonicum
MLDDLGIEEQGDEEPVPLPNVNAGILRKVIQWCTYHKDDPPPQEDDENKERRTDDIPSWDQEFLRVDQGTLFELMLAANYLDIRGLLDVCCKTVANMIKGKTPEEIRKTFNIKCDFTPQEEEQVKKENEWCEEK

SEQ ID NO: 21866 - protein, 169 aa, Schistosoma japonicum
MAARYRDVGTKVYIGDLPREASERELERIFREYGRLRNVWVARNPPGFAFVEFEDAADASDAVRELDGTVMCGVRARVELSTGKSRQKPWVRGGARNGGGRDNGPGSRRMKPFDPADRCYECGERGHYAYDCRRRGGGPGGQNGRSRPDGRRRSRSVSNHRSFSRSRSR

SEQ ID NO: 21867 - protein, 200 aa, Schistosoma japonicum
MRTIDVSVRSTAEPLLSPNVAGFVCGGISGTVSRTVTAPMDRLKVLRQMDTPEIAGKDMIASLRILIKEGGILSLWRGNGVNILKNCPESAIRFGLHGWLKSVIFPNVKGPLSPKDRLLVASLAGATSLTITYPVEILKTRMALRRSHETNSILSVIRILYTEGSLRGFYRGYKISMMSYVPYSGIGGSYAFMRCLNNAM

SEQ ID NO: 21868 - protein, 219 aa, Schistosoma japonicum
MNGKNGEASGKITGSISTPCDSATESSDMTSKDYYFDSYAHFGIHEEMLKDEIRTLTYRSALIHNKHLVKDKVVLDVGCGTAILCLFAIKAGAKHAIGIECSNIIDRAVEVVRANNMSDRITLIKGKVEEVELPPEFPKVDIVISEWMGYCLFYESMLNTVIYARDKWLAPGGIIMPDRATLYVCAIEDRQYKDEKINWWDSVYGFDMSCIRKVALTDP

SEQ ID NO: 21869 - protein, 217 aa, Schistosoma japonicum
MSSSDEISWISWFCGLRGNEFFCEVDEDYIQDRFNLTGLSEQVPKYRDALDMILDLETDPSDNPENTDLVEQAAEMLYGLIHSRYILTNPGLNIMLAKWQHGDFGCCPRVYCESQPCLPIGSSDVPGEDTVKIYCPRCQDTYRPKSTRHHHTDGAYFGTGFPHMLVLVHPEYRPKRASKQFTARVYGFKIHPLAYQLQYQAAANYVMPVRPGFPKCT

SEQ ID NO: 21870 - protein, 246 aa, Schistosoma japonicum
MCDESWINKSKIQDRESLVALAKISDQSERYNDMACAMKKVVEMPSKLNNEERNLFSAAYKNVVGCRRSAWRIVSSIEQKLEEEKKKRATEYRTFIENELQSVCQEVLDILDKFLIKSDDAPEDIVFYRKMKGDYYRYLAEFQTGDKRAEAIKHSKEAYEAATAKATSDLPPTHPIRLGLALNFSVFYYEIENNPEKACTIAQNAFNESIELLDQPDSGSLKDSTLVMQLLRDNLTLWTSEREAAQ

SEQ ID NO: 21871 - protein, 561 aa, Trypanosoma cruzi
MLSLLFSFFSPSPSVRIGGVGGGGRSHVTVIVVVAAFLVLFWLLFCCHLCAFFLLSFFFFVSFFSLDAFPLPPLPISLCFLVELCACACISETFRALSMSDVFYLNIPRGRVPRGASGAASAAPTVSLHDPLSRAVSPASSNARWGVVPMVVGVLSVGCALSLAVRLWQYRQQCLSSIISGGGRVLRGEGGKPQLRRRPRRCSSLLNNARRDDTPLPQKEPVRLTTDERIPSPTAHLPEANDGCCDDDNRRNGLEWHSLDHQGEAGDEDFDTRTSSLNSPLVFVTTTGERYKRVSQLGRGGCGLVYKCFNLNTGQVVAVKEVRLEESTDGDRAEEMRSEFELLSRVSHPNIIRVIGCHVGKKHARLFLEWAAGGSLCDVMKAIDRSFASGLHEDLVQSYVRQILEALQCLHEHGIIHRDLKPQNLLIDHAGRLRVTDFGLSRLVAEGASAVETVVAGTPRYLAPEAISAGRFSCGSDLWAVGATMSELFTGRPPWSHLGVQQLPSLLYHIANNPEDHPVIPTHISKEAREFMAQCFRPEPGDRGTAAILLQHPFLTRERRE

SEQ ID NO: 21872 - protein, 298 aa, Homo sapiens [sequence omitted]

SEQ ID NO: 21873 - protein, 749 aa, Danio rerio
MDSNGVTDKKVLEGDRDLQFLMNGGDLLKVRSESWKKTRYFKLQEDCKTMWHESKKTLKTKQTFSIEDIEEVRTGRQTDSLRKYTEETLEGRAFSILFKGRQKSLDLIASTEEEAKKWVSGLEKVISSLNNLSSQKKTEHWIYSSLRKADKNLDNKMSLKEVKSFLKDINVEVHEDYAEMLFKECDKSNGGFLEGNEIEHFYKILTKREEIDVIYGEYAKTDGLMSANDLLNFLLTEQREEVSQNDALQLIEKYELDENAKAKQQMTQDGFLMYLHQPEGLIFNQAHKSVYHDMNQPLSHYFISSSHNTYLMEDQLKGPSSTEAYIKALLKGCRCVELDCWDGSDGEPVIYHGYTLTSKILFKDVIKAIKEYAFKTSEYPVILSLENHCGVEQQKIMAQHLTSILGSALVTKPLGDQMPTCLPAPEELKGRFIVKGKRLDKLENAFSDESKMADEESVSEEEDDEGDEENNEKKSGSLKLAKELSDIVIYCKSVPFHGLEDSREKHSFYEMASFKEGKALKLAEESATEYIRHNTDKLSRIYPGGMRTDSSNYNPVPMWNAGCQIVALNFQTPCLEMDLNQGLFYQNGRSGYILKPSYLRERDTEFDPITPTKGPWLKRKTLHVMVISAQQLPKVGKRESAIVDPIVKVQVYGVPADTAAVETSYIKNNGFNPMWNENFQLEVCVPDLALVRFLIEDYDSTSDNEFIGQYTLPFNSLRNGYHHVPLLTQDGNLLSSAGLFVHIMVVDTE

SEQ ID NO: 21874 - protein, 259 aa, Mus musculus
MLEERESKEPAMNPFQKNESKETLFSPVSTEEMLPGPPSPPKKSTPKLFGSSYPLSIAFIVVNEFCERFSYYGMKAVLTLYFLYFLHWNEDTSTSVYHAFSSLCYFTPILGAAIADSWLGKFKTIIYLSLVYVLGHVFKSLGAIPILGGKMLHTILSLVGLSLIALGTGGIKPCVAAFGGDQFEEEHAEARTRYFSVFYLSINAGSLISTFITPMLRGDVKCFGEDCYALAFGIPGLLMVLALGEWSGKGCEQPLIPAT

SEQ ID NO: 21875 - protein, 229 aa, Danio rerio
MDKSQHVQRAKLAEQAERYDDMADSMKKVTELGEELSDEERNLLSVAYKNVVGARRSAWRVVSSIEQKTEGTDKKQMAQEYREKIEAELKAICNDVLHLLDKFLIRSTSPAESQVFYLKMKGDYYRYLAEVATGDEKTNIIQKSQEGYQAAFDISKDNMQPTHPIRLGLALNFSVFYYEILNSPEQACDLAKKAFDDAISELDQLTEDSYKDSTLIMQLLRDNSDTVDL

SEQ ID NO: 21876 - protein, 478 aa, Danio rerio
MLKETLRLLFVWAVLESVCSRGCSSFFCRKTRRVSGSRFGADPGKPLMLTPYLEQGKIEEAKKLSLVGPLPGANVKSYSGYLTVNKTYNSNLFFWFFPAQERPETAPVLLWLQGGPGGTSMFGLFVEHGPYFVYKNLTLGYRHFPWTSRYSVLYIDNPVGTGWSFTEDDRGFAQNQDDVGRDLYSALTQFFQIFREFQSNPFYATGESYAGKYVPAIGYYIHRNNPSAKVKINFKGVAIGDGLCDPELMLGGYADFLYQTGLVDELQRQHVKMQTDAGVKLIQEQRWVEAFQVFDSLLNGDLVPYPSYFQNVTGCTNYFNYMQCQEPPDQEYFSSFVTLPEVRRSIHVGNLTFNDGSDVEKHLLQDVMKSIKPWLGVLMENYRVLIYSGQLDVIVAAPLTERFLPTVSWSGADEYKTAERFPWKVQPSDTEVAGYVRQVREFFQVIVRGGGHILPYDQPERSFDMIDRFLSTDGFTSH

SEQ ID NO: 21877 - protein, 524 aa, Emericella nidulans
MPPNFAGLSGRKLSLTVSTVATMGFLLFGYDQGVMSGIISDVAFNDVFTATKDDATMQALVTAVYELGCLAGAVYALMFGDRMGRRWMILSGAAVMILGVIIQVTSFPGHIPLLQFFIGRVITGIGNGMNTSTIPTYQAECSKTSNRGLLICIEGGIIAIGTAIAYWIDFGSHYGPPDLVWRFPIAFQIIFGIIIIVGMWFLPDSPRHLIAKGRIEEGEYVLAALNGCEVHDHETQIQKQLTLDSLRASGALGKKTSFRDLLTGGPSQHLRRMLVGSSSQVFQQLGGCNAVIYYLPVLLKSNLHQDNDQALLIGGINMIVYAVFATFSWFFIERIGRRKLFLGGSMVQTTAMIITFACLIPGDEQSSKGAVFGLFLYMAAFGATWLPLPWLYPAELSPVRTRAKANAVSTCNNWLFNFAVVMFTPPMVAAIGWGTYLFFAAWNAFFIPVIWFFYPETANRSLEEIDLIFAKGYHEKISYVRASHELPKLSDDEIEAEAAKYQYSPETEAEVEKGHVAHPGSTSE

SEQ ID NO: 21878 - protein, 509 aa, Rhodococcus ruber
MTGTLSRDSGTTNQVDERLGAAAREFLGRPHQLFIDGQWVDAADGRTFGTYDPATGAEITQVAHGGPEDVDRAVAAARRAFDDGDWATMKPNKREQILWRIGDLLDARGEMLGQIEALDNGKSAAIATAVDVTFAADVFRYYAGWCTKIEGTTVDVSMPFAGDKQFHAYTQRVPVGVCGQIIPWNFPLLMAAWKLAPALATGNTLVLKPAEQTPLTALLLGEIMAEAGVPDGVVNIITGFGDAGAAISAHDDVDKVAFTGSTEVGKLIVDAAKGNLKKVSLELGGKSANIVFADCDFDAAVAGSVAAWMFNHGQACTAGTRLYVEDSIYEKFTQAVADAAAQATIGHGLDPATELGPLVDQDQFDKVSYYLRAGIEDGGRALTGGGRHGDTGYFIQPTVFVDVEPDHRVVTDEIFGPVVAALRFSDMDDAVRQANDSIYGLAAGVWTKDISKAHKVASRLHAGSVWVNQYNGFDTAMPFGGFKQSGWGRELGKGALDLYTQTRSVNIQL

SEQ ID NO: 21879 - protein, 369 aa, Rhodococcus ruber
MKTKAAVLFDLHKPFEIIELELDDPGPGEVLIKYTAAGLCHSDLHLSDGSLPPRFPIVGGHEGAGIIEAVGVGVTKVKPGDHVVCSFIPNCGTCRYCSTGRQNLCDMGATILEGHMPDGTFRFHAGGKDFGAMCMLGTFSERSVISQHSVVKVDDWLPLDKAVLVGCGVPSGWGTATYAGNVRQGDTVVIYGIGGLGINAVQGAVHSGARHVVVVDPVQFKRDEALKFGATHAFADAAEAHAEVEKLTWGQMADQALILVGTVDEPVVSSAFDVIGKGGTVVITGLGNMTDKTVQVSGTMMALFGKTITGTVFGSANPQYDIVKLLRLYDEGKLKLDELITTTYTLDQVNEGYQDLQDGKIMRGVIIHD

SEQ ID NO: 21880 - protein, 363 aa, Xenopus laevis
MSTSPLPRKGYYTQEVNKTVWEVKERYRELLAVGSGAYGIVCSSLDTRTGTKVAIKKLYRPFQSELFAKRAYRELRLLKHMQHENVIGLLDVFTPDTNLDKFNDFYLVMPFMGTDLGKIMKHEKLSEDRIQFLVYQILRGLKYIHSAGIIHRDLKPGNLAVNEDCELKILDFGLARHTDSEMTGYVVTRWYRAPEVILNWMHYTQTVDIWSVGCIMAEMYTGRPLFKGNDHLNQLTEIMKITGTPTQDFVQKLQSTDAKNYIKSLPKVQKKDFGSLLRYANPLAVNILEKMLVLDAEKRITATEALAHAYFEQFHDIDDETEAEPYDDSFDNVNLPLEEWKRLTHEELTSFEPLVADSKETSV

SEQ ID NO: 21881 - protein, 419 aa, Rhodococcus ruber
AAERERMIWRVGDLLTQRAEEFGQLEALDNGKSAVIAAAVDTAWSADIFRYYAGWATKIEGSTVNVTMPFVPGGEFHAYTLREPVGVCGLIVPWNFPLLMAAFKLAPALAAGNTVILKPAEQTPLTALLLAEIFEEAGFPPGVVNIVPGFGDAGAALAAHDDVDKIAFTGSTEVGKKVVDAAKGNLKKVSLELGGKSPNIVFADADFDAAVQGSLDAWLFNHGQCCVAGTRLFVERPIFERFTEAVAEAASKVKIGPGLDPATQLGPLVSQEQLDRVTGYLREGLIDGARALTGGKRWGDKGFFVEPTVLVDVQPDFSVVREEIFGPVVNAMPFDADDGISAAANDSIYGLAAGIWTRDLSKAHRTARRLKAGSVWINQYNGFDTAMPFGGFKQSGWGRELGAGALDLYTQTKAVNIAL

SEQ ID NO: 21882 - protein, 370 aa, Rhodococcus ruber
MKTKAAVLLETGKPFEIMELDLDGPGPGEVLIKYTAAGLCHSDLHLTDGDLPPRFPIVGGHEGSGIIEEVGPGVTKVKPGDHVVCSFIPNCGTCRYCSTGRQNLCDMGATILEGCMPDGSFRFHSGSTDFGAMCMLGTFAERATISQHSVVKVDDWLPLETAVLVGCGVPSGWGTAVYAGDVRAGDIVVIYGIGGLGINAVQGAVHAGAKYVVVVDPVEFKRDTALKFGATHAFATAAEAAEKVNELSWGQGADAALILVGTVDEEVVSAATSIVGKGGTVVITGLANPEKLTVHVSGTELTLFQKTIKGSLFGSANPQYDIVRLLRLYDAGQLKLDELVTHRYSLEEVNQGYQDLRDGKNIRGVILHDA

SEQ ID NO: 21883 - protein, 375 aa, Rhodococcus ruber
MKTKGAILWGLNEPWSVEEIEIGDPVAGEVQIRMEAAGMCHSDHHIVTGATPMPSFPVMGGHEGSGVITKVGDGVVGLEVGDHVVLSFIPACGRCPSCATGHSNLCDLGAGLLSGMAISDGTYRIQARGQHVIPMCLLGTFSPYMTVNQTQVVKIDKDVPFELAALVGCGVPTGWGSATHVADVKPGEAVAVIGVGGVGISALQGAVASGARQIFAIDPVPWKREQALKFGATHALPRRWRALMPIMETTWGRMADKTIITVGEMRGEYVEEALQLTAKNGRCVVTAMGHMTDMDVKLNAFLFAMLQKDLQGNIFGGCNARVDIPNLLAMYKAGQLNLADMVTRTYTLEQVNDGYQDMLDGKNIRGVIRYTDADR

SEQ ID NO: 21884 - protein, 200 aa, Rhodococcus ruber
IVVEVGPEVRLVAQGDHVVFSFLAACGRCRWCAKGLQNLCDRGAAIMTGGRPDDPASFRLSLDGAPVTQTCGLSTFSEYATVSVDSAIKVDKDLPMDKLFLLGCGVGTGWGAAVNSAEVYPGQTVIVQGVGGIGINAVQGAAHAGSARIIAVDPVPFKRETALRFGATHAVADMAEATEIARSCTDGQGADAAIVTVGAM

SEQ ID NO: 21885 - protein, 296 aa, Rhodococcus ruber
VGRPVGPGVANIREGDHVVLAFIPACGRCRACAKGLQNICDEGANLLTGQAIADKTHRVTLNGDPVIQMCLLGTFAPYVTVHEASVIKIEDDFPLDKAALLGCGVATGWGSATAIGGTKVGDSVVVIGIGGVGINAVQGAAHAGARHVVAIDPVEFKRDQAKKFGATHTFASIEEALPVIGEITWGAMADVTIITVGEIHGDIIAPSMALTGKGGQVVVVGMGSAADTQVTLSLFELTLLQKRLQGAIFGGVGPRLQIPKLLDLYRSGQLELDKLVTKTYRLEDINDGYADMHEAR

SEQ ID NO: 21886 - protein, 303 aa, Rhodococcus sp. DS7
MKTKAAVLLEPGKPFEIMELDLDGPGVGEVLIKYTAAGLCHSDLHLTDGDLPPRYPIVGGHEGSGIIEEVGPGVTKVKPGDHVVCSFIPNCGTCRYCSTGRQNLCDMGATILEGSMPDGSFRFHGNGMDFGGMCMLGTFSERATISQHSVVKIDDWLPLETAVVVGCGVPSGWGTAVNAGNLRAGDTAVIYGIGGLGINAVQGAVSAGCKYVVVVDPVALKRETALKFGATHAFADAESAAAKVNELTWGQGADAALILVGTVDEDVVSAATAVIGKGGTVVITGLADPAKLTVHVSGTDLTL

SEQ ID NO: 21887 - protein, 415 aa, Oryza sativa (japonica cultivar-group)
MGQQAAEAQPLLLQGDQVDAEWGCRPHRIVLFVEPSPFAYISGYKNRFQNFIKHLREMGDEMLVVTTHKGAPEEFHGAKVIGSWSFPCPLYQNVPLSLALSPRIFSAVAKFKPDIIHATSPGVMVFGARFIAKMLSVPMVMSYHTHLPAYIPRYNLNWLLGPTWSLIRCLHRSADLTLVPSVAIAEDFETAKVVSANRVRLWNKGVDSESFHPKFRKHEMRIKLSGGEPEKPLIIHVGRFGREKNLDFLKRVMERLPGVRIAFVGDGPYRAELERMFTGMPAVFTGMLQGEELSQAYASGDLFAMPSESETLGQVVLESMASGVPVVAARAGGIPDIIPKDKEGKTSFLFTPGDLDECVRKIEQLLSSKVLRESIGRAAREEMEKCDWRAASKTIRNEHYCTATLYWRKKMGRTN

SEQ ID NO: 21888 - protein, 342 aa, Oryza sativa (japonica cultivar-group)
MAFFSHHHLQQPHPQAPPPPPPQQQQQPVPPSFRNALPVPVDGQIPAPLPFFNPPPAFQDQPAQPPLVDAMGLTAAAGLGWRQPREQELLGENSQMSSIDFLQTGSAVSTGLALSLEDRRHGGGSGAGAGNSSGDSPLLLLPMLDDDISREVQRLDADMDRFIKAQSERLRQSILEKVQAKQFEALASVEDKILRKIRDKEAEVENINKRNSELEDQIKQLAVEVGAWQQRAKYNESMINALKYNLEQVCAHQSKDFKEGCGDSEVDDTASCCNGGAANLQLMPKENRHSKDLTACRVCKSSEACMLLLPCRHLCLCKECESKLSFCPLCQSSKILGMEIYM

SEQ ID NO: 21889 - protein, 293 aa, Oryza sativa (japonica cultivar-group)
MAAAETSGTVAAPGRWSLHGKMALVTGGTRGIGRAVVEELAALGAAVHTCSRNEAELGERLKEWEARGFRVTISVCDLSARDQRERLIGDVADRFGGKLDILVNNVGTNIRKPTTEYSADEYSFLMATNLESAYHLCQLGHPLLKASGSGSIVFISSVAGIVALFSGTIYAMTKGAMNQLTKNLACEWAKDNIRTNCVAPGYILTSLSEGILANKEFEGSVKSRTPLRRVGEPAEISSLVAFLCMPGSTYITGQTIAVDGDAKKASPRTLQQNGVSNCPLRDAAAFCLDGHRP

SEQ ID NO: 21890 - protein, 308 aa, Oryza sativa (japonica cultivar-group)
MAEAVASGAAGRWTLRGKTALVTGGTRGIGYSPQHPSLVLPYRYPVRSETSTAEPLLLFHDQRGEFMRRHAVVDELAALGAAVHTCSRKEAELGERLREWEGKGFRVTGSVCDVSVREQRERMLREVAGLYGGKLDILVNNVGTNFSKQTTEYSADDYSFIMATNLESAYHLCQLAHPLLKSSGSGSVVFISSVSGVVAVSSGSVYAMTKGAMNQLAKNLACEWAKDNIRTNSVAPWYMKTSLVEDELARKDFADSVVRRTALKRVGEPEEVSSLVAFLCMPGASYITGQTISVDGGMTINGLYPTQD

SEQ ID NO: 21891 - protein, 311 aa, Oryza sativa (japonica cultivar-group)
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGVKLLLINHPDLSCLDTCHFKSEHVVKYSTNCQDTLLANKDFEGAVVSRTPLRRVGEPEEVSSLVAFLCMPGSSYITGQTISVDGGNRYKSSVSMMVLAEQ

SEQ ID NO: 21892 - protein, 74 aa, Blepharisma undulans
MGGKGGKGGKGLGKVGAKKRHRRVIRENIQGITKPAIRRLARRGGVKRLSGLVYDETRNVLKVFLEGVVRDAVT

SEQ ID NO: 21893 - protein, 72 aa, Colpidium campylum
MVGGKGGKGMGKVGAKRHAKRSNKASIEGITKPAIRRLARRGGVKRISSFIYDDSRQVLKSFLENVVRDAVT

SEQ ID NO: 21894 - protein, 73 aa, Obertrumia georgiana
MVGQGKGGKGMGKVGAKRHSRKSNKASIEGITKPAIRRLARRGGVKRISSFIYDDSRAVLKNFLENVVKDAVT

SEQ ID NO: 21895 - protein, 73 aa, Obertrumia georgiana
MVGQGKGGKGMGKVGAKRHSRKSNKASIEGITKPAIRRLARRGGVKRISSFIYDDTRAVLKNFLENVVKDAVT

SEQ ID NO: 21896 - protein, 73 aa, Obertrumia georgiana
MVGQGKGGKGMGKVGAKRHSRKSNKASIEGITKPAIRRLARRGGVKRTSSFIYDDTRAVLKNFLENVVKDAVT

SEQ ID NO: 21897 - protein, 78 aa, Colpoda cucullus
MVGQGKGGKAVGGKGVGKVGAKRRAGRSQKASIEGITKPAIRRLARRGGVKRISTFIYDDTRAVLKGFLENVVRDATT

SEQ ID NO: 21898 - protein, 75 aa, Prorodon teres
MAQGQGKGGKGMGKGGAAKRHARKSHKQNIEGITKPAIRRLARRGGVKRISSFIYDDTRAVLKSFLENVVRDSVT

SEQ ID NO: 21899 - protein, 73 aa, Prorodon teres
MAGQGKGGKGMGKVGTKRHARKTHKQSIEGITKPAIRRLARRGGVKRISSFIYDDTRAVLKSFLENVVRDSVT

SEQ ID NO: 21900 - protein, 428 aa, Trypanosoma cruzi
MLCYWKRRPSGPHVSPTGTIDLTNARFVENPKDPRSWTIEGDHLSKTFTLTADTEEQREAWVREMSKVKPENREQPSTAVQSSGDVHAVTLYTGGRHKVSLDDFELKATIGAGSFSNVFVAREKSTDKVYAIKEMGKELIQQHNMLSNIAAEKHILQTISHPFIVSLHYAFETKKCLYLVLDFLPGGELFFHLAKEKVFDEYRAKFYCGEIALAIGYLHSLDIIFRDLKPENIVLDEDGHACLTDFGLAKMNVSNASNFTFCGTTEYIAPEFLLGQPHGRAVDWWALGILLYEMTEGIPPFFNENSNEMYEEILKGELKFGDVGGEESGLPVVSENAKALLRRLLDRNPQTRLQDLEEFKKHPFFEDIDWEKLSRREIQPPFRPSSNILCNFDEDFTSKEPRAGFQEEDGGEHGNIACFSFDGQMGPA

SEQ ID NO: 21901 - protein, 484 aa, Saccharomyces cerevisiae
MADKIERHTFKVFNQDFSVDKRFQLIKEIGHGAYGIVCSARFAEAAEDTTVAIKKLTNVFSKTLLCKRSLRELKLLRHFRGHKNITCLYDMDIVFYPDGSINGLYLYEELMECDMHQIIKSGQPLTDAHYQSFTYQILCGLKYIHSADVLHRDLKPGNLLVNADCQLKICDFGLARGYSENPVENSQFLTEYVATRWYRAPEIMLSYQGYTKAIDVWSAGCILAEFLGGKPIFKGKDYVNQLNQILQVLGTPPDETLRRIGSKNVQDYIHQLGFIPKVPFVNLYPNANSQALDLLEQMLAFDPQKRITVDEALEHPYLSIWHDPADEPVCSEKFEFSFESVNDMEDLKQMVIQEVQDFRLFVRQPLLEEQRQLQLQQQQQQQQQQQQQQQQPSDVDNGNAAASEENYPKQMATSNSVAPQQESFGIHSQNLPRHDADFPPRPQESMMEMRPATGNTADIPPQNDNGSLLDLEKELEFGLDRKYF

SEQ ID NO: 21902 - protein, 131 aa, Drosophila heteroneura
EESLYECNICLDTAKDAVVSMCGHLFCWPCLHQWLLTRPNRKLCPVCKAAVDKDKVIPLYGRNSTRQEDPRNKVPPRPAGQRTEPEPAPGFPGFGFGDSFHMSFGIGAFPFGFFTSSLNFREPRPAAANRG

SEQ ID NO: 21903 - protein, 413 aa, Nicotiana tabacum
MPEKPLFGKYELGKLLGCGASAKVYHAREINNGQSVAIKMINKNNKDNIPNENIEREISILRQLRHPYIVKLYEVLATKSKIYFVMEYVKGGELFTKIADHGRFSEDLSRKYFQQLISALNYCHSRGIYHRDLKPENILIDENGDLKISDFGLSATTDQIQKFDGLLHTVCGSPAYVAPEILTIKGYDGAKTDIWSCGIILYVMIAGYLPFYDQNLMLMYKKIYKGEFKCPKWMSPDVIRILSRLLDTNPATRITIDEIIKDPWFRKGLKFIKFAGEEEDKYSLSSNCLNAFDLISFSQGLDISGLFKSNNPANDLERTVVEQSPESVIERVEEMAKKENFRLRKKKEWGIEMKVQNGKLTMSVDIYRLTERFVIVEVKREAGNGDLYTDLWRNKLKAVILGQQIAEIQDSGS

SEQ ID NO: 21904 - protein, 445 aa, Nicotiana tabacum
MISTWRKRRTEKRVAKRGLVEDITNMELVIPRHFTCPISLDLMKDPVTLSTGITYDRENIEKWIEAGNQTCPITNQTLRNGEPIPNHSIRKMIQQWCVENKDHGIERIPTPRIPVTSSEVVELLAKISKEIHDLELCGELVSKVKKLVNESERNKRCFVTNGTAQVLSAAFVAFSEEINMRNASTGEVILSTLTTILPLDGESKLNLGSISSLRCMVWFLKNGSLSSRRNAVFVLKDILKMEEQDKVEILLGMEGALEGLVKLVKEPICPTTTKASLLAIYHMVNSSHLSSSFANKKAQSRFVDLGLVELLVEMLVDCEKSICEKALGVLDGICSSIEGRKRAYSYALTVPVLVKKLLRVSDLATEFSVSILWKIGKNEKRENGGDVLVEALKLGAFQKLLLLLQVGCSETTKEKASELLKLLNVHRDRAECVDSLDFKSLKRPF

SEQ ID NO: 21905 - protein, 487 aa, Bacillus cereus ATCC 14579
MWESKFVKEGLTFDDVLLVPARSDILPREVSVKTVLSESLQLNIPLISAGMDTVTEADMAIAMARQGGLGIIHKNMSIEQQAEQVDKVKRSESGVISDPFFLTPEHQVYDAEHLMGKYRISGVPVVNNLDERKLVGIITNRDMRFIQDYSIKISDVMTKEQLITAPVGTTLEEAEKILQKYKIEKLPLVDNNGVLQGLITIKDIEKVIEFPNSAKDKQGRLLVGAAVGVTADAMLRIDALVKASVDAIVLDTAHGHSKGVIDKVKEVRAKYPSLNIIAGNVATAEATKALIEAGANVVKVGIGPGSICTTRVVAGVGVPQLTAVYDCATEARKHGIPVIADGGIKYSGDMVKALAAGAHVVMLGSMFAGVAESPGETEIYQGRQFKVYRGMGSVGAMEKGSKDRYFQEGNKKLVPEGIEGRVPYKGPLADTVHQLVGGLRAGMGYCGAQDLEFLRENAQFIRMSGAGLRESHPHHVQITKEAPNYSL

SEQ ID NO: 21906 - protein, 166 aa, Bacillus cereus ATCC 14579
MEQDQDIYFMQLAIEEAKKAEEIQEVPIGAVIVLDGEVISVAHNLRETEQRSIAHAELLAIDDACKKLGTWRLEDATLYVTLEPCPMCAGGIVLSRVKRVVYGASDPKGGCAGTLMNLLTDERFNHQCEVVSGVLEEECGTLLTNFFRELRKKRKAIKKLEKNAGN

SEQ ID NO: 21907 - protein, 221 aa, Bacillus cereus ATCC 14579
MFKRLREDIEVVFEQDPAARGYFEVILTYSGLHAVWAHRIAHAFYKKNFFFLARFVSQVSRFFTGIEIHPGATIGRRFFIDHGMGVVIGETCEIGDNVTIYQGVTLGGTGKEKGKRHPTIQDNVLIATGAKVLGSITVGENSKIGAGSVVLKEVPAHSTVVGIPGRVVIQNGVKIGQELNHSDLPDPIFDKLKAMEVELDKLKKQLELKVERKDKNDYSHL

SEQ ID NO: 21908 - protein, 355 aa, Bacillus cereus ATCC 14579
MVTKEQVVEALEGIVDPFLHKTLKETSAIKEVTVKPEKEHVSVKIAIVKTGTAEQMQLQSGIVKLVKELGAATVGLRFAEFTEEELAQFAPEQEEEQSESLLSPNSKTTFLAVASGKGGVGKSTVSVNLAVALARLGKKVGIIDADIYGFSVPDMMGIEKRPIVRGDKIIPVERLGVKVISMGFFVEDNAPVIWRGPMLGKMLNHFFTEVEWGDLDYLVLDLPPGTGDVALDVHSMLPSCKEIIVTTPHPTAAFVAARAGAMALRTEHSILGVVENMAYFESKVTGEKEYVFGKGGGDKLATELQTNVLGRIPLQQPDWNKEDFAPSVYEDTHTTGIIYSKIAETVIDKTAVTQK

SEQ ID NO: 21909 - protein, 277 aa, Bacillus cereus ATCC 14579
MILTNLKDYTTLHNGVKMPWFGLGVFKVEDGSEVIDSVKAAIKNGYRSIDTAAIYQNEEGVGQAIRESGVSREELFITSKVWNSDQGYETTLQAFETTLEKLGLEYLDLYLVHWPVKGKYTESWKALETLYKDGRVRAIGVSNFHIHHLQDVFEIAEIKPMVNQVEYHPRLAQEELHAFCKEHNIQLEAWSPLMQGQLLDNPTLQEIATKYNKSTAQIILRWDLQNEVVTIPKSIKEHRIIENANIFDFELSADDMKAIQALNEDRRVGPDPDNFNF

SEQ ID NO: 21910 - protein, 436 aa, Bacillus cereus ATCC 14579
MNIMQPSAPPHLESTETIFPSSITKLVVFICWLAILADGYDLGIYGAVLPKLLEDKSWALSPAHAGTIASYALLGMFIGAILVGTITDLIGRKWTLICCLALFSITMGLAAIAPSPELFGLSRFIGGIGLGGVIPTASALTVEYSPKKRQSFIYALMFTGYPLGIVLGAILSMLMLEDFGWRIMFGIGMIPLLLIPFIIRYLPESIQFLLSRNRQEEVNQILNRFQIEFHVKDKTHQDPSTIRKKNGFFTLFSKEYIKATLLFWITYIMGMFLIYGLNTWLPQMMRQAGYPLGSSLSFLLMLNITAAIGALFAGAIADRIGAKIVISISYLMAAICIGLLTIKPSVTIIYLLIGLAGIGSVGITQILNAYVTQYFPSHIRATSLGWGLGLGRVGAIAGPILVGIIMTMQYDLAWNFYLFSFAGLIAAISVFFIPTK

SEQ ID NO: 21911 - protein, 516 aa, Bacillus cereus ATCC 14579
MIKKENSVFYISFLLTTLFIIWGITPASWIQDYDLQSVTSSLNSFILNKFGWFYSLLMTTMIILAAYLAFSKYGSIRLGKDGEKPKYNYPSWLSMLFGAGMGIGLLFYGIAEPISHFTDPLTGKAGTEESAKLAMQYSFFHWGLFPWSLYAMVALTIAYFTFRKQKGSTIGATVTPLFNRSKNSRIGKTVDILAVLATVFGIVPSVGIGAQQIAGGLSYLFPSIHNTLLTQLVLIAIFAVLYLTSAQTGLDRGIKYLSNLNFSLAGILLISFLLLGPTVFIMKYFTSTLGSYIGALPSMGLNLGAFSEKSSSWIENWTIFYWGWWISWSPFVGTFIARISKGRTIKEFIFGVVLVPTLICTFWFAVFGGTAIHMEMFQSLGIADEIAKNGTEIGLFAVISHLPFSTFLTIIGLILVATFFVTSADSATFVVSMQTSNGSLSPKNSLKLIWGLTIAIIAAILLQAGGLNALQIAAIIAALPFSIVVVLMVISLFKELRKEDVNLQTKEVSQKIKKVM

SEQ ID NO: 21912 - protein, 463 aa, Bacillus cereus ATCC 14579
MKRISIQFGFYFLIVTLLIESVLFILLYYSLVNTRVNEEMTALLKRGNSHRDVLEKYYDEQTISHVALMESEAETTVVITNANKEILAKSNEINTTINDHISKMQTRTDHNGAIIENHWKTSNYICTVSPIVVDGKHEGYVYMFLGTESIEKLVNGLTKQFIIAGAITFLLTVITIFLLSRLLTKPLLHMKHATEKMSKGDLSVSLTTTRNDEIGELASSIQTLANDLHYMKTERSEFLASVAHELRTPLTYVRGYADIALKESTPSEQRLRYLSIIKDESDYITNLVQDLFSLAQMEQHNFSIQVKEVHLHTFLTRICEKVNAMYKERYIKVSFSCPPTLLVNLDEQRFEQVVVNILNNAYRHSKEHSHINISITEEHKRISITIEDEGEGIPLEDLPHIFDRFYRVDKARTRSTGGTGLGLSIVKEIVELHGGNITVTSEVDYGSCFIISLPSIKKHDYHQ

SEQ ID NO: 21913 - protein, 461 aa, Bacillus cereus ATCC 14579
MESAIQLEREQQRKKKHPPGLYLLFFTEMWERFSYYGLRGLLTLYLTTALVSGGLGFSPAWALSIYGFYTGACYFTPMIGGYLTDRFLGRRKAITIGGITMAIGNLTLFALQNQLGLYLGLALIIIGNGFFKPNISTLVGELYEENDPKRDSAFTIFYMGINVGSFLAPLVCGFLSENLFKTTVDGVVHYGFRYGFLAASIGMIIGQILFTTLSNRFLGNIGKKPTRDLQTAAGQPSVGDTPLTKKEKQRTAVIVILTCFVVFFWAGFEQAGSSLTLYTNKFVDRSVFGWEVPTSWFQSVNPLFIILLAPVISALWAKLATRKQGDLKIPTKMGLGMILLGIGYIILVIATLKTGSDEHNITEKANLLFIVFTYLFHTLGELFLSPVGLSMVSALAPVKLASLLMGVWLASSGIANILGGQLASFTTSLGYAEVFTVIGAVAIVLGCVLLLISKKLVKWMD

SEQ ID NO: 21914 - protein, 303 aa, Bacillus cereus ATCC 14579
MPYFYVFLLLLTSLLWGGNFVVGKSLVDHASPMTLTNLRWMIAIVCLLPMVWFKEKKILPPRTAILPLILMGISGVALFNIFQFLALEKTSATNVGLISTLNAISIALFSVLFLKEKVNTLQILSMILSFFGVILVLLKGDFSLLFSLHFNSGDLWMIAAVCIWGIYSVCSKWATKTTTPLMATLYSGIFGVILLLPFNIGSFTVSNINTSFITSLLYTGLISTVLCMVFWNIGVQKLGATTSGIFLNFNPIFTAILAFIFLGEELTWIQILGTIVVVTGCYLFSHFKTVAVQPVRPLMRKHS

SEQ ID NO: 21915 - protein, 896 aa, Bacillus cereus ATCC 14579
MNSKAKFSIRYKIMAGYLVIILFLLVSFIMLNNEISSLQKSRNFIIDHDFKVLNLTNQVEKELLTIENKAKGFIISNNPTYVQSLNSAEKDYEKHYQDLFALLEDNPSQQEKLKQINENITSWINKEIHPLIANNNSNNVQTIDTTQIQSLQSQLTNFRNTEEQLTKKRAAQLDTENNKLEIWLYSLLFLLSCISIIVSLYISNAITKTIKNVIQAIKSISSKEKITERIHVNTHDEIKDLAHTTNHLLDEISKREWLQTELAELILMYQGVSSIEMLGKKILSGIIQKTQTSCGAFYVREEYEETVYYVKKASFADQGADVGKQSIKMGEGFIGQSALEKKSFILRDIPEEFRYVTTGLLEIRPKNILVIPVLFEDEVIAVMELVSVTEISDLHQDLIHQTVDNLGLTIHSIMGRMRIQTLLHESQAMTEELQVQSEELQTQAEELQMQAEELRTTNEQLESRTEEAEQKTADLQITKLELEEKASELLRSSKYKSEFLANMSHELRTPLNSILLLSEMLRENHDNNLSDDEIELATVIHSSGKDLLTLINDILDLSKVEAGKLDIIFEATNISDMAANMHQNFLHIAAQKNVEFTIEDSDTIPDLFYTDAKRIEQIIKNLLSNAFKFTEKGSVSLHFDSIETTNLSHDMQSISKDWITISVKDTGIGIAKEQHQLIFEAFQQADGATIRKYGGTGLGLSICKEFARLLGGWITLESNVGEGSTFTVYIPNLPNGLHDIQLSNLEVAATIEDVIPAKVVEETIVTTETNNVFQEKTILIVDDDHRNIFALQNALKKQNANIITAQNGIECLEILKSNTNIDLILMDIMMPNMDGYETMENIRMNLGLHEIPIIALTAKAMPNDKEKCLSAGASDYISKPLNLHQLYSVMSVWLIK

SEQ ID NO: 21916 - protein, 466 aa, Bacillus cereus ATCC 14579
MFTMVQKLWLTVVCAVCVTVSFLYFVSLYSYEKLYVDNLKASLVMEGKSLAAQYDKREGISTFEEKVRSFDQISSSDVIFVSNPRDLSACLPFDVHHHSLISEGDRQTLLDGKTVTKIGYEEHFDRNIMGVVIPVLENKKLVGIVYSYIPLKSIKDLIYDMGLILAPLAIAMILITIWVGRKIIIAITKPLSQMERVANHLATGDFSERITVSSEDEIGRLGKAFNKMANSLETEDVKRKEFLANVSHELRTPLSYIKGYSEAILDGVAKGPQQEKVTQLIHKEAGRMQRLVHDLLDLAQLEGEHFPLKKQPIVFSQLIEDVLDTYEIKFIEKEIHISTNLNPEVIVMIDEDRMQQVLHNVLDNAIRYTNQKGNIVITLEQIDDYCELKIKDTGIGIDIEHLENLGERFYRVDKARSRQHGGTGLGLAIVKQIVHIHGGQWKIESEKDKGTTVIIKLNVQDEGSMF

SEQ ID NO: 21917 - protein, 247 aa, Bacillus cereus ATCC 14579
MVQLNGKVAIVTGGAKGIGKAITVALAQEGAKVVINYNSSKEAAENLVNELGKDGHDVYAVQADVSKVEDANRLVEEAVNHFGKVDILVNNAGITRDRTFKKLNREDWERVIDVNLSSVFNTTSAVLPYITEAEEGRIISISSIIGQAGGFGQTNYSAAKAGMLGFTKSLALELAKTNVTVNAICPGFIDTEMVAEVPEEVRQKIVAKIPKKRFGQADEIAKGVVYLCRDGAYITGQQLNINGGLYM

SEQ ID NO: 21918 - protein, 452 aa, Bacillus cereus ATCC 14579
MKETTSFSQKLKQFVLLFFPIFVTQMSLFAMSFFDTTMSGHASPTDLSGVAIGTSIWIPVSTGLTGILMATTPIVAQLVGSKKKEDVPHVVIQAVYLAICASFVVILIGFFVVSPILNGMRLEEPVERIAAQFLSIIAIGIIPLFTYTVLRGFIDALGKTRTTMIITLLSLPINVILNYLLIFGNFGFPKLGGVGAAIASTATYWCILIITVIIIQTKEPFASFNIFKQLYRPSLSSWIAFLKLGVPIGFAIFFETSIFAAVTLMMSNFSTTTIAAHQAAMNFASLLYMTPLSLAMAMTIAVGFEVGAKRYDNAKQYGLIGIGLALAFALLYSILLYFFDDQIASIYTTDAKVHHLAKEFLIFAILFQISDAIATPVQGALRGYKDVNVALIMTLIAYWIIGLPLGYILATYTEWAAKGYWIGLIIGLAFGAAFLLIRLFQVQRKYTTQNSR

SEQ ID NO: 21919 - protein, 438 aa, Bacillus cereus ATCC 14579
MYLHGTSRINGQGHLEIGGCDTTQLAKQYGTPLYVYDEGSIRGKCRAFHRAFKESGFSYQVAYASKAFLCMEMCRVAREENMSLDVVSGGELYTALQAGFPASRIHFHGNNKTEEEIVMALQANIGCFVVDNFFELEVLHDLAMQHGKFVNILIRVTPGVEAHTHEYITTGQDDSKFGFGVSNGQAMQAIGLALQKSNYNVLGIHSHIGSQIFETAGFVRAIEVLRQFLEEVREQTNYVVKVLNVGGGFGIRYTESDTPLTLETYVRAVTSAVREQFTVCEYPLPEIWIEPGRSIVGDAGTTIYTVGSVKDIPGIRKYVSVDGGMTDNLRPALYNARYEAMLANRANDENEELVSIAGKCCESGDMLIWDIHLPKVAASDLLAVSCTGAYGYSMANNYNRIRRPAVVFAKGGTSQVVVERETYENIIGNDRIRIKELV

SEQ ID NO: 21920 - protein, 402 aa, Bacillus cereus ATCC 14579
MLSAKTIEIVKSTVPLLQEKGVEITTRFYQILFSEHPELLNIFNHTNQKKGRQQQALANAVYAAATYIDNLEAIIPVVKQIGHKHRSLGIKAEHYPIVGTCLLRAIKEVAGAPDEVLNAWGEAYGVIADAFISIEAEMYEEAAHKEGGWKDFRNFVIVKKVKESDVITSFYLKPEDGGKVSSFIPGQYVTIQINIEGETYTHNRQYSLSDAPGKEYYRISVKKEKGVDTPDGKVSNYLHGHVKEGDVLPVSAPAGDFVLNMDSTLPVVLISGGVGITPMMSMLNTLIEQDSKRNVYFVHAAINSNTHAMKEHVKAVENEYEQVKAYTCYSAPTEKDLEMKNFDKEGFIESEWLKTIIPTTEAEFYFCGPVAFMKHINAALTDLSVKQEHIHYEFFGPATSLQ

SEQ ID NO: 21921 - protein, 303 aa, Bacillus cereus ATCC 14579
MSVKKEWIAPLALLFVSFIWGATFVVVQNAMSFVGPFTFNGIRFLFAGIILLFVQIIFSQKTSKQELKHSSLAGLMVGFFLFVGYLLQTFGLLYTTSSKAGFLTGLSIVMVPILSFIFLKQKATIFIILGIAVATTGLYLLTAADSFQLNIGDILVLGCAVAFAAHILINGFFSKKISPLLLSTSQVLAVGIFSSICAFLFEDWEKLFSVSLWTNQSFLFALFLTALFATSIAFFIQTSAQKHTSPTRVAIIFAMEPVFAALTGVLVANEQLSISAIIGCLCIFLGMIFVELPSKTKKEAQAA

SEQ ID NO: 21922 - protein, 469 aa, Bacillus cereus ATCC 14579
MKPPADNNKEGAESHKLESESKPIWKSMSMFLVPLLLSNVLQSVGQLFGMVVVGRWLGVNDLAAISAFFPLFFLLVSFVIGIGSGSSILIGQAFGAKNEDRLKAIVGTTLTFTFIIGVLLAIIGSIFAMDIMRLMGTPENIIEISVHYARILFISMPVLFLYFAYTTFMRGTGDSKTPFYFLIVSTALNMILLPILIFGWLGAPKLDVYGAAYASVISTVITFIVMLVYLKKKNHPLQLDGTVRKYLRMDGELLKLLLRLGIPASINMILVSLSEIAVIAFVNRYGSDATAAYGVVNQVASYVQMPAVSLGITVSIFAAQSIGANQFDRLQKVVKAGIIMNYVIGGVLISLIYVFSRDILSLFLTSQTTIEIAHSLVMITLWSYLIFGHAQIISATMRASGTVLWPTVIGVVSIWLVEVPVAYYLSYHTSLGIEGIWIGYPAAFIVSLILQYAYYKLSWQKKRITRLVS

SEQ ID NO: 21923 - protein, 546 aa, Bacillus cereus ATCC 14579
MKRFVLTAVTVSVIFLIAACSVTTNITTDHKNMNDKKTLQTETATTPLKVEKGPEVTLIAKEEKQKLSNGVIVPVWTFNGSSPGSEIRVKKGEKVKVTLKNELSAPVSIHWHGYPVPNNMDGIPGVTQDAVEPGKSFTYEFEANVPGTYWYHSHQDSVNQLDRGLYGALIVEDTKEKYDKDYTLMLDEWVTDKEEMNKQLKEMTKGQIGNKSKGNENGEKNDDKNGMDHSDMNMGSDKKDSSNMEGMDHGNMKMEGHDMSMYDLFTINGKSGDLVAPLKVNKGDNVRLRLVNAGYLSHDIHVHGHDIKVIATDGQPINDPKVIKDKVISIAPGERYDIEFTANNPGKWYVEDHSKNKGAKGMKAVIEYDGSKEMKDKTDEKEKLPKVDIMKYGTKKLGSFTLNQEYTATYNMDLNTQMNGNEMVYTINGKVFPDIDPIQVKKGDLVKVRLVNRSKMDDHPMHLHGHFFQVLSKDGKPIEGSPIVKDTLNLKPGEEYEVAFVADNPGDWMFHCHDLHHASAGMVTEVKYTDYKSDYVPNRNIPNKPE

SEQ ID NO: 21924 - protein, 301 aa, Bacillus cereus ATCC 14579
MTQLSRTKTAIILTFLVFMWGINWPLSKFALHYTPPVLFAGVRTLIGGFILLLFALPKYKELHLKETWHLYVISSLLNIIIFYGLQTVGLQYMPAGLFSAIVFLQPVLLGIFSWIWLEESMYGLKIFGLVLGFIGVGVISSSSLTGHISVIGILLALGCAIGWALGTVFIKKTGHRVNAIWMVTIQLLIGGLCLIGFGSEFESWSSIAWSMPFVSVLLFISFFVIAMGWLAYFTLVGAGEASKVGAYTFLIPLIAIIVSSIFLHEAITMSLFIGLLFIVVSICFVNIKPKTLAVRQQVEVK

SEQ ID NO: 21925 - protein, 389 aa, Bacillus cereus ATCC 14579
MKSPNFQLSLQTSNLIIGFMVWVILSSLMPYIKADIPLTAGQISMVTAVPVILGSILRIPIGYWTNRFGARKLFFISFILLLFPVFYISVANSMMDLIIGGLFVGIGGAVFSVGVTSLPKYFPKESHGFVNGIYGVGNAGTAITSFLAPVIATSVGWRTTVQCYLVLLAAFALMNFLLGDRKEKKVNTPLMEQIKGVYKNEKLWFLCIFYFLTFGSFVAFTVYLPNFLVSHFGLEKVDAGMRTAGFIVLATIMRPIGGWLGDKFNPFKILIFVFIGLTLSGIILSFMPSMNVYTFGCLLVAFCAGIGNGTIFKLVPMYFSEQAGIVNGLVSALGGLGGFFPPLILTLLFQLTGHYAIGFMALSEVALACLIITVWMYSQEKLLVMLKNH

SEQ ID NO: 21926 - protein, 304 aa, Bacillus cereus ATCC 14579
MHNKKWDLRIICAHAFTILIWGTAFPAIRMGLESYTPEHLTLLRLLIASFILLLFSFIYKLRLPDLKDIPAIFIFGALGFTIYHIALNYGEKTVNAGSASLIISVTPIVTAILASVFLNEKMKLNGWLGGVISFAGIALISFSQGDAIQLNSGGLFILLAAISESLFFVFQTSYLKKYGFLPFTIYTILSSTVCMLIFLPGVYQEILAAPLEVNLSVIYLGVFPTVLPYIALAYIISRAGASEATSSLYLTPITACFIAWIWLGEVPTLVSIIGGGITILGIVIAHIPVLRKEKHRNLANNQSV

SEQ ID NO: 21927 - protein, 169 aa, Bacillus cereus ATCC 14579
MNFERDRYFLQMALEEAEKALKENTYPVGAVIVDGNNNVIARGRNRVHPEKDITAHAELDAIRNAGEAMFDAKIKNERFTIYSTLEPCPMCTGGILFAKIQRVVWLLNDDLGFGGYKKIKNALVFEGKFNKIDMVEEPFEDLKTRQRELMRQWELNPNNIINLRRAIKK

SEQ ID NO: 21928 - protein, 303 aa, Bacillus cereus ATCC 14579
MKRWQMEWLLVSVALVWGANYTIGKYGVAYMSSIQFNSLRFLVASPVLLLITFLMERSLRIDRKDWLRLVAVGIVGTTMYQTMFMLSVKYTSATNASLLIAMSPIFTGILAVLHKQERFSMKVQIGSIVAFIGAAFVLLTGHTGGTTYEYAWLGNIIGLVAAIAWGWYPILAQPLITKYSAMRVTSWSTLIGIVPLVVYCLFNVNTLTWPVDMPSWGSLAYSIVFATIFGLAMWYVGISKIGSTKVMVYMYLVPLFAVIFAAVTIGEQINMMQLVGGLIIFIGLYVVKKGGIQKPALNLKKVS

SEQ ID NO: 21929 - protein, 254 aa, Bacillus cereus ATCC 14579
MKNLDGKVALVTGASRGIGRAIAMRLAKDGALVAIHYGRNKTAADETISEIESNGGKAFLIEAELNSIDGVKKLVKQLKNELQIKVGTSEIDILVNNAGIGTQGTIENTTEEVFDEIMSVNMKAPFFLIQQTLPLIRAEGRVINISSAEVRLGFTGSIAYGLSKGALNTMTLPLAKHLGERGITVNTIMPGYTKTDINAKLLDDPEIRNFAKNSSVFGRIGQVEDIADAVAFLASSDSRWVTGQIIDVSGGFCL

SEQ ID NO: 21930 - protein, 289 aa, Bacillus cereus ATCC 14579
MKPIKANLMILLVTMTWGTSYLFMKIGLETVPSFSLVALRFGIAFFVCAAVFFKQFRSIHFVTLKYGFILGFLLFVVSASVILGLKTTSASNAGFLASLTVIFIPLLSIVLFKDRLSYRLIISSLVAMTGIGLLTLNNQLTLNSGDLLCILAALFYAFHIIVTGRAAKVANTLQLGILQLGFAGGFGVLSALIFEEPQLPSTKESWIAVLVLSIFCSAFAYIIQAMAQKYTTPTHTGLIFSLEPVFSALFAYLFMNEVLSLKGYIGALLILSGVILAEIKVKRKSTLLL

SEQ ID NO: 21931 - protein, 385 aa, Bacillus cereus ATCC 14579
MVKYISILGSTGSIGTSALDVVSAHPEHFKIVGLTANYNIDLLEQQIKTFQPRIVSVATKDLADKLRTRISANTKITHGTDGFIAVATHPDSNLVLSSVVGVSGLLPTIEALKAKKDIAIANKETLVAAGHIVTELAKQNGCRLIPVDSEHSAIFQCLKGENNKEIEKLIVTASGGAFRDKTRDEMQTLQAKDALKHPNWLMGAKLTIDSATLMNKGFEVMEARWLFDIPYKKINVMIHKESIIHSLVEFIDGSVMAQLGAPDMRMPIQYAFHYPTRLPSSYEKLNLLEIGSLHFEKPDLEKFPCLQYAYECGKIGGTTPAVLNAANEIANALFLKNEIAFFDIEKTIYKTVEAHHNVKDPSLDAILEADQWARQYANELLIKKR

SEQ ID NO: 21932 - protein, 279 aa, Bacillus cereus ATCC 14579
MKNLQSKTVLSNGVEMPWFGLGVFKVEEGPELVEAIKSAIKAGYRSIDTAAIYGNEAAVGEGIRAGIETTGISREELFITSKVWNADQGYEETIAAYEESLKKLKLDYLDLYLVHWPVEGKYKDTWRALETLYKEKRVRAIGVSNFQIHHLQDVIKDAEIKPMINQVEYHPRLTQKELQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 21933 - protein, 250 aa, Bacillus cereus ATCC 14579
MTVKKLYFIPAGRCMLDHSSVNGTLAPGNLLNLPVWCYLLETEEGPILVDTGMPESAVNNEGLFNGTFVEGQILPKMTEEDRIVNILKRVGYEPDDLLYIISSHLHFDHAGGNGAFTNTPIIVQRTEYEAALHREEYMKECILPHLNYKIIEGDYEVVPGVQLLYTPGHSPGHQSLFIETEQSGSVLLTIDASYTKENFEDEVPFAGFDPELALSSIKRLKGVVAKEKPIVFFGHDIEQEKGCRVFPEYI

SEQ ID NO: 21934 - protein, 247 aa, Bacillus cereus ATCC 14579
MKLKDKVAIITGGASGIGESTVRLFIEEGAKVVIADFSERGKELSDELNAHGYNTLFIKTDVTKEADIKQLIHETVSTYGKLDIMYANAGVADDAPANELSYEKWKRTIDINLSGVFLSDKYSIEQFLKQGTGGVIVNAGSIHSFVSLPTPTAYSSAKGGVKLLTQNLCTAYAKYGIRINAVCPGYIDTPLLGSVNPQQKEYLASLHPQGRLGTPEEVAKAVLFLASDDASFVNGTTLLVDGGYTAR

SEQ ID NO: 21935 - protein, 246 aa, Bacillus cereus ATCC 14579
MEFLNGKTAVVTGAAQGIGKEIARVYAKLGAKVLISDVNEENLQKTTRELSDEGYEVCSYRCDVSNQNEAKSLIEYAVQKFGTLHILVNNAGITRDAMLHKMEKSAWEQVLQVNLTGVFYCMQPALLYMRQQGYGRIINISSISREGNIGQANYAATKAGVVGLTKTAAKEVGSFGITCNAICPGFMDTDMTKTIPDKVKEKMVGAIPVGRIGTPEDIANAAAFLASEYASYITGEVLNVSGGLQV

SEQ ID NO: 21936 - protein, 349 aa, Bacillus cereus ATCC 14579
MLTQEQIMNALKHVEDPELHKSVVELNMVRNIQMNGTEVKLEVVLTIQGCPLKAKIQQDIEESLHAIGASKVEVTFGSMTQEERAALTEKLKRNTRTETGMPSMLRPDSGVRFITVTSGKGGVGKSTVTINLATALARMGKKVGILDADIYGFSIPAMMETNKKPTMIDQTAIPVISHGVKIMSMGFFTEGNNPVMWRGPMLNKWIQNFLANTHWGELDYLLLDLPPGTGDVAIDVAAMIPQAKEIIVTTPHNIASFVASRVGVMAKHTKHEILGIVENMAYYEEQDGSKNYLFGKGGGEMLAEQLQTEVIAKIPFAKREENNGSSVYDEDSLVGEVFTSLAEDIIYRG

SEQ ID NO: 21937 - protein, 237 aa, Bacillus cereus ATCC 14579
MKKYALVTGGSGGIGSAISKQLIQDGYTVYVHYNNSEEKVLELQKAWGEVVPVQANLASSDGAEQLWGQIEHPIDVIVYAAGKSIFGLVTDVTNDELDYMVELQVKNVYKLLSMALPPMIGRRSGNIVIVSSIWGQIGASCEVLYSMVKGAQNSYVKALAKEVSLSGLRVNAVAPGAIETEMLSVFSEEDKMGIAEDIPLGRIGLPEEVAKTVSFLVSPGASYITGQIIGVNGGWHC

SEQ ID NO: 21938 - protein, 380 aa, Bacillus cereus ATCC 14579
MKNISLLGASGSIGTQTLDVLRSHPDQFRLVAFSVGKNIDYAVKVIQEFSPQIVSVQREEDVLKLQSVSGNTKIVYGSEGLLEVALHPDAEIVVNAVVGSVGLLPTLRAIEAKKTIGIANKETLVTAGHLVMEAARKHNVSLLPVDSEHSAIFQCLNGENEKRISRLIITASGGSFRDKTRDELHHVTVEDALRHPNWSMGSKITIDSATMMNKGLEVIEAHWLFGIPYEQIDVVLHKESIIHSMVEFEDRSVMAQLGSPDMRVPIQYALTYPDRLPLSDTKQLNLWEIGTLHFEKMDQERFRCLRFAYEAGKAGGSMPAVMNAANEVAVEAFLQKRIGFLTVEDLIEKAMNHHNVIARPSLEEILEIDAATRRFVMEQI

SEQ ID NO: 21939 - protein, 246 aa, Bacillus cereus ATCC 14579
MLKGKVALVTGASRGIGRAIAIDLAKQGANVVVNYAGNEQKANEVVDEIKKLGSDAIAVRADVANADDVTNMVKQTVDTFGQVDILVNNAGVTKDNLLMRMKEEEWDTVINTNLKGVFLCTKAVSRYMMRQRHGRIINIASVVGVIGNPGQANYVAAKAGVIGLTKTSAKELASRNITVNAIAPGFIATDMTDVLDENIKAEMLKVIPAAQFGEAKDIANAVTFFASDQSKYVTGQTLNVDGGMVM

SEQ ID NO: 21940 - protein, 401 aa, Bacillus cereus ATCC 14579
MLKGKKILLCVTGGIAVFKAAALTSKLTQSGASVKVMMSESAMKFVTPLTFQALSRHDVYTDTFDEKDSAVIAHIDLADWADVVLVAPATANCIGKLAGGIADDMITTTLLATTAPVWIAPAMNVHMYENKIVQKNMMTLKTLGYTFIEPGEGFLACGYVAKGRLEEPEAIIARLEEAFSEHKPLQGKRILITAGPTREKVDPVRFMTNFSSGKMGYAIAEVAANLGADVILVSGPTALNPPLHVTTVQVESAQDMLEAVLQHYQNVDVVIKTAAVADYRPKYVHENKMKKQNGDAVIELERTVDILKTLGQKKDKQLLIGFAAETTNVEEYATKKLREKNADMIVANDVKAQGAGFGTDTNIVTMYRKDGKVIELPLLMKKEVAREILKQIEMMLEDDRL

SEQ ID NO: 21941 - protein, 259 aa, Bacillus cereus ATCC 14579
MTRNKVEICGVDTAKLPVLKNEEMRKLFREMQSGEISAREKLVNGNLRLVLSVIQRFNNRGEYVDDLFQVGCIGLMKSIDNFDLGQNVKFSTYAVPMIIGEIRRYLRDNNPIRVSRSLRDIAYKALQVREKLIAENSKEPTAMDIAKVLEVTHEEIVFALDAIQDPVSLFEPIYNDGGDPIFVMDQLSDEKQKDEQWVEELALKEGMKRLNDREKMIIRKRFFQGKTQMEVAEEIGISQAQVSRLEKSAIKQMNKTIQG

SEQ ID NO: 21942 - protein, 325 aa, Bacillus cereus ATCC 14579
MAQMTMIQAITDALRVEMKNDPNVLVFGEDVGVNGGVFRATEGLQAEFGEDRVMDTPLAESGIGGLAVGLALEGFRPVPEIQFFGFVYEVMDSISGQLARMRYRSGGRWTAPVTVRSPFGGGVHTPELHADSLEGLVAQQPGLKVVIPSTPYDAKGLLISAIRDNDPVIYLEHMKLYRSFRQEVPEGDYTIDLGKADIKREGTDVSVIAYGAMVHAALKAAEELEKEGISLEVVDLRTVQPLDIETIIASVEKTGRVVVVQEAQKQAGIAANVVAEINDRAILNLEAPVVRVAAADTVFPFSQAESVWLPNHKDIVEAVNKVMNF

SEQ ID NO: 21943 - protein, 240 aa, Bacillus cereus ATCC 14579
MKMMDANEIISFIQKSEKKTPVKVYIKGDLKEVTFPETVQAFVNKKSGVLFGEWSEIKTILDENNKHIVDYVVENDRRNSAIPMLDLKGIKARIEPGAIIRDHVEIGDNAVIMMNATINIGAVIGEGSMIDMNAVLGGRATVGKNCHVGAGAVLAGVIEPPSAKPVIVEDDVVIGANVVVLEGVTVGKGAVVAAGAVVTEDVPPYTVVAGTPARVIKEIDEKTKAKTEIKQELRQLNPEK

SEQ ID NO: 21944 - protein, 219 aa, Bacillus cereus ATCC 14579
MSIQVFCDFDGTITNNDNIMSIMEKFAPPEAEEVKNKILSQELSIQEGVSQLFQLIPTNLHDDIIQFLIETAEIRSGFHEFIQFVKENNISFYVISGGMDFFVYPLLQGIIPKEQIYCNETDFSAEFITVKWPHSCDDHCQIHCGLCKSSLIRKLSDTDDFHIVIGDSITDLQAAKQADKVFARDFLITKCEENHIAYTPFETFQDVQAELKLLLEVKA

SEQ ID NO: 21945 - protein, 570 aa, Bacillus cereus ATCC 14579
MTLNIQGIAASSGIAIAKAFRLENPEFNIEKKSITNEAAEIARLDAALEKAKTELEAIKDHAFAELGADKAAIFEAHLLVLNDPELVNPVKDKVNSEKVNAEFAMDEVASMFISMFENMDNEYMKERAADIRDVTKRVLAHLLGINFSNPGTISEEVIIIAEDLTPSDTAQLNRKYAKGFTTDIGGRTSHSAIMARSMEIPAVVGTKVVMEKIQNGDIVIIDGLDGEVIVNPSEETLRSFEEKKAKFEEQKAEWAKLKDQATVTSDGHHVELVANIGTPNDVQGIIDNGGEGVGLYRTEFLYMGRDNLPTEEEQFEAYKAVLEGVKEGQPVVVRTLDIGGDKELPYLHLPKEMNPFLGYRAIRLCLDEQDVFRTQLRALLRASVYGNLKIMFPMIATLDEFRQAKAILLEEKAKLVEAGTTVSDSIEVGMMVEIPASAVLADQFAKEVDFFSIGTNDLIQYTMAADRMNEQVSYLYQPYNPSILRLVKMVIDAAHKEGKWAGMCGEMAGDSLAIPLLLGLGLDEFSMSATSILPARTQLSKLSKAEMETLAEKALMMSTAEEVVELVKSI

SEQ ID NO: 21946 - protein, 275 aa, Bacillus cereus ATCC 14579
MHIPTTTLHNGVKMPMIGLGVYKAKEGDEVKQAVKTALEVGYRSIDTATVYENESGVGEAIRESGIPREDIFITTKVWNDDQGYEETLEAFEKSLKKLQMDYVDLYLIHWPVRGKYVDTYRALEKLYEEGKVRAIGVSNFHKHHLELLLPNCKVKPMVNQVELHPMLTQFELRNYCQDEQIQMEAWSPLMRGGEVFQHPIIQAIANKYEKTPAQVILRWDIQSGIVTIPKSVTPSRIKENFTIFDFALTEEEIRQINTLNRDLHVGTNPDKYDTL

SEQ ID NO: 21947 - protein, 327 aa, Bacillus cereus ATCC 14579
MAVMSYIDAITLAMREEMERDEKVFVLGEDVGKKGGVFKATHGLYDQFGEDRALDAPLAESAIAGVAIGAAMYGMRPIAEMQFADFIMPAVNQIVSEAAKIRYRSNNDWTCPVTIRAPFGGGVHGALYHSQSVEAMFANQPGLKIVIPSTPYDAKGLLKAAIRDEDPVLFFEHKRAYRLIKGEVPEDDYVLPIGKADVKREGDDITVITYGLCVHFALQAAEKLAQDGISAHILDLRTVYPLDKEAIIEAASKTGKVLLVTEDNKEGSIMSEVAAIIAENCLFDLDAPIARLAGPDVPAMPYAPTMEKFFMVNPDKVEKAMRELAEF

SEQ ID NO: 21948 - protein, 630 aa, Bacillus cereus ATCC 14579
MDLTQIQNPSFLKDMSISELEGLSEDIRKFLIEELSQTGGHIAPNLGVVELTIALHKLFDSPQDKFLWDVGHQSYVHKILTGRAKEFGTLRQYQGLCGFPKRCESEHDVWETGHSSTSLSAAMGMALARDLKKTKEYVIPIIGDGALTGGMALEALNHIGHEKTDMIVILNDNEMSIAPNVGALHNVLGRLRTAGKYHWVKDELEYILKKIPAVGGKVAATAEKIKDSLKYLLVSGVFFEELGFTYLGPVDGHDYEKLFETLQYAKKTKGPVLVHVITKKGKGYKPAESDVIGTWHGTGPYKIESGDFVKPKEVAPAWSAVVSETVLKLARADERIVAITPAMPVGSKLEKFQKEFPDRMIDVGIAEQHATTMAAGMATQGMKPFLAIYSTFLQRAYDQVVHDICRQNLNVFIGIDRSGLVGADGETHQGVFDISFLRHLPNMVLMMPKDENEGQHLVYTAMQYEDGPIALRYARGNGLGVHMDEELKAIPIGTWETLKEGTQAAILTFGTTIPMAMEAAERLEKAGVSVKVVNARFIKPMDEAYLHDLLGKNIPILTIEEACLIGGFGTGVVEFASENGYHSALVERMGIPDRFIEHGSVTKLLEEIGLTTDAVVDRIHTMIPSKQKRA

SEQ ID NO: 21949 - protein, 375 aa, Bacillus cereus ATCC 14579
MADKPARSKQIETEMTLEQVKEQLTELGKKRGVLTYEEIAERMNGFEIESDQMDEYYEYLGEQGIDLVGDNDNEEGPNNRQISKTEEEFDLNDLSVPPGVKINDPVRMYLKEIGRVDLLSAEEEIRLATRIEEGDEEAKRRLAEANLRLVVSIAKRYVGRGMLFLDLIQEGNMGLIKAVEKFDYRKGFKFSTYATWWIRQAITRAIADQARTIRIPVHMVETINKLIRVQRQLLQDLGREPSPEEIGEEMDLAPEKVREILKIAQEPVSLETPIGEEDDSHLGDFIEDQEATSPADHAAYELLKEQLEDVLDTLTDREENVLRLRFGLDDGRTRTLEEVGKVFGVTRERIRQIEAKALRKLRHPSRSKRLKDFLE

SEQ ID NO: 21950 - protein, 587 aa, Bacillus cereus ATCC 14579
MNKFRSRLLFTFVSLIVFILVGLGLLLETVFENYYIDHAKERMVKETEYVATLAEEQGFDNVLKNPYVFEKLEEKIPASIVFLDEKKKVQYRKGQELAFSPETIKELSSEVAKQRSKVITKETDRKNEFYHAVFVQDVEGKQGYILVKSIIDPLRDVHQKTWGLLIIGFVIACLVVVFLGMKITGQYIRPIESVTKVAIELAKGNYKARAYESHSDETGMLSKAINILARNLQEMTLEQEMQQDRLHTLIENMGSGMILIDSRGYINLVNRSYKETFHVTDEEYLDRLYYESFHHTEIIELVEEIFMTEVKVRKQMLLPLGIERKHFEVYGAPIIGTNHEWKGIVLVFHDITELKKLEQMRKDFLANVSHELKTPITSIKGFSETLLDGAMDNKKFCEHFLHIILKESERMQGLIEDLLDLSKIEQQGFKLNMGTVDMKGLLEDIHMVLDNKAGEKEISLQVNVLKRASVIGDPSRLKQIFINLINNAIVYTPAGGVVSVELAEDKYNAYIKVSDTGIGISKEEIPRIFERFYRVDKARSRNTGGTGLGLSIVKHLVEAHQGTITVDSEVGEGTTFTVVLPKSATEK

SEQ ID NO: 21951 - protein, 261 aa, Bacillus cereus ATCC 14579
MYSDLAGKVVVITGSATGLGRAMGVRFAKEKAKVVINYRSRESEANDVLEEIKKVGGEAIAVKGDVTVESDVVNLIQSAVKEFGTLDVMINNAGIENAVPSHEMPLEDWNRVINTNLTGAFLGSREAIKYFVEHDIKGSVINMSSVHEKIPWPLFVHYAASKGGIKLMTETLALEYAPKGIRVNNIGPGAINTPINAEKFADPKKRADVESMIPMGYIGNPEEIAAVATWLASSEASYVTGITLFADGGMTLYPSFQAGRG

SEQ ID NO: 21952 - protein, 301 aa, Bacillus cereus ATCC 14579
MRRWGIELLILSVVIIWGINYTIAKYGLLEFTAIEFTALRMMAAAPLLLLLTFCIEKSVYMERTDIPRLIIVSVVGIVLYQTLFMETVKYTSATNASLLISISPIFTTAFAIFLKQEKFSSRKLIGSMTAFVGAALVLVAGHSLTSSFYGNGIGLITSICWGLYPVLAGPLIKKYSALRVTAWSALVGAIPLLLLSGPHVFVMPFHITHGMTLFALLYSIFFVTVFGLVMWYVGVQKIGASHTMVYMYITPLVAVLFAAVWANEYVSFQQIIGGIIIFVGLWFVKSEKVKVHSIAGEPISK

SEQ ID NO: 21953 - protein, 323 aa, Bacillus cereus ATCC 14579
MERELALEIVRVTEAAALASAQWMGRGKKNEADDAATTAMRDMFDSVNMAGTVVIGEGELDEAPMLYIGEELGTGNGPEVDIAVDPLEGTNIVAKGLANAMAVIAIADKGNLLHAPDMYMEKIAVGPKAAGKISLDDPIEKTIEIVAEANNKKIRDLTVIVQERERHQDIIDRVRAKGARVKLFGDGDVGASIATALPGTGIDLFVGIGGAPEGVISAAALKCLEGEMQARLVPMNEEEEARCREMGLEDPRQLLMLDDLVSGDDAIFSATGVSAGELLDGVKFLGGDLAETYSIVMRYKTRTVRFIKTHHHLDHKPHLNLDI

SEQ ID NO: 21954 - protein, 232 aa, Bacillus cereus ATCC 14579
MFRKVDHKNMGRANHGWLNTHFHFSFANYYNPNNMNFGALRVINDDLVAAQTGFDMHPHRDMEIISYVVDGALTHEDSMGNRGTIERGHVQYMSAGTGVFHSEHNLGDETLRLLQIWILPDRADHKPNYGEFKFDWSKREDEWFHMVSSVEGNAPIQIHQDANLYSLSLEAGKEIHFPVKEGRQLYLVQIEGSSVINGETFVMRDAAESVEEDIHIQAKEQSHYLAIELKKQ

SEQ ID NO: 21955 - protein, 279 aa, Bacillus cereus ATCC 14579
MKNLQSKAVLNNGVEMPWFGLGVFKVEEGPELVEAVKSAIKAGYRSIDTAAIYGNEKAVGEGIRAGIEATGIAREELFITSKVWNADQGYETTIAAYEESLKKLGLDYLDLYLVHWPSEGKYKDTWRALETLYKEKRVRAIGVSNFQIHHLQDVMKDAEIKPMINQVEYHPRLTQKELQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 21956 - protein, 256 aa, Bacillus cereus ATCC 14579
MNSIKQFNFKNKNIFITGATSDIAICIAESFSGFGGNLILSDTDKQLPKLEHVKQKMIEKFRNNVQIVTIDLYKVNDIQNAIEKLDKPIDILINCAGNNYFVPALEVSEENWQKIIDVNLKGTFFLSQSIAKKMISDGIKGKIVNIGSQHGVVANGLRAPYCISKFGLIGLTKVLALEWSTFNILVNCVSPTYVKTSKSKDFLEHEDVKKAYLYKIPLKKYALPHDISYAVLFLSSDQNQIITGENILVDGGYTLH

SEQ ID NO: 21957 - protein, 431 aa, Bacillus cereus ATCC 14579
MSTIIDVYAREVLDSRGNPTVEVEVYTESGAFGRAIVPSGASTGEHEAVELRDGDKSRYLGKGVVNAVNNVNEIIAPEIAGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEVAVYDGVKSFYNIKR

SEQ ID NO: 21958 - protein, 505 aa, Bacillus cereus ATCC 14579
MMRKLTKTFIVSLTLCIAFTIWGIIPESIIGKGSLGNVTTAIQTALVSKFGWFYIISVSIILGVSIFLIVSKYGSIRLGKDDDEPDYSYMTWFAMLFSAGMGIGLVFWGVAEPLNHLYAPPFGDSATEESARLALRFSFFHWGLHPWGLYAFVALCIAYFTFRKGKASTISATVGPLFKGGEHGRIAHSFDVLAVFATVFGVATSLGLGAKQIAGGVSYLTSIPNSLTTQLVIIAIVTVLFMLSAQTGLDKGIKYLSNTNIIFAFALMIIVLFAGPTNFIMNYFTSTIGSYIQELPSMSFRLSPLDEGGNQWIQSWTIFYWAWWIAWSPFVGTFIARVSRGRTIREFVIGVLLVPTVIGALWFSVFGGTGIHMELFGDAHIFDKVKEMGTEVGLFAMFDQMGSFGSALSVLGILLIATFFITSADSATFVLGMLTTHGSLNPPNRIKMIWGIVLAAIASTLLYIGGLEALQTAAIIAAFPFVFVIFFMMAALFKELQKEGRMKRH

SEQ ID NO: 21959 - protein, 321 aa, Bacillus cereus ATCC 14579
MERSLSMELVRVTEAAALSSARWMGRGKKDEADGAATSAMRDVFDTIPMKGTVVIGEGEMDEAPMLYIGEKLGTGYGPRVDVAVDPLEGTNIVAAGGWNALAVIAIADHGNLLHAPDMYMNKIAVGPEAVGAVDIDAPIIDNLRAVAKAKNKDIEDVVATVLNRPRHQEIIEEIRKAGARIKLINDGDVAGAINTAFDRTGVDILFGSGGAPEGVLAAVALKCLGGEIHGKLLPQNEAELARCKKMGIEDINRILRMEDLVKGDDAIFAATGVTDGELLRGVQFKGSVGTTQSLVMRAKSGTVRFVDGRHSLNKKPNLVIK

SEQ ID NO: 21960 - protein, 522 aa, Bacillus cereus ATCC 14579
MRMKSRKTDWPVFIISGGSLLLFVIAVFLNKDYVESAINKSFAFSIKYFGAFWQVLLLGTFIVAMCMAFSKYGRVKLGGLEKPEISTAKWLAIIMSTLLAGGGVFWAAAEPMYHLMTVPPIHDGISAGTKEAVMPALAQSYMHWGFLAWTILGTISAVVMMYGHYHKDMPLKPRTLLYPIFGEKLRKSLLGTIIDAAAIIAVAAGTIGPIGFLGLQASYGLQELFGISDVFTTQLAIIVCVVAVSTISAVTGIDKGIQIISNLNVRLAIVLMAFILLFGPGGFIIDSFVSSFGFYVNEFIPMSTYRGDTSWLGSWTIFFWGWFIGYGPMMAILVSRISRGRTIREIIVAIGIIAPIITTFWFTILGGSGVFYELMNPGSISDALSESGMPAAMIAITGQLPLSNIIGPAFLLLTILFVVTTGDSMAYSISMAVTGDGDPRISLRIFWSLIMGAVAAILLYMGEGSINALQSFIVVTAVPVSILLFPMLWLAPKVAGELALKQGIVKEEDKTAFLFQKASKSK

SEQ ID NO: 21961 - protein, 328 aa, Bacillus cereus ATCC 14579
MMENVFDYEDIQLIPAKCIVNSRSECDTTVTLGKHKFKLPVVPANMQTIIDERIATYLAENNYFYIMHRFQPEKRISFIRDMQSRGLIASISVGVKEDEYEFVQQLAAEQLTPEYITIDIAHGHSNAVINMIQHIKKHLPESFVIAGNVGTPEAVRELENAGADATKVGIGPGKVCITKIKTGFGTGGWQLAALRWCAKAASKPIIADGGIRTHGDVAKSIRFGATMVMIGSLFAGHEESPGETIERDGKLYKEYFGSASEFQKGEKKNVEGKKMFVEHKGSLEDTLIEMEQDLQSSISYAGGTKLDAIRTVDYVVVKNSIFNGDKVY

SEQ ID NO: 21962 - protein, 139 aa, Pinus pinaster
MSGKGAKGLLMGKSSAPVNNNNNKDKDKKKPVSRSSRAGLQFPVGRIHRLLKSRISANGRVGATAAVYSAAILEYLTAEVLELAGNASKDLKVKRITPRHLQLAIRGDEELDTLIKGTIAVGGVVFHIHKSLINKSSKD

SEQ ID NO: 21963 - protein, 348 aa, Lotus japonicus
MGRTPCCDEIGLKKGPWTPEEDAILVDYIQKHGHGSWRALPKLAGLNRCGKSCRLRWTNYLRPDIKRGKFTEEEEQLIINLHAVLGNKWSAIAGHLPGRTDNEIKNFWNTHLKKKLLQMGLDPVTHRPRLDHLNLLSNLQQFLAATNMVTSFTNTLDSNAALRLQSDATQLAKLQLLQNILQVLGTNPASNLELLNQLGPSSSISDTFLHEALGLNQSKLQELYKSSIGFPSHQNLSNLQTLEVPHHLQQHYMNGGSTINSCMQSRKVVDEQLDATNSSSTIPLNSLPNLVSASPQCSTVKEMENKVNPNECSNPSSTSTTFEMWGDFMCEEVNDDYWKDLIDQESNR

SEQ ID NO: 21964 - protein, 336 aa, Lotus japonicus
MGRSPCCDENGLKKGPWTPEEDQKLVEHIQKHGHGSWRALPKLAGLNRCGKSCRLRWTNYLRPDIKRGKFSPEEEQTILHLHSILGNKWSTIATHLPGRTDNEIKNFWNTHLKKKLIQMGFDPMTHQPRTDLVSTLPYLLALANMTQLMDHNHQSFDEQAVQLAKLQYLNYLLQSSNNPLCMTNSYDQNALTNMEAFSLLNSISNVKENLGVDFSQMDTQTSLFSHDGNNMASSQPLHHPSNMLPHFLDPQVSFSSQSCLNNNEQGQGTNNFAISQRDHTGDESSWINIPSINPPNAIGTSGDASSSTSSYGGAGPSPYNWSELFFEDPTTMHELS

SEQ ID NO: 21965 - protein, 307 aa, Lotus japonicus
MMRTPSIDESGMKKGPWSQEEDKVLVDYIQKHGHGSWRALPQLAGLNRCGKSCRLRWTNYLRPDIKRGKFSDEEEQLIINLHASLGNKWATIASHLPGRTDNEIKNLWNTHLKKKLKLLQMGLDPVTHCPRSDHMNILSNLQQILAAANIVSSFTNPCDMIHALMLHSDATNLAKLHLLQNMLQNNNFQNIYNGSVAFPSLHQIQPSFQNFEAPQHLSGGRDDISNYRECLKFDEQLGLSNIADPTPSNSLPKLVSASPECSPVNQEENMANHKEWSNFDPSSTAFETWGEFMSEDTSETYWKDFME

SEQ ID NO: 21966 - protein, 354 aa, Lentinula edodes
MGCAQSSGIDDEAKARNDEIENQLRRDRMMAKNEIKMLLLGAGESGKSTVLKQMKLIHHGGYNDSERDSYKEIIFSNTIQSMRAILDAMPSLDLFLNPSNDARRATILSLPVQLEVDVMPRDVGDSIRGLWSDPAVKEAVKRSREFQLNGSAVYYFNSIDRMSGPGYMPSDQDILRSRVKTTGITETTFQVGELTYKLFDVGGQRSERKKWIHCFENVTALVFLVSLSEYDQMLYEDESVNRMQEALTLFDSICNSRWFVKTSIILFLNKIDLFAEKLPRSPLGDYFPDYTGGNNYDAACEYLLRRFVSLNQSAATKQVYAHYTCATDTQQIKFVLSAIQDILLQLHLREAGLL

SEQ ID NO: 21967 - protein, 312 aa, Lentinula edodes
MTESLRFLGSLTGHKGWVTAIATSSENPDMILTASRDKTIIVWQLTRDDDSYGYPKRILQGHNHFVSDVVISSDGQFALSSSWDHTLRLWDLNTGLTTRRFAGHTSDVLSVSFSADNRQIVSGSRDKTIKLWNTLGECKYDIKDDGHSEWVSCVRFSPNVMNPVIVSSGWDKVVKVWELSKFKLKTNHYGHTGYINTVSVSPDGSLAASGGKDGITMLWDLNEGKHLYSLEAGDIVNALVFSPNRYWLCAATASCVKIFNLESKSIVDELKPAYAEEGGRQPECVSIAWSADGQTLFAGFTDNCLRVWTVTS

SEQ ID NO: 21968 - protein, 722 aa, Caenorhabditis elegans
MSKYEVLQGFYAVHDELGSGGFGKVRLATHLLTNQKVAIKIIDKKQLGHDLPRVQTEMDALRNLSHQNICRLYHYIETEDKFFIVMEYCSGGEMFDYIVRKERLEESEARHFFRQLVSAIAFVHSQGYAHRDLKPENLLLTEDLHLKLIDFGLCAKTEKGRIDKHNLDTCCGSPAYAAPELIQGLQYKGNEADVWSMGILLYTLLVGALPFEDDNMQIMYKKIQSGCFYEPEFLSPLSKQLLRAMLQVVPERRISVKKLLEHDWLNHKYTQPVKWNTIYDKNFIDRDVARVMSKYYGFESTDKMIEKIKEWNFDYMTSTYYALLHRKRNGMEIILPMVRNSTNTAPPNVQNILCSPTIHASLENNLDKSGLEDDDSDPSSISSSSDISARLKKNCVVSDESSSSRFVKPMSPAAEKDKKMSYVNAMLTMPSQFTGRSPLRIPESPMSVRSSDSASLGSAATPSRGGVKDNDKENASTGKNYRMGASTCKSRGPLKITGVGKAENVTIKTQYLTLKISRNENYKEGTMKSVYTTPNTRPTLRGLFSPGNAEHKKRQRARSSDRASIGMPPGSPVSIGSAHSANNADGRTPRSRIKTNRLPQRVFTSLERKKEKLITLLTPRKMQRDSPQVLKDVKNMVNVSMTASQDPEEVRNLLKKVFDDERMRYELNGWKFLATQETVHGWMTVELEIVRLQMFDKVRNLRRFFCCVNINIPSRKPTYIEL

SEQ ID NO: 21969 - protein, 521 aa, Caenorhabditis elegans
MAGRKSSRTAERVPTTQKPERKSAILSPHDELRERLLETAIDMKENIPQRNTRNSSVGSQKSDCSETRKRRSTKEGPAAKRHSGEKHRNGSREDSLEYISDDREVGSSSSQSSRTRGQPLPAMPEEEEVFDKSSSSDNLAESEESHEMVRLEERQDIEEEIEDDFDDEEEDVVNDKEEYEEIESEDEDDYPVQNEGFAVTKRLMNDEHMVTAPTFLSTAKCDGIGSPTKVWSLMVKRDEIPRATRFLLGNHPDMDDEKRRILIDWMMEVCESEKLHRETFHLAVDYVDRYLESSNVECSTDNFQLVGTAALFIAAKYEEIYPPKCIDFAHLTDSAFTCDNIRTMEVLIVKYIGWSLGPITSIQWLSTYLQLLGTGKKNKSDHYEEQNMYVPELLRSEYLEMCKILDFLLFEIDSFTFSYRTIAAAVLFVNYEPTCAVEKATGFMQAQLEKVIEYVEPVCRAFAKQRQLLDDVIPKHESIKSDDSHNIQVYVKRSSMEPIVKSERERIQHLKARRLHPQRLF

SEQ ID NO: 21970 - protein, 538 aa, Prunus cerasus
MADRRAEYNAVVSGQPQKNIADFDPPGKPKRNKYAFACAILASMTSILLGYDIGVMSGAVIYIKKDLKVSDVEIEVLVGILNLYSLIGSAAAGRTSDWIGRRYTIVLAGAIFFAGALLMGFAPNYAFLMFGRFVAGIGVGYALMIAPVYTAEVSPASSRGFLTSFPEVFINAGILFGYVSNYGFSKLPTHLGWRLMLGVGAIPSIFLAIGVLAMPESPRWLVMQGRLGDARKVLDKTSDSLEESKLRLGEIKEAAGIPEHCNDDIVEVKKRSQGQEVWKQLLLRPTPAVRHILMCAVGLHFFQQASGIDAVVLYSPRIFEKAGITNPDHVLLCTVAVGFVKTVFILVATFMLDRIGRRPLLLTSVAGMVFTLACLGLGLTIIDHSGEKIMWAIALSLTMVLAYVAFFSIGMGPITWVYSSEIFPLQLRAQGCSIGVAVNRVVSGVLSMTFISLYKAITIGGAFFLFAAIAAVGWTFFFTMLPETQGRTLEDMEVLFGKFYRWRKANALLKQKKQVDHGDGNNNPNNPQIQLGTKGQAN

SEQ ID NO: 21971 - protein, 533 aa, Ctenopharyngodon idella
MEKMKDSKMKQVTHYLVFCVSTAVIGSLQFGFNTGVINAPDKKVQNFIRNVTLERTGETMKDTTLTNVWGIAVSIFNVGGMVGSLSVGALVDKLGRRKSMLLSNILALIGGSLMGLSKVSASYELMIVGRLVIGVFCGLCTGLTPMYVGEISPTALRGAFGTLHQLGVVIGILVAQILGLESLLGSQSLWPLLLALTILPAVLQSVMLIFCPESPRYLLISVNQEDEARKVLTRLRGHSDVEDDIREMKEEAMKMSMEKKVSIPELFRNSAYRQPIIIAIILQLSQQLSGINAVIYYSTEIFRKAGITEPVIATIGMGAVNTLFTVVSLFLVERAGRRTLHMIGLAGMTFCVLVMTISLKLVNPADPVQNSTVIAKTASEAGISAVSVVAILAVLGFVASFEMGPGPIPWFIVAELFAQGPRPAAIAVAGCCNWTASFIVGLSFPPLLELCGPYVFIIFLILLIIFFLFTYFRVPETKGRTFEDIASGFSNVAGSNAANYTSPEGAVTMPVSPSSDKIQMTELAGQEKSGTNL

SEQ ID NO: 21972 - protein, 505 aa, Arabidopsis thaliana
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCMPGVENYQIALRIHEKFTKQRHQRPLLVALS

SEQ ID NO: 21973 - protein, 505 aa, Arabidopsis thaliana
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPSIPRHSNFTGLKVLVMDENGVSRMVTKGLLVHLGCEVTTVSSNEECLRVVSHEHKVVFMDVCMPGVENYQIALRIHEKFTKQRHQRPLLVALS

SEQ ID NO: 21974 - protein, 505 aa, Arabidopsis thaliana
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCIPGVENYQISLRIHEKFTKQRHQRPLLVALS

SEQ ID NO: 21975 - protein, 505 aa, Arabidopsis thaliana
GLRLQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCIPGVENYQISLRIHEKFTKQRHQRPLLVALS

SEQ ID NO: 21976 - protein, 505 aa, Arabidopsis thaliana
GLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRLVTKGLLVHLGCEVTMVSSNEECLRVVSHEHKVVFMDVCMPGVENYQIALRIHEKFTKQRHQRPLLVALS

SEQ ID NO: 21977 - protein, 532 aa, Arabidopsis lyrata subsp. lyrata
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALRIHEKFTKQRHQRPLLVALTGNT

SEQ ID NO: 21978 - protein, 532 aa, Arabidopsis lyrata subsp. lyrata
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAVILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALRIHEKFTKQRHQRPLLVALTGNT

SEQ ID NO: 21979 - protein, 532 aa, Arabidopsis lyrata subsp. petraea
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALCIHEKFTKQRHQRPLLVALTGNT

SEQ ID NO: 21980 - protein, 532 aa, Arabidopsis lyrata subsp. petraea
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKLFTKFAQTQSLATRSSGGSGLGLAISKRFVNLMEGNIWIESDGLGKGCTAIFDVKLGISECSNESKQSGIPKVPAIPRHSNFTGLKVLVMDENGVSRMVTKGLLVHLGCEVTTVSSNEECLRVVSHEHKVVFMDVYLPGVENYQIALCIHEKFTKQRHQRPLLVALTGNT

SEQ ID NO: 21981 - protein, 532 aa, Arabidopsis lyrata subsp. petraea
KTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPGLSTKRYALMVLMLPSDSARQWHVHELELVEVVADQVAVALSHAAILEESMRARNLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRDADFFVVPTGSHFYLRVKVKDSGAGINPQDIPKLFTKFAQTQSLATRSSGGSGLGLAISKRFVNLMEGNIWIESDGLGKGCTAIFDVKLGISERSNESKQSGIPKVPAIPRHSSFTGLKVLVMDENGVSRMVTKGLLVHLGCEVTTVSSNEECLRVVSHEHKVVFMDVCLPGVENYQIALCIHEKFTKQRHQRPLLVALTGNT

SEQ ID NO: 21982 - protein, 344 aa, Caenorhabditis elegans
MGSCQSNENSEGNARNKEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVSFIKQKFAELNLNPDKKTIYMHETCATDTNQVQLVISSVIDT

SEQ ID NO: 21983 - protein, 345 aa, Caenorhabditis elegans
MGSCQSNENSEGNARNKEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVSFIKQKFAELNLNPDKKTIYMHETCATDTNQVQLVISSVIDTI

SEQ ID NO: 21984 - protein, 346 aa, Caenorhabditis elegans
MGSCQSNENSEGNARNKEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVSFIKQKFAELNLNPDKKTIYMHETCATDTNQVQLVISSVIDTII

SEQ ID NO: 21985 - protein, 342 aa, Caenorhabditis elegans
MGSCQSNENSEGNARNKEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVSFIKQKFAELNLNPDKKTIYMHETCATDTNQVQLVISSVI

SEQ ID NO: 21986 - protein, 350 aa, Caenorhabditis elegans
MGSCQSNENSEGNARNKEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVSFIKQKFAELNLNPDKKTIYMHETCATDTNQVQLVISSVIDTIIQKNL

SEQ ID NO: 21987 - protein, 332 aa, Caenorhabditis remanei
NKEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVNFIKQKFAELNLNPDKKTIYMHETCATDTNQVQLVISSVIDTIIQ

SEQ ID NO: 21988 - protein, 343 aa, Caenorhabditis remanei
ENSEGNARNKEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVNFIKQKFAELNLNPDKKTIYMHETCATDTNQVQLVISSVIDTIIQKNL

SEQ ID NO: 21989 - protein, 333 aa, Caenorhabditis remanei
EIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVNFIKQKFAELNLNPDKKTIYMHETCATDTNQVQLVISSVIDTIIQKNL

SEQ ID NO: 21990 - protein, 340 aa, Caenorhabditis remanei
ENSEGNARNKEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVNFIKQKFAELNLNPDKKTIYMHETCATDTNQVQLVISSVIDTIIQ

SEQ ID NO: 21991 - protein, 340 aa, Caenorhabditis remanei
EGNARNKEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVNFIKQKFAELNLNPDKKTIYMHETCATDTNQVQLVISSVIDTIIQKNL

SEQ ID NO: 21992 - protein, 339 aa, Caenorhabditis remanei
EGNARNKEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVNFIKQKFAELNLNPDKKTIYMHETCATDTNQVQLVISSVIDTIIQKN

SEQ ID NO: 21993 - protein, 334 aa, Caenorhabditis remanei
KEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVNFIKQKFAELNLNPDKKTIYMHETCATDTNQVQLVISSVIDTIIQKNL

SEQ ID NO: 21994 - protein, 356 aa, Caenorhabditis briggsae
MGSCQSNENSEGNARNKEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSRAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVAFIKQKFAELNLNPDKKTIYMHETCATDTNQVQLVISSVIDTIIQKNLQKAGMM

SEQ ID NO: 21995 - protein, 333 aa, Caenorhabditis briggsae
MGSCQSNENSEGNARNKEIEKQLNADKRAGSSIVKLLLLGAGECGKSTVLKQMQILHSNGFTEEEVNEKRAIVYNNTVSAMCTILRAMDGVLHLPLENGQKEAEKAIVMKVQENGEEGEALTEEVSRAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVAFIKQKFAELNLNPDKKTIYMHETCATDTNQ

SEQ ID NO: 21996 - protein, 336 aa, Caenorhabditis remanei
RNKEIEKQLNADKRAGSSIVKLLLLGAGECGMSTVLKQMQILHSNGFTEEEVNEKRAIVYNNTVSAMCTILRAMDGVLHLPLENGQKEAEKAIVMKVQENGEEGEALTEEVSKAIQSLWADPGVKKAFEMRSEYQLPDSAKYFLDNCQRISEPGYRPNDQDILYSRVATTGVVEVKFKIKELDFRVFDVGGQRSERRKWIHCFDNVESIIFITAISEYDQVLFEDETTNRMIESMQLFNSICNSTWFLSTAMILFMNKKDLFMEKIQRVNITTAFPDYEGGQNYEEAVNFIKQKFAELNLNPDKKTIYMHETCATDTNQVQLVISSVIDTIIQKNL

SEQ ID NO: 21997 - protein, 577 aa, Streptococcus thermophilus
MTKMLKGIAASDGVAVAKAYLLVQPDLSFETVTVEDTSAEEARLDAALAASQDELSVIREKAVESLGEEAAAVFDAHLMVLADPEMTGQIKETIRAKQVNAEAALTEVTNMFIAIFEGMDDNPYMQERAADIRDVTKRVLANLLGKKLPNPATIDEESIIVAHDLTPSDTAQLNKKFVKAFVTDIGGRTSHSAIMARTLEIPAVLGTNNITELVKDGDILAVSGITGEVVINPTEEQIAEFKAAGEDYAKQKAEWAQLKDAPTVTADGKHFELAANIGTPKDVEGVNDNGAEAVGLYRTEFLYMDSQDFPTEEDQYEAYKAVLEGMNGKPVVVRTMDIGGDKELPYFDLPKEMNPFLGYRALRISISETGNQMFRTQLRALLRASVHGKLRIMFPMVALLTEFRTAKGILEEEKAKLVAEGVAVANDIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSILRTRSLMKKLDTAKMEEYANRALTECSTMEEVLELSKKYVNVD

SEQ ID NO: 21998 - protein, 773 aa, Hordeum brevisubulatum
MVVAAAILPELATQLVVPVAAAVGIAFAVLQWFLVSKVKVAPERRGEGSGSAGAGGGKDGASEYLIEEEEGLNDHNVVLKCAEIQTAISEGATSFLFTEYKYAGGFMTVFAVLIFVFLGSIEGFSTKSQPCHYSVGKTCKPALANAAFSTIAFVLGAVTSLVSGFLGMKIATYANARTTLEARKGVGKAFIVAFRSGAVMGFLLAASGLFVLYVAINLFGLYYGDDWEGLFEAITGYGLGGSSMALFGRVGGGIYTKTADVGADLVGKEERNIPEDDPRNPAVIADNVGDNVGDIAGMGSDLFGSYAESSCAALVVASISSFGINHEFTPMMYPLLISSVGIIACLITTLFATDFFEVKEVDQIEPALKKQLIISTAVMTVGIALVSWLGLPYTFTIFNFGAQKTVHSWQLFLCVAVGLWAGLVIGFITEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAGITTVDVLTPNVFIGLLVGAMLPYWFSAMTMKSVGSAALKMVEEVRRQFNTIPGLMEGTAKPDYATCVKISTDASTKEMIPPGALVMLTPLIVGTFFGVETLSGVLAGALVSGVQIAISASNTGGAWDNAKKYIEAGASEHAKSLGPKGSDCHKAAVIGDTIGDPLKDTSGPSLNILIKLMAVESLVFAPFFATYGGILFKYL

SEQ ID NO: 21999 - protein, 676 aa, Danio rerio
MPVDSTSELLKHYEVYETIGSGGFAKVKLGRHKLTGEKVAIKIMEKKDLGDDLPRVKIEIEAMKNLSHQHVCRLYHVIETTSKIYMVLEYCPGGELFDYIIAKDRLSEEETRVFFRQIISALAYVHSQGYAHRDLKPENLLIDEDHNLKLIDFGLCAKPKGGLGFELLTCCGSPAYAAPELIQGKAYIGSEADVWSMGVLLYALLCGFLPFDDDNCMVLYRKITRGKYSNPHWLSPSSILLLNQMMQVDPKRRLTVKHLLDHPWVMRGYSTPVEWHSKYPLGHIDEDCITEMAVTFKQSKQRTIQLVSEWKYDQITATYLLLLAKKRQGRPVRLRAECPVIDIVCSPLQDMQLKKSLRFTEDDDGVHPVVLGSMVFPPDCYDDENPWTPLTPKNTHTTNTPRMKLYPETTEKWNEMAYSPVIEHSRPCRQKPERRERTKENKENLAVPGTDGDVFALPAPRTPTYNRKVKSNRTVMTTPNHNNNKSSEVNKGAGSATKEGSRRREVEQQQNGQQGELNMLAFSPERRSRSLDLAGCQVDSGQKRKGGKVFGSLERGLDKVITMLTPSKKRGPRDGPRKIRAQYNVTLTNQTNADQVLNQILSILPEKNVDFVQKGYTLKCHTQSDFGKVTMQFELEVCLLQKPEVVGIRRQRLKGDAWVYKHLVEDILSSSSQWSA

SEQ ID NO: 22000 - protein, 608 aa, Tetragenococcus halophilus
MRKEEARARKEAIENRPPFRGLQINPTTSLFDEEGKEEIGERNWKGWGVDIHPQVTIPATIILLLFIILLSIFSQEANVVFDYILDAVTNYTGWFMILATAIFIGAGLFFAFSRYGKIVIGGNDAKPEFSRWGWFAMLLSAGMGIGLVFWSVAEPISHLGEPSPMFNVDPNSAGAVKTALTSSFFHWGIHPWAIYAIVGLGLAFFSYNKGLPLTIRSLFYPLIGNKIYGWWGNIIDILSVLATMTGLATSLGLGVSQVNAGLNYLFGISISPGIQIVLIIVITAFATTSVVLGLDKGVQKLSEINMVLAAIFALFILLVGPTVFILSGFTQNLGYYAANFIEMSFWTETFTSTNWQGSWTLFYWAWWISWSPFVGMFIARISKGRSVKEFIIGVVLVPTIISAIFMSILGGTALYQQINGINDLASVVNVDESLALFSLSDSLPLSSILSVVGIILVTVFFITSSDSGSLVIDHLTSGGKLDTPLAQRIFWAIIEGAVAAVLLIGGGLTALQTASIITGLPFTFVLLAMVYSLYLGLRQEFLIERAVREKLRKVRNDHIITEVVQSNVEDKALVENVAEKLAEEEDPEEDTNEETNEDDYNTESQSSQ

SEQ ID NO: 22001 - protein, 785 aa, Homo sapiens
RTPLGPQAAGAVATQVSPAVPLPPRRPSGMDSGRDFLTLHGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQKLQHWIHSCLRKADKNKDNKMSFKELQNFLKELNIQVDDSYARKIFRECDHSQTDSLEDEEIEAFYKMLTQRVEIDRTFAEAAGSGETLSVDQLVTFLQHQQREEAAGPALALSLIERYEPSETAKAQRQMTKDGFLMYLLSADGSAFSLAHRRVYQDMGQPLSHYLVSSSHNTYLLEDQLAGPSSTEAYIRALCKGCRCLELDCWDGPNQEPIIYHGYTFTSKILFCDVLRAIRDYAFKASPYPVILSLENHCTLEQQRVMARHLHAILGPMLLNRPLDGVTNSLPSPEQLKGKILLKGKKLGGLLPPGGEGGPEATVVSDEDEAAEMEDEAVRSRVQHKPKEDKLRLAQELSDMVIYCKSVHFGGFSSPGTPGQAFYEMASFSENRALRLLQESGNGFVRHNVGHLSRIYPAGWRTDSSNYSPVEMWNGGCQIVALNFQTPGPEMDVYQGRFQDNGACGYVLKPAFLRDPNGTFNPRALAQGPWWARKRLNIRVISGQQLPKVNKNKNSIVDPKVTVEIHGVSRDVASRQTAVITNNGFNPWWDTEFAFEVVVPDLALIRFLVEDYDASSKNDFIGQSTIPLNSLKQGYRHVHLMSKNGDQHPSATLFVKISLQD

SEQ ID NO: 22002 - protein, 606 aa, Homo sapiens
PASAVPTAGLRATRPQRASHMEAPEEPAPVRGGPEATLEVRGSRCLRLSAFREELRALLVLAGPAFLVQLMVFLISFISSVFCGHLGKLELDAVTLAIAVINVTGVSVGFGLSSACDTLISQTYGSQNLKHVGVILQRSALVLLLCCFPCWALFLNTQHILLLFRQDPDVSRLTQTYVTIFIPALPATFLYMLQVKYLLNQGIVLPQIVTGVAANLVNALANYLFLHQLHLGVIGSALANLISQYTLALLLFLYILGKKLHQATWGGWSLECLQDWASFLRLAIPSMLMLCMEWWAYEVGSFLSGILGMVELGAQSIVYELAIIVYMVPAGFSVAASVRVGNALGAGDMEQARKSSTVSLLITVLFAVAFSVLLLSCKDHVGYIFTTDRDIINLVAQVVPIYAVSHLFEALACTSGGVLRGSGNQKVGAIVNTIGYYVVGLPIGIALMFATTLGVMGLWSGIIICTVFQAVCFLGFIIQLNWKKACQQAQVHANLKVNNVPRSGNSALPQDPLHPGCPENLEGILTNDVGKTGEPQSDQQMRQEEPLPEHPQDGAKLSRKQLVLRRGLLLLGVFLILLAGVRWCDHSSLQPRTLGLQAILLCQPPE

SEQ ID NO: 22003 - protein, 602 aa, Homo sapiens
MDSLQDTVALDHGGCCPALSRLVPRGFGTEMWTLFALSGPLFLFQVLTFMIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQGWLKGQEEESPFQTPGLSILHPSHSHLSRASFHLFQKITWPQVLSGVVGNCVNGVANYALVSVLNLGVRGSAYANIISQFAQTVFLLLYIVLKKLHLETWAGWSSQCLQDWGPFFSLAVPSMLMICVEWWAYEIGSFLMGLLSVVDLSAQAVIYEVATVTYMIPLGLSIGVCVRVGMALGAADTVQAKRSAVSGVLSIVGISLVLGTLISILKNQLGHIFTNDEDVIALVSQVLPVYSVFHVFEAICCVYGGVLRGTGKQAFGAAVNAITYYIIGLPLGILLTFVVRMRIMGLWLGMLACVFLATAAFVAYTARLDWKLAAEEAKKHSGRQQQQRAESTATRPGPEKAVLSSVATGSSPGITLTTYSRSECHVDFFRTPEEAHALSAPTSRLSVKQLVIRRGAALGAASATLMVGLTVRILATRH

SEQ ID NO: 22004 - protein, 267 aa, Candida albicans
MANEEYVTDSSSDFTEYWIDLFLGIKGNEYFCDIDDEYIRDRFNLTGLNSEVSKLPTLIDIITDVIDIELQPEEHKDSLEHNARILYGLIHARYILTTRGLNKMFEKFRSGDFGYCPRVHCQLNPLLPIGLNDQPRMASVKLYCSKCEDLYNPKSGRHSAIDGAYFGTSFPAMFFQNFPNTVPIHAKETYVPRVFGFKLHEYSKLNRWRELQRLKLENRLKKNGIQIDNVVGGFITNGDEEEKQDNNNNKQLQSVSSQFKSLSPNQK

SEQ ID NO: 22005 - protein, 533 aa, Pleurotus ostreatus
MAVAFVALVSLALALVRVEASIGPRGTLNIANKVIQPDGFYRSTVLAGGSYPGPLIKGKTGDRFQINVVNKLADTSMPVDTSIHWHGLFVKGHNWADGPAMVTQCPIVPGHSFLYDFEVPDQAGTFWYHSHLGTQYCDGLRGPLVVYSKNDPHKRLYDVDDESTVLTVGDWYHAPSLSLTGVPHPDSTLFNGLGRSLNGPASPLYVMNVVKGKRYRIRLINTSCDSNYQFSIDGHTFTVIEADGENTQPLQVDQVQIFAGQRYSLVLNANQAVGNYWIRANPNSGDPGFENQMNSAILRYKGARSIDPTTPEQNATNPLHEYNLRPLIKKPAPGKPFPGGADHNINLNFAFDPATALFTANNHTFVPPTVPVLLQILSGTRDAHDLAPAGSIYDIKLGDVVEITMPALVFAGPHPIHLHGHTFAVVRSAGSSTYNYENPVRRDVVSIGDDPTDNVTIRFVADNAGPWFLHCHIDWHLDLGFAVVFAEGVNQTAAANPVPEAWNNLCPIYNSSNPSKLLMGTNAIGRLPAPLKA

SEQ ID NO: 22006 - protein, 91 aa, Gossypium barbadense
MDGAPYLRKIDLKIYSGYPELLQAIENMFKFTIGEYSEREGYKGSDYAPTYEDKDGDWMLVGDVPWEMFITSCKRLRIMKGSEARGLGCGV

SEQ ID NO: 22007 - protein, 343 aa, Oryza sativa (japonica cultivar-group)
MAPPLLPAAEEDGGCVARWMRRDVLLGLALGQFVSLLITSTGFSSSELARRGINAPTSQSLLNYILLSLIYGGILIYRRQPLTIKWYYYLILGIIDVEANYIVVKSYQYTSLTSVMLLDCWSIPCVIILTWIFLKTKYGLRKFIGVGVCVAGLILVVFSDVHASDRAKGPNPLKGDLLVIFGSMLYACSNVTENTTKYLKGIKLNTSNATKIWQCQNYPKFGNVKIDNKVNNVCWQLVLPFLGFALAMFLFYSTVPTVLKICGATMLNLSLLTSDMWAVLIRIFAYHEKVDWIYFVAFAGTAAGLLIYSYKSSKEAEETAQVAGASDKQGKAGDEEAGMQNSS

SEQ ID NO: 22008 - protein, 267 aa, Shigella flexneri 2a str. 2457T
MAIPAFGLGTFRLKDDVVISSVKTALELGYRAIDTAQIYDNEAAVGQAIAESGVPRHELYITTKIWIENLSKDKLIPSLKESLQKLRTDYVDLTLIHWPSPNDEVSVEEFMQALLEAKKQGLTREIGISNFTIPLMEKVIAAVGAENIATNQIELSPYLQNRKVVAWAKQHGIHITSYMTLAYGKALKDEVIARIAAKHNAIPAQVILAWAMGEGYSVIPSSTKRKNLESNLKAQNLQLDAEDKKAIAALDCNDRLVSPEGLAPEWD

SEQ ID NO: 22009 - protein, 620 aa, Shigella flexneri 2a str. 2457T
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKNRRTVCVIGDGAITAGMAFEAMNHAGDIRPDMLVVLNDNEMSISENVGALNNHLAQLLSGKLYSSLREGGKKVFSGVPPIKELLKRTEEHIKGMVVPGTLFEELGFNYIGPVDGHDVLGLITTLKNMRDLKGPQFLHIMTKKGRGYEPAEKDPITFHAVPKFDPSSGCLPKSSGGLPSYSKIFGDWLCETAAKDNKLMAITPAMREGSGMVEFSRKFPDRYFDVAIAEQHAVTFAAGLAIGGYKPIVAIYSTFLQRAYDQVLHDVAIQKLPVLFAIDRAGIVGADGQTHQGAFDLSYLRCIPEMVIMTPSDENECRQMLYTGYHYNDGPSAVRYPRGNAVGVELTPLEKLPIGKGIVKRRGEKLVILNFGTLMPETAKVAESLNATLVDMRFVKPLDEALILEMAASHEALVTVEENAIMGGAGSGVNEVLMAHRKPVPVLNIGLPDFFIPQGTQEEMRAELGLDAAGMEAKIKAWLA

SEQ ID NO: 22010 - protein, 495 aa, Shigella flexneri 2a str. 2457T
MNFHHLAYWQDKALSLAIENRLFINGEYTAAAENETFETVEPVTQAPLAKIARGKSVDIDRAVSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQKAASATAAGIFYNQGQVRIAGTRLLLEESIADEFLALLKQQAQNWQPGHPLDPATTMGTLIDSAHADSVHTFIREGEGKGQLLLDGRNAGLAAAIGPTIFVDVDPNASLSREEIFGPVLVVTRFTSEDQALQLANDSQYGLGAAVWTRDLSRAHRMSRRLKAGSVFVNNYNDGDMTVPFGGYKQSGNGRDKSLHALEKFTELKTIWISLEA

SEQ ID NO: 22011 - protein, 253 aa, Shigella flexneri 2a str. 2457T
MQQKMIQFSGDVSLPAIGQGTWYMGEDASQRKTEVAALRAGIELGLTLIDTAEMYADGGAEKVVGEALTGLREKVFLVSKVYPWNAGGQKAINACEASLRRLNTDYLDLYLLHWSGSFAFEETVAAMEKLIAQGKIRRWGVSNLGYADMQELWQLPGGNQCATNQVLYHLGSRGIEYDLLPWCQQQQMPVMAYSPLAQAGRLRNGLLKNAVVNEIAHVQQHAAALEVELSSAELAMLDKAYPAPKGKTALDMV

SEQ ID NO: 22012 - protein, 315 aa, Shigella flexneri 2a str. 2457T
MDNLDVICIGAAIVDIPLQPVSKNIFDVDSYPLERIAMSTGGDAINEATIISRLGHRTALMSRIGKDASGQFILDHCRKENIDIQSLKQDVSIDTSINVGLVTEDGERTFVTNRNGSLWKLNIDDVDFARFPQAKLLSLASIFNSPLLDGKALTEIFTQAKARQMIICADMIKPRLNETLDDICEALSYVDYLFPNFAEEKLLTGKETLDEIADCFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 22013 - protein, 266 aa, Shigella flexneri 2a str. 2457T
MLAGLRFMLVAFPAIFFVARPKVPLNLLLGYGLTISFAQFAFLFCAINFGMPAGLASLVLQAQAFFTIVLGAFTFGERLHGKQLAGIALAIFGVLVLIEDSLNGQHVAMLGFMLTLAAAFSWACGNIFNKKIMSHSTRPAVMSLVIWSALIPIIPFFVVSLILDGSASMIHSLVTIDMTTILSLMYLAFVATIVGYGIWGTLLGRYETWRVAPLSLLVPVVGLASAALLLDERLTGLQFLGAVLIMTGLYINVFGLRWRKAVKVGS

SEQ ID NO: 22014 - protein, 457 aa, Shigella flexneri 2a str. 2457T
MQKYISEARLLLALAIPVILAQIAQTAMGFVDTVMAGGYSATDMAAVAIGTSIWLPAILFGHGLLLALTPVIAQLNGSGRRERIAHQVRQGFWLAGFVSVLIMLVLWNAGYIIRYMENIDPALADKAVGYLRALLWGAPGYLFFQVARNQCEGLAKTKPGMVMGFIGLLVNIPVNYIFIYGHFGMPELGGVGCGVATAAVYWVMFLAMVSYIKRARSMRDIRNEKGTAKPEPAVMKRLIQLGLPIALALFFEVTLFAVVALLVSPLGIVDVAGHQIALNFSSLMFVLPMSLAAAVTIRVGYRLGQGSTLDAQTAARTGLMVGVCMATLTAIFTVSLREQIALLYNDNPEVVTLAAHLMLLAAVYQISDSIQVIGSGILRGYKDTRSIFYITFTAYWVLGLPSGYILALTDLVVEPMGPAGFWIGFIIGLTSAAIMMMLRMRFLQRMPSAIILQRASR

SEQ ID NO: 22015 - protein, 369 aa, Shigella flexneri 2a str. 2457T
MNEQSQAKSPEALRAMVAGTLANFQHPTLKHNLTTLKALHHVAWMDDTLHVELVMPFVWHSAFEELKEQCSAELLRITGAKAIDWKLSHNIATLKRVKNQPGINGVKNIIAVSSGKGGVGKSSTAVNLALALAAEGAKVGILDADIYGPSIPTMLGAENQRPTSPDGTHMAPIMSHGLATNSIGYLVTDDNAMVWRGPMAGKALMQMLQETLWPDLDYLVLDMPPGTGDIQLTLAQNIPVTGAVVVTTPQDIALIDAKKGIVMFEKVEVPVLGIVENMSVHICSNCGHHEPIFGTGGAEKLAEKYHTQLLGQMPLHISLREDLDKGTPTVISRPESEFTAIYRQLADRVAAQLYWQGEVIPGEISFRAV

SEQ ID NO: 22016 - protein, 949 aa, Shigella flexneri 2a str. 2457T
MKYLASFRTTLKASRYMFRALALVLWLLIAFSSVFYIVNALHQRESEIRQEFNLSSDQAQRFIQRTSDVMKELKYIAENRLSAENGVLSPRGRETQADVPAFEPLFADSDCSAMSNTWRGSLESLAWFMRYWRDNFSAAYDLNRVFLIGSDNLCMANFGLRDMPVERDTALKALHERINKYRNAPQDDSGSNLYWISEGPRPCVGYFYALTPVYLANRLQALLGVEQTIRMENFFLPGTLPMGVTILDENGHTLISLTGPESKIKGDPRWMQERSWFGYTEGFRELVLKKNLPPSSLSIVYSVPVDKVLERIRMLILNAILLNVLAGAALFTLARMYERRIFIPAESDALRLEEHEQFNRKIVASAPVGICILRTADGVNILSNELAHTYLNMLTHEDRQRLTQIICGQQVNFVDVLTSNNTNLQISFVHSRYRNENVAICVLVDVSSRVKMEESLQEMAQAAEQASQSKSMFLATVSHELRTPLYGIIGNLDLLQTKELPKGVDRLVTAMNNSSSLLLKIISDILDFSKIESEQLKIEPREFSPREVMNHITANYLPLVVRKQLGLYCFIEPDVPVALNGDPMRLQQVISNLLSNAIKFTDTGCIVLHVRADGDYLSIRVRDTGVGIPAKEVVRLFDPFFQVGTGVQRNFQGTGLGLAICEKLISMMDGDISVDSEPGMGSQFTVRIPLYGAQYPQKKGVEGLSGKRCWLAVRNASLCQFLETSLQRSGIVVTTYEGQEPTPEDVLITDEVVSKKWQGRAVVTFCRRHIGIPLEKAPGEWVHSVAAPHELPALLARIYLIEMESDDPANALPSTDKAVSDNDDMMILVVDDHPINRRLLADQLGSLGYQCKTANDGVDALNVLSKNHIDIVLSDVNMPNMDGYRLTQRIRQLGLTLPVIGVTANALAEEKQRCLESGMDSCLSKPVTLDVIKQTLTVYAERVRKSRDS

SEQ ID NO: 22017 - protein, 1197 aa, Shigella flexneri 2a str. 2457T
MKFLPYFFLLCCGLWSTISFADEDYIEYRGISSNNRVTLDPVRLSNKELRWLASKKNLVIAVHKSQTATLLHTDSQQQVRGINADYLNLLKRALNIKLTLREYADHQKAMDALAEGEVDIVLSHLVTSPPLNNDIAATKPLIITFPALVTTLHDSMRPLTSPKPVNIARVANYPPDEVIHQSFPKATIISFTNLYQALASVSAGHNDYFIGSNIITSSMISRYFTHSLNVVKYYNSPRQYNFFLTRKESVILNEVLNRFVDALTNEVRYEVSQNWLDTGNLAFLNKPLELTEHEKQWIKQHPNLKVLENPYSPPYSMTDENGSVRGVMGDILNIITLQTGLNFFPITVSHNIHAGTQLSPGGWDIIPGAIYSEDRENNVLFAEAFITTPYVFVMQKAPDSEQTLKKGMKVAIPYYYELHSQLKEMYPEVEWIQVDNASAAFHKIKEGELDALVATQLNSRYMIDHYYPNELYHFLIPGVPNASLSFAFPRGEPELKDIINKALNAIPPSEVLRLTEKWIKMPNVTIDTWDLYSEQFYIVTTLSVLLVGSSLLWGFYLLRSVRRRKVIQGDLENQISFRKALSDSLPNPTYVVNWQGNVISHNSAFEHYFTADYYKNAMLPLENSDSPFKDVFSNAHEVTAETKENRTIYTQVFEIDNGIEKRCINHWHTLCNLPASDNAVYICGWQDITETRDLINALEVEKNKAIKATVAKSQFLATMSHEIRTPISSIMGFLELLSGSGLSKEQRVEAISLAYATGQSLLGLIGEILDVDKIESGNYQLQPQWVDIPTLVQNTCHSFGAIAASKSIALSCSSTFPDHYLVKIDPQAFKQVLSNLLSNALKFTTEGAVKITTSLGHIDDNHAVIKMTIMDSGSGLSQEEQQQLFKRYSQTSAGRQQTGSGLGLMICKELIKNMQGDLSLESHPGIGTTFTITIPVEISQQVATVEAKAEQPITLPEKLSILIADDHPTNRLLLKRQLNLLGYDVDEATDGVQALHKVSMQHYDLLITDVNMPNMDGFELTRKLREQNSSLPIWGLTANAQANEREKGLSCGMNLCLFKPLTLDVLKTHLSQLHQVAHIAPQYRHLDIEALKNNTANDLQLMQEILMTFQHETHKDLPAAFHALEAGDNRTFHQCIHRIHGAANILNLQKLINISHQLEITPASDDSKPEILQLLNSVKEHIAELDQEIAVFCQKND

SEQ ID NO: 22018 - protein, 831 aa, Shigella flexneri 2a str. 2457T
MLTIQFLCPLPNGLHARPAWELKEQCSQWQSEITFINHRQNAKADAKSSLALIGTGTLFNDSCSLNISGSDEEQARRVLEEYILVRFIDSDSVQPTQAELTAHPLPRSLSRLNPDLLYGNVLASGVGVGTLTLLQSDSLDSYRAIPASAQDSTRLEHSLATLAEQLNQQLRERDGESKTILSAHLSLIQDDEFAGNIRRLMTEQHQGLGAAIISNMEQVCAKLSASASDYLRERVSDIRDISEQLLHITWPELKPRNNLVLEKPTILVAEDLTPSQFLSLDLKNLAGMILEKTGRTSHTLILARASAIPVLSGLPLDAIARYAGQPAVLDAQCGVLAINPNDAVSGYYQVAQTLADKRQKQQAQAAAQLAYSRDNKRIDIAANIGTALEAPGAFANGAEGVGLFRTEMLYMDRDSAPDEQEQFEAYQQVLLAAGDKPIIFRTMDIGGDKSIPYLNIPQEENPFLGYRAVRIYPEFAGLFRTQLRAILRAASFGNAQLMIPMVHSLDQILWVKGEIQKAIVELKRDGLRHAETITLGIMVEVPSVCYIIDHFCDEVDFFSIGSNDMTQYLYAVDRNNPRVSPLYNPITPSFLRMLQQIVTTAHQRGKWVGICGELGGESRYLPLLLGLGLDELSMSSPRIPAVKSQLRQLDSEACRELARQACECRSAQEIEALLTAFTPEEDVRPLLALENIFVDQDFSNKEQAIQFLCGNLGVNGRTEHPFELEEDVWQREEIVTTGVGFGVAIPHTKSQWIRHSSISIARLAKPVDWQSEMGEVELVIMLTLGANEGMNHVKVFSQLARKLVNKNFRQSLFAAQDAQSILTLLETELTF

SEQ ID NO: 22019 - protein, 263 aa, Shigella flexneri 2a str. 2457T
MGKLTGKTALITGALQGIGEGIARTFARHGANLILLDISPEIEKLADELCGRGHRCTAVVADVRDPASVAAAIKRAKEKEGRIDILVNNAGVCRLGSFLDMSDEDRDFHIDINIKGVWNVTKAVLPEMIARKDGRIVMMSSVTGDMVADPGETAYALTKAAIVGLTKSLAVEYAQSGIRVNAICPGYVRTPMAESIARQSNPEDPESVLTEMAKAIPLCRLADPLEVGELAAFLASDESSYLTGTQNVIDGGSTLPETVSVGI

SEQ ID NO: 22020 - protein, 472 aa, Shigella flexneri 2a str. 2457T
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGAAFLTLLDSIGAAGTFWLYTALNIAFVGITFWLIPETKNVTLEHIERKLMAGEKLRNIGV

SEQ ID NO: 22021 - protein, 321 aa, Shigella flexneri 2a str. 2457T
MMSLAWPLFRVTEQAALAAWPQTGCGDKNKIDGLAVTAMRQALNDVAFRGRVVIGEGEIDHAPMLWIGEEVGKGDGPEVDIAVDPIEGTRMVAMGQSNALAVMAFAPRDSLLHAPDMYMKKLVVNRLAAGAIDLSLPLADNLRNVARALGKPLDKLRMVTLDKPRLSAAIEEATQLGVKVFALPDGDVAASVLTCWQDNPYDVMYTIGGAPEGVISACAVKALGGDMQAELIDFCQAKGDYTENRQIAEQERKRCKAMGVDVNRVYSLDELVRGNDILFSATGVTGGELVNGIQQTANGVRTQTLLIGGADQTCNIIDSLH

SEQ ID NO: 22022 - protein, 451 aa, Shigella flexneri 2a str. 2457T
MTFFVCFLAALAGLLFGLDIGVIAGALPFIADEFQITSHTQEWVVSSMMFGAAVGAVGIGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 22023 - protein, 236 aa, Shigella flexneri 2a str. 2457T
MGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGKIAKLDQGKRLGPDPDQFGG

SEQ ID NO: 22024 - protein, 608 aa, Shigella flexneri 2a str. 2457T
MEQNPQSQLKLLVTRGKEQGYLTYAEVNDHLPEDIVDSDQIEDIIQMINDMGIQVMEEAPDADDLMLAENTADEDAAEAAAQVLSSVESEIGRTTDPVRMYMREMGTVELLTREGEIDIAKRIEDGINQVQCSVAEYPEAITYLLEQYDRVEAEEARLSDLITGFVDPNAEEDLAPTATHVGSELSQEDLDDDEDEDEEDGDDDSADDDNSIDPELAREKFAELRAQYVVTRDTIKAKGRSHAAAQEEILKLSEVFKQFRLVPKQFDYLVNSMRVMMDRVRTQERLIMKLCVEQCKMPKKNFITLFTGNETSDTWFNAAIAMNKPWSEKLHDVSEEVHRALQKLQQIEEETGLTIEQVKDINRRMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELAERMLMPEDKIRKVLKIAKEPISMETPIGDDEDSHLGDFIEDTTLELPLDSATTESLRAATHDVLAGLTAREAKVLRMRFGIDMNTDHTLEEVGKQFDVTRERIRQIEAKALRKLRHPSRSEVLQ

SEQ ID NO: 22025 - protein, 542 aa, Shigella flexneri 2a str. 2457T
MIAVVKLLPTGEDFASHVYPCYTSHRKETIMTNNPPSAQIKPGEYGFPIKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 22026 - protein, 466 aa, Shigella flexneri 2a str. 2457T
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKQGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 22027 - protein, 142 aa, Oncorhynchus tshawytscha
REDRTTWKSNYFMKIIQLLDDYPKCFIVGADNVGSKQMQAIRLSLRGKAVVLMGKNTMMRKAIRGHLENNPALEKLLPHIKGNVGFVFTKEDLAEIRDMLLANKVPAAARAGAIAPCDVTVPAQNTGLGPEKTSFFQALGIT

SEQ ID NO: 22028 - protein, 134 aa, Oncorhynchus kisutch
SNYFMKIIQLLDDYPKCFIVGADNVGSKQMQAIRLSLRGKAVVLMGKNTMMRKAIRGHLENNPALEKLLPHIKGNVGFVFTKEDLAEIRDMLLANKVPAAARAGAIAPCDVTVPAQNTGLGPEKTSFFQALGIT

SEQ ID NO: 22029 - protein, 545 aa, Vigna unguiculata
MALPHSISALSTTLTLSSSVNKPTTNKVNSFPFLSNKGTQFFTKQTRPRSGRSPLLTPARVAAPPSTVETDQSFPETEKGETEEEFNEESSSSKFTWRDHWYPVSLIEDLNPLLPTPFQLLGREIVRTTSPLPKWVAFDDKCPHRLAPLSEGRIDEDGKLQCSYHGWSFDGCGSCVKIPQAASEGPEARAVGSPKACATRFPTLVSQGLLFVWPDENGWEKASASKPPMLPDEFEKPEFATVNIQRDLFYGYDTLMENVSDPSHIEFAHHKVTGRRDRAKPLPFKMDARGSWGFSGANEGNPKISAKFVAPCYYMNKIEIDTKLPVVGDQKWVVWICSFNVPMAPGKTRSIFSARNFFQFTVPGPAWWQVVPRWYEHWTSNKVYDGDMIVLQGQEKIFLSKTKEGDDINKQYTSITFTPTQADRFVLAFRNWLRRHGNGQPEWFSSIPDLPLPSTVLSKREMLDRLEQHTLKCSSCKEAYEGFQIWQKVLIGATVIFCATSGIPADVQFRVLLAGLAIVSAALAFTLNQLQKNFEFVDYVHAEIE

SEQ ID NO: 22030 - protein, 348 aa, Danio rerio
MSQKARPTFYRQELNKTIWEVPERYQNLSPVGSGAYGSVMSAFDGKAGLRVAVKKLSRPFQSIIHAKRTYRELRLLKHMKHENVIGLLDVFSPATSLEGFNDVYLVTHLMGADLNNIVKCQKLTDDHVQFLIYQILRALKYIHSADIIHRDLKPSNLAVNEDCELKILDFGLARLTDDEMTGYVATRWYRAPEIMLNWMHYNMTVDIWSVGCIMAELLTGRTLFPGTDHINQLQQIMRLTGTPPASLISRMPSHEARNYISSLPHMPKRNFADVFIGANPLAVDLLEKMLVLDTDKRITASQALAHPYFAQYHDPDDEPEADPYDQSFESRDLEIEEWKSKIYIQNRN

SEQ ID NO: 22031 - protein, 244 aa, Triticum monococcum
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAHAAQQDQTQPQTSSSSSSFMLRDAPPAANTSIHPAAAGERAEDAAVQPQAPPRTGLPPWMVSHING

SEQ ID NO: 22032 - protein, 114 aa, Lycopersicon esculentum
MAEEKHQHHHHLFHHKNKEDEGGPVDYEKEVKHHSHLEKIGELGAVAAGALALHEKHKAKKDPEHAHKHKIEEEIAAVAAVGAGGFAFHEHHQKKDAKKEKKEVEGGHHHHHHY

SEQ ID NO: 22033 - protein, 402 aa, Trichomonas vaginalis
MGCSASKPSEPSNAKLPSAPVPKKVEQVPEPKPEPQPQPEPQPQPEPPKPAEPAPAPAPAPEPQKPAEPAPKVVAVEDDTNEAYGLLLCGAGESGKTTFTRQLKLRYLNGFNEKDCRDFLRTIRGNLVETMQLLLVWLEHNNIEIEDSELSSMAQDIIDVDPQDCEFNEELVEKLKALWENEQIKKAFEHKDETAVPDHMPYFFAKIDELAGEDYIPSNEDVLRARIRSIGIEAITFDLQGARIRIFDVGGQKSERSKWANVMNQVEGVIFCVSFAEFDKPMFEDQNVLRINDSLEIFGNITHQEKFSNSPIFLVCNKFDVFTEKIKNTDAFVKIFPEFSGDSHNPEACADYLIQRFLDKAAPLSEDRPIIQYKIVALNGDQVVETADAICKFISDKYYQDA

SEQ ID NO: 22034 - protein, 276 aa, Arabidopsis thaliana
MEAAAAADSSIPRDKDFGKFQFGCEHYKRRCKIRAPCCNLIFSCRHCHNDSANSLPDPKERHDLVRQNVKQVVCSICQTEQEVAKVCSNCGVNMGEYFCDICKFFDDDISKEQFHCDDCGICRVGGRDKFFHCQNCGACYGMGLRDKHSCIENSTKNSCPVCYEYLFDSVKAAHVMKCGHTMHMDCFEQMINENQYRCPICAKSMVDMSPSWHLLDFEISATEMPVEYKFEVSILCNDCNKGSKAMFHILGHKCSDCGSYNTRRISTPQDPVSETE

SEQ ID NO: 22035 - protein, 525 aa, Oryza sativa (japonica cultivar-group)
MAPVSLHLLSLTRLSLPFRDTVTNPSTPRIPPWRRQWISPTDARRRRLSMPVSAVAAEAPLPRAVDEKETPAAGEERFDWLDQWYPVAPVRDLDKRKPHGKMVMGISVVVWFDGGGGEWRVVDDACPHRLAPLSEGRVDGKGCLQCAYHGWCFDGHGSCQFIPQAPALGPPVHKNSKACVASYPSVVQNNILWFYPRSEPEYKEILQRKRPPYIRELDDPSSVINSGVRDLLYGYRNYLQAIHKQLDASMYVCVFEFDQEGGLPIKMNIEELNIAGFHSNPEENWGYFKFIAPVTLIGSPFRAKPVVDQDNNNTNNKKQPEVTTVFFCIPVSPGRCRVIWANGYNLDGWFDKMIPRWWLHIKTNQVLDSDSSVLHIEERNYAAFGLDNWHKACYVPTSSDNLIIAFRNWFKKYCNNQVGWLTPMVNQLPPASTRVEVYERYWSHVMQCTSCSAALKWMRALEVALQVASVAVVGFLAAGKGTVVTSGVQRAAVVAAAVLCFAASRWLAGFIEKTFYFEDYVLADK

SEQ ID NO: 22036 - protein, 555 aa, Oryza sativa (japonica cultivar-group)
MAPVSLPLLSRARPPLLLRDAGVKLSTVRLPPPWRQQWKHTSGERRRRLSMPASAVAAETPPPHARAEEEEEAAPAVGGGEEGRFEWLDQWYPVAPVCDLDPRKPHGKMVMGLRVVAWFDGGGGGEWRVVDDACPHRLAPLSEGRVDGKGRLQCAYHGWCFDGHGSCQFIPQAPALGPPVHKNSKACVASYPSVVQNNILWFYPRSEPEYKEILQRKRPPYFPDLDDPSFNTVFGVRDLFYGYDVLVENLMDPAHVPYAHKGLMPIQNKEDPGRYCSTVHLLSTVESDQEGGYPVKIRTEQAKIDGFLSVQEDDVCYMKFDAPCTLYGKPFRTKEPQIDQGKEKKKKKQPEAMTVFLCVPVAPGRSRLIWAFPRNVDAWLDNIIPRWLYHIVTNIVLDSDSYLLHIEERNFATVGLDNWHKACYVPTSSDNMVITFRNWFRKYCKHQIGWATPMANQLPPTPTKDQVLERYRSHVMQCTSCSAALKKMKALEVALQVASVAIVGFLAVAKGSLAPSVVRRAAAVSTAVLCFAASRWLASFIEKSFYFQDYVHAYK

SEQ ID NO: 22037 - protein, 511 aa, Oryza sativa (japonica cultivar-group)
MVMGLSVVAWLDGGGEWRVVDDACPHRLAPLSEGRVDGKGRLQCAYHGWCFDGHGSCQFIPQAPALGPPVHKNSKACVASYPSVVQNNILWFYPRSEPEYCDVLKRKRPPYVPEIDDDDPSHFMVYGVRDLLYGYELLVENLMDPAHVPYAHKGLFVEFDLEHGSPMKMRIEEASIDGFHSNLDGDWGYFKFVAPCTLYGTPFRTDLEADEVKKKKKKKPEVRVVLFTVPVAPGRSRFIWASRYKVGGWLDKILPRWFYHMTSNTILDSDTYLHVEDRNITTVGLDNWHKACYVPTSSDNLVIAYRNWFRKYCNHQIGWANPNPTVKQQLPQTPTRDQLLERYWSHVMQCTSCRAALKGMRALEITLQVAAVAVVGFLAAGKETAVMSGVQRASPPPAGSPTSSRRPSISRIMSMLTNDASIQEICDVLLLLGICHEPGLRRGFRLHRLAVSWPSWFRDAAINQQPKLETLWPCVCVIHAEARPGIQSFSLSKNKRSQATAKGIHEETASA

SEQ ID NO: 22038 - protein, 305 aa, Miscanthus condensatus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 22039 - protein, 305 aa, Miscanthus condensatus
IESVGEGVTDVAPGDHVLPVFTGECKECAHCRSAESNMCDLLRINTDRGVMIGDGKSRFSINGKPIYHLVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 22040 - protein, 305 aa, Miscanthus condensatus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMSFLNERTLKGTFFGNFKPRTDLPNVVELYMKKELEVEKFITHSVPFAEINKAFDLMAKGEGIRCIIRMEN

SEQ ID NO: 22041 - protein, 305 aa, Miscanthus condensatus
IESVGEGVTDVAPGDHVLPVFTGECKECAHCRSAESNMCDLLRINTDRGVTIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYVKKELEVEKFITHSVPFAEINKAFDLMAKGEGIRCIIRMEN

SEQ ID NO: 22042 - protein, 305 aa, Miscanthus condensatus
IESVGEGVTDVAPGDHVLPVFTGECKECAHCRSAESNMCDLLRINTDRGVKIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMSFLNERTLKGTFFGNFKPRTDLPNVVELYMKKELEVEKFITHSVPFAEINKAFDLMAKGEGIRCIIRMEN

SEQ ID NO: 22043 - protein, 305 aa, Miscanthus condensatus
IESVGEGVTDVAPGDHVLPVFTGECKECAHCRSAESIMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNLLNERTLKGTFFGNFKPRTDLPNVVELYMKKELEVEKFITHSVPFAEINKAFDLMAKGEGIRCIIRMEN

SEQ ID NO: 22044 - protein, 305 aa, Miscanthus condensatus
IESVGEGVTDVAPGDHVLPVFTGECKECAHCRSAESNMCDLLRTNTDRGVMIGDGKSRFSINGKPIYHFVGTSTFSEYTVMHVGCVAKINPEAPLDKVCVLSWGISTGLGASINVAKPPKGSTVAIFGLGAVGLAAAEGARIAGASRIIGVDLNPSGFEEARKFGCTEFLNPKDHKKPVQEVLAEMTNGGVDRSVECTGNINAMIQAFECVHDGWGVAVLVGVPHKDAEFKTHPMNLLNERTLKGTFFGNFKPRTDLPNVVELYMKKELEVEKFITHSVPFAEINKAFDLMAKGEGIRCIIRMEN

SEQ ID NO: 22045 - protein, 305 aa, Miscanthus condensatus
IESVGEGVTDVAPGDHVLPVFTGECKECAHCRSAESNMCDLLRINTDRGVMIGDGKSRFSINGKPIYHFVGTSTFSEYTVMHVGCVAKIDPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 22046 - protein, 305 aa, Miscanthus condensatus
IESVGEGVTDVAPGDHVLPVFTGECKECAHCRSAESNMCDLLRINTDRGVMIGDGKSRFSINGKPIYHFVGTSTFSEYTVMHVGCVAKIDPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPRKDAEFKTHPMNFLNERTLKGTFFGNFKPRTDLPNVVELYMKKELEVEKFITHSVPFAEINKAFDLMAKGEGIRCIIRMEN

SEQ ID NO: 22047 - protein, 305 aa, Miscanthus condensatus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22048 - protein, 305 aa, Miscanthus floridulus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARTAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFELMAKGEGIRCIIRMEN

SEQ ID NO: 22049 - protein, 305 aa, Miscanthus sinensis var. formosanus
IESVGEGVTDVAPGDHVLPVSTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 22050 - protein, 305 aa, Miscanthus sinensis var. formosanus
IESVGEGVTDVAPGDHVLPVFTGECKECAHCRSAESNMCDLLMINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFVCVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 22051 - protein, 305 aa, Miscanthus sinensis var. formosanus
IESVGEGVTDVAPGDHVLPVFTGECKECPHCKSAESNMYDLLRINTDRGVMIGDGKSRFSINGKPIYHFVGTSTFSEYTVMHVGCVAKINPQAPLDKVCVLSCGISTGLGASINVAKPPKGSTVAIFGLGAAGLAAAEGARIAGASRIIGVDLNPSRFEEARKFGCTEFVNPKDHKKPVQEVLAEMTNGGVDRNVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 22052 - protein, 305 aa, Miscanthus sinensis var. formosanus
IESVGEGVTDVAPGDHVLPVFTGECKECAHCRLAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTGFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 22053 - protein, 305 aa, Miscanthus sinensis var. formosanus
IESVGEGVTDVAPGDHVLPVFTGECKECAHCRSAESNMCDLPRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRGVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22054 - protein, 305 aa, Miscanthus sinensis f. glaber
IESVGEGVTDVAPGDHVLPVFTGECKECPHCKSAESNMCDLLRINTDRGVMIGDGKSLFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNISAMIQAFECVHDGWGVAVLVGVPHKDAELKTHPMNFLNERTLKGTFFGDFKPRTDLPNVVELYMKKELEVEKFITHSVPFAEINKAFDLMAKGEGIRCIIRMEN

SEQ ID NO: 22055 - protein, 305 aa, Miscanthus sinensis f. glaber
IESVGEGVTVVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLTAAEGARIAGGSRIIGVDLNPSRFEEARKFGCTEFVNPKDHKKPVQEVLAEMTNGGVDRSVECTGNINAMVQAFECVHDGWGVAVLVGVPHKDAELKTHPMNFLNERTLKGTFFGDFKPRTDLPNVVELYMKKELEVEKFITHSVPFAEINKAFDLMAKGEGIRCIIRMEN

SEQ ID NO: 22056 - protein, 305 aa, Miscanthus sinensis f. glaber
IESVGEGVTDVAPGDHVLPVLTGECKECAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRNVECTGNINAMIQAFECVHDGWGVAVLVGVPHKDAEFKTHPMNFLNERTLKGTFFGNFKPRTDLPNVVELCMKKELEVEKFITHSVPFAEISKAFDLMAKGEGIRCIIRIEN

SEQ ID NO: 22057 - protein, 305 aa, Miscanthus sinensis f. glaber
IESVGEDVTDVAPGDHVLPVFTGECKERAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSILFAEISKAFDLMAKGEGIRCIIRMEN

SEQ ID NO: 22058 - protein, 305 aa, Miscanthus sinensis var. sinensis
IESVGEGVTDVAPGDHVLPVFTGECKECPHCKSAESNMCDLLRINTDRGVMIGDGKSRFSINGKPICHFVGTSTFSEYTVMHVGCVAKINPQAPLDKVCVLSCGISTGLGASINVAKPPKGSTVAIFSLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22059 - protein, 305 aa, Miscanthus sinensis var. sinensis
IESVGEGVTGVAPGDHVLPVFTGECKECPHCKSAESNMCDLLRINTDRGVMIGDGKSRFSINGKPIYHFVGTSTFSEYTVMHVGRVAKINPQAPLDKVCVLSCGISTGLGASINAAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22060 - protein, 305 aa, Miscanthus sinensis var. sinensis
IESVGEGVTDVAPGDHVLPVFTGECKECPHCKSAESNMCDLLRINTDRGVMIGDGKSRFSINGKPICHFVGTSTFSEYTVMHVGCVAKINPQAPLDKVCVLSCGISTGLGASINVAKPPKGSTVAIFSLGAVGLAAAEGARIAGASRIIGVDLNPSRFEEARKFGCTEFLNPKDHKKPVQEVLAEMTNGGVDRSVECTGNIYAMIQAFECVYDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22061 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPLKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22062 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPLKGSTVAIFGLGAVGLAAAEGARIAGASRIIGVDLNPSRFEEARKFGCTEFANPKDHKKPVQEVLAEMTNGGVDRSVECTGNINAMIQAFECVHDGWGVAVLVGVPHKDAEFKTHPMNFLNERTLKGTFFGNFKPHTDLPNVVELYMKKELEVEKFITHSIPFAEINKAFDLMAKGEGIRCIIRMEN

SEQ ID NO: 22063 - protein, 305 aa, Miscanthus sinensis var. sinensis
IESVGEGVTDVAPGDHVLPVFTGECKECAHCRSAESNMCDLRRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLDPSRFEIARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22064 - protein, 305 aa, Miscanthus sinensis var. sinensis
IESVGEGVTDVAPGDHVLPVFTGECKECAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRADLPNVVELYMKKELEVEKFITHSIPFAEINKAFDLMAKGEGIRCIIRMEN

SEQ ID NO: 22065 - protein, 305 aa, Miscanthus sinensis var. sinensis
IESVGEGVTDVAPGDHVLPVFTGECKECPHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRILGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFDNFKPRTDLPNVVELYMKKELEVEKFITHSIPFAEINKAFDLMAKGEGIRCIIRMEN

SEQ ID NO: 22066 - protein, 305 aa, Miscanthus sinensis var. sinensis
IESVGEGVTDVAPGDHVLPVFTGECKECPHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRILGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22067 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNISAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22068 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMDFLNERALKGTFFGNFKPRTDLPNVVELYMKKELEVEKFITHSIPFAEINKAFDLMAKGEGIRCIIRMEN

SEQ ID NO: 22069 - protein, 305 aa, Miscanthus sinensis var. sinensis
IESVGEGVTDVAPGDHVLPVFTGECKECPHCKSAESNMCDLPRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEAGKFGCTEFVNPKDHKKPVQEVLAEMTNGGVDRSVECTGNINAMIQAFERVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22070 - protein, 305 aa, Miscanthus sinensis var. sinensis
IESVGEGVTDVAPGDHVLPVFTGECKECAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRVIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22071 - protein, 305 aa, Miscanthus sinensis var. sinensis
IESVGEGVTDVAPGDHVLRVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINATIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22072 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVMELYMKKELEVEKFITHSVPFAEINKAFDLMAKGEGIRCIIRMEN

SEQ ID NO: 22073 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGALRIIGVDLNPSRFEEARKFGCTEFVNPKDHKKPVQEVLAEMTNGGVDRSVECTGNINAMIQAFECVHDGWGVAVLVGVPHKDAEFKTHPMNFLNGRTLKGTFFGNFKPRTDLPNVVELYMKKELEVEKFITHSIPFVEINKAFDLMAKGEGIRCIIRMEN

SEQ ID NO: 22074 - protein, 305 aa, Miscanthus transmorrisonensis
IESVGEGVTDVAPGDHVLPVFTGERKECPHCKSAESNMCDLLMINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22075 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22076 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASGIIGVDLNPSRFEEARKFGCTEFVNPKDHKKPVQEVLAEMTNGGVDRSVECTGNINAMIRAFECVHDGWGVAVLVGVPHKDAEFKTHPMNFLNERTLKGTFFGNFKPRTDLPNVVELYMKKELEVEKFITHSIPFAEINKAFDLMAKGDGIRCIIRMEN

SEQ ID NO: 22077 - protein, 305 aa, Miscanthus transmorrisonensis
IESVGEGVTDVAPGDHVLPVFTGECKECPHCKSAESNMCDLLRINTDRGVMIGDGKSRFPINGKPIYHFVGTSTFSEYTVTHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEISKAFDLMAKGEGIRCIIRMEN

SEQ ID NO: 22078 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRNVECTGNINAMIQAFECVHDGWGVAALVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 22079 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTAAIFGLGAVGLAAAEGARIAGASRIIGADLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 22080 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 22081 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSRGISTGLGASINVAKPPKGSTVAIFGLGAVGLAAAEGARIAGASRIIGVDLNPSRFEEARKFGCTGFVNPKDHKKPVQEVLAEMTNGGVDRSVECTGNINAMIQAFECVHDGWGVAVLVGVPHKDAEFKTHPMNFLNERTLKGTFFGNFKPRADLPNVVELYMKKELEVEKFITHSVPFAEINKAFDLMARGEGIRCIIRMEN

SEQ ID NO: 22082 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVARINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGAPHKDAEFKTHPMNFLNERTLKGTFFGNFKPRTDLPNVVELYMKKELEVEKFITHSVPFAEINKAFDLMAKGEGIRCIIRMEN

SEQ ID NO: 22083 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTGAIFGLGAVGLAAAEGARIAGASRIIGVDLNPSRFEEARKFGRTEFVNQKDHKKPVQEVLAEMTNRGVDRNVECTGNINAMIQAFECVHDGWGVAVLVGVPHKDAKFKTHPMNFLNERTLKGTFFGNFKPRTDLPNVVELYMKKELEVEKFITHSVPFAEINKAFDLMAKGEGIRCIIRMEN

SEQ ID NO: 22084 - protein, 305 aa, Miscanthus transmorrisonensis
IESVGEGVTDVAPGDHVLPVFTGECKECPHCKSAESNMCDLRRINTDRGVMIGDDKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 22085 - protein, 305 aa, Miscanthus transmorrisonensis
IESVGEGVTDVTPGDHVLPVFTGECKECPHCKSAESNMCDLLRVNTDRGVIIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMVQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22086 - protein, 305 aa, Miscanthus transmorrisonensis
IESVGEGVTDVAPGDHVLPVFTGECKECPHCKSAESNMCDLLRFNTDRGVMIGDGKSRFSINGKPIYHFVGTSTFSEYTVMHVGCVAKINPQAPLDKVCVLSCGISTGLGASINVAKPPKGSTVAIFDLGAVGLAAAEGARIAGASRIIGVDLNPSRFEEARKFGRTEFVNQKDHKKPVQEVLAEMTNRGVDRNVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 22087 - protein, 305 aa, Miscanthus transmorrisonensis
IESVGEGVTDVAPGDHVLPVFTGECKECPHCKSAESNMCDLLRINTDRGVMIGDGKSRFSINGRPIYHFVGTSTFSEYTVMQVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAESKTHPMNFLNERTLKGTFFGNFKPRTGLPNVVELYMKKELEVEKFVTHSVPFAEINKAFDLMAEGEGIRCIIRMEN

SEQ ID NO: 22088 - protein, 500 aa, Atriplex triangularis
MAFPMPVRQLFIDGERREPLLKNRIPIINPSTEEIIGDIPAATAEDVEVAVVAARKAFKRNKGRDWAATSGAHRAKHLRAIAAKITERKDHFVKLETLDSGKPFDEAVLDIDDVASCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDIDKIAFTGSSATGSKIMASAAQLVKPVTLELGGKSPVIMFEDIDIETAVEWTLFGVFWTNGQICSATSRLLLHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 22089 - protein, 691 aa, Andrographis paniculata
MASVATWDRSASSPYLQEQSGKEKVKWNFASLAERGEYFSEKPPTPLLDTIDYPIHMKNLSTKELKQLADEPRSDVIFNVSKTGGHLGSSLGVIELTVAIHYVFNAPQDRILWDVGHQSYPHKILTGRRNMMPTLRQTDGLCGFTKRSESNYDCFGAGHSSTTISAGLGMAVGRDLQGRKNHVVAVIGDGAMIAGQAYEAMNNAGYLDSDMIVILNDNKQVSLPTANLDGPIPPVGALSSALSRLQSNRPLRELREVAKGVTKQIGGSMHELAAKVDEYARGLISGSGSTLFEELGLYYIGPVDGHNIDDLTAILKEVKSTKTTGPVSIHVVTEKGRGYSYAEKAADKYHGVAKFDPATGKQFKSSTPTQAYTTYFAEALIAEAEQDNIIVAIHAAMGGGTGLNLFDRRFPTRCFDVGIAEQHAVTFAAGLACEGLKPFCAIYSSFLQRAYDQVVHDVDLQKLPVRFAMDRAGLVGADGPTHCGAFDITYMACLPNMVVMAPADEAELFHMVATAAAIDDRPSCFRYPRGNGIGVELPPGNKGIPLEIGKGRILLEGERVALLGYGTAVQSCMTAAALMEPHGLQLTVADARFCKPLDQGLIRRLANSHEVLITVEEGAVGGFAAHVAQFMALDGLLDGKLKWRPLVLPDRYIDHGSPADQLMEAGLTSHHIAATVFNILGKAREALQIMS

SEQ ID NO: 22090 - protein, 586 aa, Andrographis paniculata
IWDVGHQAYPHKILTGRRPRMHTIRQGFGLAGFPKRDESPYDAFGAGHSSTSISAALGMAVGRDLLGKSNHVISVIGDGAMTAGQAYEAMNNAGFLDSNLIIVLNDNNQVSLPTATVDGPAPPVGALSEALTRLQASRKFRLLREAAKSMTKQMGEHVHETAAKVDTYVRGMAGPPRATLFEELGLYYIGPVDGHSIEDLVHILKKVKEMPAPGPVLIHILTEKGKGYSPAEAAADKMHGVVKFDVRTGKQAKSKSKTKSYTQYFAESLVAEAKQDDKIVAIHAAMGGGTGLNIFQKQFPDRCFDVGIAEQHAVTFAAGLATEGLKPFCAIYSSFLQRGYDQVVHDVDLQKLPVRFIMDRAGLVGADGPTHCGAFDTTYMACLPNMVVMAPSDEAELMHMIATAATIDDQPSSIRYPRGNGIGADLPADNKGTPLQIGKGRILREGSRVAIMGFGAVVQNCMAAAAILDQHGVHVTVADARFCKPLDGGLIRQLAKEHEVLVTVEEGSVGGFSSHVAQFLSLNGFLDGKLKWRPMVLPDRYIDHGAHGRPDFEEAGLSPKHIACTVMAMVSGDRRKDRLKLIQLEF

SEQ ID NO: 22091 - protein, 218 aa, Aspergillus niger
MSSTSPSKEPEVEPEVQSGEDQEQMDKEQQDTQAQGQGEFEVKEQDRWLPIANVARIMKLALPENAKIAKEAKECMQECVSEFISFITSEASEKCQQEKRKTVNGEDILFAMTSLGFENYAEALKIYLSKYRETQSARGEHQNRPTSSGYGAGAPVGAPGPAGPGGRPMAPGAGFPDTADSANNIMNQSLDPSEQDTSTYGYPPMVGQPHNGTAGESY

SEQ ID NO: 22092 - protein, 557 aa, Suaeda maritima subsp. salsa
MWSQLSSFFASKMDMVSTSDHASVVSMNLFVALLCGCIVIGHLLEENRWMNESITALLIGLSTGIIILLISGGKSSHLLVFSEDLFFIYLLPPIIFNAGFQVKKKQFFRNFITIILFGAVGTLVSFIIISLGSIAIFQKMDIGSLELGDLLAIGAIFAATDSVCTLQVLNQDETPLLYSLVFGEGVVNDATSVVLFNAIQNFDLTHIDHRIAYRIAFQFGGNFLYLFFASTLLGAVTGLLSAYVIKKLYFGRHSTDREVALMMLMAYLSYMLAELFYLSGILTVFFCGIVMSHYTWHNVTESSRVTTKHAFATLSFVAEIFIFLYVGMDALDIEKWRFVSDSPGTSVAVSSILLGLLMVGRALLFSLVFLMNLSKKSNSEKVTFNQQIVIWWAGLMRGAVSVALAYNQFSRSGHTQLRGNAIMITSTITVVLFSTMVFGLLTKPLILFMLPQPKHFTSASTVSDLGSPKSFSLPLLEDRQDSEADLGNDDEEAYPRGTIARPTSLRMLLNAPTHTVHHYWRRFDDYFMRPVFGGRGFVPFVPGSPTEQSTTNLSQRT

SEQ ID NO: 22093 - protein, 496 aa, Caenorhabditis elegans
MTPFPSSEEWKTSTKLEALGSMEGELAHLLSTCKPETLNHNKTELSGFRNLFARFLRAKPTVDWSKIEPLPEGAIRPYKSLGHVVDKELIASQLRKLVVVKLNGGLGTSMGCKGPKSVISVRNDLTFLDLTMQQIQTLNKTYGVDVPLVLMNSFNTNEDTQKVLKKYANVKVSVHTFSQSQYPRINRETLLPIVKSLEADDNECWYPPGHGNFYEAFHNSGLLDKFLADGKEYCFLSNIDNMGATVDLSILNFVLNPSPDQTAPEFLMEVTDKTRADVKGGTLIQYEGRLMLLEIAQVPKDYVDEFKSISKFRIFNTNNLWAKLDAMRKIVVENKLEMEVIVNPKHLDRGLDVIQLETAAGAAIKSFSGAVGVNVPRSRFLPVKKTSDLLLLMSNLYDIDNGSLTLSHQRSFPTTPLVKLGSSFDKVKDYLGRFNGIPDLLELDHLTVSGDVWFGKDVSLKGTVIIIANHGDRIDIPPGSILENKIVSGNLRILEH

SEQ ID NO: 22094 - protein, 207 aa, Caenorhabditis elegans
MSKEKSFDTKKFLIDLASGGTAAAVSKTAVAPIERVKLLLQVQDASKAIAVDKRYKGIMDVLIRVPKEQGVAALWRGNLANVIRYFPTQAMNFAFKDTYKAIFLEGLDKKKDFWKFFAGNLASGGAAGATSLCFVYPLDFARTRLAADIGKELSSTVPHTSECSIPPRWSSLLMDRNSTSSPLGELLKLSQSDLESFPTHGTLFVVV

SEQ ID NO: 22095 - protein, 642 aa, Homo sapiens
MKSNNGIEVIDAEYLLEVERCFPGVSECKAMEMSADFPWPGTTESKHHSCFWLLSPTFELCSAEDVKRTKPAPLDLKKGEGRRGQGRMACCVGLDWVLGVLKPFLSTSSLLSLLEMLIEHLSGSVHKYHKMEDRVTWKPNYFLKIIQLLDDYPKCFIMGADNMGSKQMQQIRISLCRKAMVLLGKNTTMGNVGFVFIKEDLTEIRDLLLANKVPAVAHAGSIAPVKSLCQSRTLVLGITTKISRGATEILSDVQLIKTGDKVGASEATLLNISPFFGLVIQQVFDNGSIYNPEGLDITEETAFSLSGECLRCFQGLFADWLPNCCISTPFYHQWSYYKTRGDEEAEEEHFELDIAKEVGTDPQHFSITKGLKPMRIIAMFESQSEDELTPFDMSIQELDNPGAKRILELDRFKEQQGQKRFQDLMGMDLTTHSVNALLIKCLEKEVTALCRYTPCRNIPPYFVALVPQEEELDDQKIQVPPAGFQLVFLCYADNKGKVPFAKKVMATPEQGDKVKAIVQKLRFKYRSDSFENSVLQQCSRNLEALALDLMEPEQAVDLTLPEVEAMNKRLGSPLVDKFKELLYPPDYNPEGKVSNIKHNNEGFRSKRPKVEYSEEELKTHISNSMLGKFAVPMLKETCWGMG

SEQ ID NO: 22096 - protein, 291 aa, Homo sapiens
MQICPAQCHLPHACPLSEAQPPFSVSITLCGSVASMSDKLSYKVADIDLASWGHKGLDIAENEMLGLMSVWELYLGSKPLKGTHISGWPYVTVERDILTETHGIKRDTDVMIVGKVAMVAGYGDMGKGCAQALWDFGDPFVITKIGPINLLQTAMGGYEVTVVDEACQEGNIFVTATGCVDIILGQHFEQMKDDAIMCNPLMWRSMPSGSTRTLWRSWPGLAEEQHGTILLVEGLLVILGCSMGHLGFVMSDSFTNQATVQIELWTHPDKYPAEYETHKLTKKQAQYLGMS

SEQ ID NO: 22097 - protein, 124 aa, Homo sapiens
MVPMGKNTMMCKAIQGHLENNPALEKLLPHIQGNVGFAFTKEDLTKFRDMLLNSKVPAATHAGAIAPCEVTVPGQNTGLEPKKTSFFQALSITTEILSDVQLIKTGDKLFDSSSIYNPEVLDIT

SEQ ID NO: 22098 - protein, 165 aa, Homo sapiens
MDDDSSTTDASQLGTCADYIGGSHYVIQPHDDTEESMSDQEDTNGSKVSFREQDMYLPITNVARIMKNAIPQTGKIAKDVKECVQECVSELISFITSEASEREAMKGEKGVGGAVTATDGLSEELTEEAFTNQLPAGLITTDGQQQNVMVYTTDFWCSTNSVYMI

SEQ ID NO: 22099 - protein, 379 aa, Homo sapiens
MADYLITSSTGYVPRDGLTVPQLFVGADGLTHNDFLILPGFIDFIADEVDLTSALTQKVTLKTPLISSPMDTVTEADMAIAMALMGPIGFIHHNCTAEFQAKEVQKIKKFEQGFITDPVVLSPSRTTGTKLVGIVTSRDTDFLAEKDNTTLLSEVMTPRIELVVAPAGNSAHQITMVHYIKQKYPHLQVTGGNMVTAAQAKNLTLEVMACGRPQGTAMYKVAEYAWHFGVPIIFNGGIQIVEHMVKALALGASTVMTGSLLAATMEAPGEYFFSDGVWLKKYRGMGSLDAMGKSSSSQKRYFGEGDKVKIAQDVSNSIQDKGSIQNFVSYLIVDIQQGCQDSRAHSLSALWSMMYSGELKFEKWTILAQIKGGVHGLHS

SEQ ID NO: 22100 - protein, 388 aa, Homo sapiens
MKTSEDKPSERDALQPGCNIVTIVYTLYSSTTLVALSTGQGVDLFMLDLALGEFVLVEKDVKISKKGKIYNLNEGNAKYFDRAVTEYVQKKKFPEDSSAPYGVRYVSSMVVDMHHILVYREIFMYPGNKKSPQGKGILLCPLAVHPVREQEELSPLMPAVWLLHCCSLASLCGPEPAGSRAWGHLDATRLPHGCSSASMPPGARPTFYMATRGHQPRYEGYALRTLHLIALTHAEPAPKNQAQAFWPLRFQEKQPYGLSQVWAAEELSQKKKDVTIIARKRKYMVCFDPLDESSNIDCLASIGTIFAVYRKLRSGHPQLQVCPPMTHLCEKIISMLPSWWNLNGPNQLMSLQQFVCEVQDQLNPLVIQGYPRCIAQQLHSAGEVIKKP

SEQ ID NO: 22101 - protein, 292 aa, Homo sapiens
MTDYLIRGGTDYVPDNWLPAQQLFASADCLTYDDFLILPGFTDFIADEADLTSALTRKITLKTPLISSPTDTVTGRHSHCNGSDGRYWFHSPQLHPRVPGQGETSTFLLRRTTPPSSVLAPAGLMLKEANEILQHSKKGKLSFKNRDYPLASKDSHKQLLRGAAVGTPEDDKYRLDLLTQAGVDVVVLDLSQGNSVYQIATVHYIKQKYPHLQVIGMTAAQAKNLIDAAVDGLRIGMGCGSICITQEVMACGGPQGTALYKVAEYALCFGELNFEKQTMSAQIKGGVHGLHS

SEQ ID NO: 22102 - protein, 431 aa, Homo sapiens
MRNILTVLTQETKTMLWPNCSVVRNRITASKRCLTFRGYPQRTGFMRTLQGEAMFLSPPPPPQPARHVGQEPALVQRWMLGFRDPDTPAKAKPVNIKNGQLLQLLVPDATKQWLMENTKDWPPWSRTGQSHSFSILAHVIDTEFMQDLDEEHLKKSREKIERQNLEPDGLSSLSCASEGEIIVCAAYAHELPKYDVKVGLTNYAAAYCTGLLLACSLLNRFGMDNIYDGQMEVTGDEYNVENIDGQPGAFTCYLDAGLARTITGNKVFGTLKGTVDRSLSIPHSTKRFPGYDSESNAEVHQKRIMGQNVADYMRYLMEQDEDAYKKHITLDTMEETYKKAHAAIRENPVYEKRPKKEVKKKRWNHPKMSLTQKKDQNSVHVAQIDVRPSLVLQPDASLPNKASAVVNLIYSLTPTPVLPLPVVLVCQCCLQ

SEQ ID NO: 22103 - protein, 431 aa, Homo sapiens
MTDAAVSFAKDFLAGGVAEAISKTAVAPIEQVKLLLQKQGVLSWRGNLANAIRYFPTQAFNFAFKDKYKQIFLGGNLASGGAAGATYLCFVYPLDFARTCLAANVGKAEAEREFRGLCDCLVKIYKSDGIKGLYQGFNVSMQGIIRAAYFGIYDTAKGMLPDPKDTHIVISWMTTQTVTAFSGLTSYSFDISGRKVTDIMYTGTLDCWRKIAGDEGGKAFFKGSWSSVLRGMGGAFVLVLFDEIKKYSLPTSIWVYQCICRKNRLNLKNKALSISGILKEKKDVNQSIGVHIPSTGIPECDSDECEVLLSESFGTLVGKRGKVFFGYIFPVVDQECIGPKEKDHNDAKLAISIPELDGNPAKGVYCGWGIARPLFWTGELVGNGTLGNCLLSTWVCSCAQSLLSLQSRSKALAKEALALAVTNEGFLAIAH

SEQ ID NO: 22104 - protein, 223 aa, Homo sapiens
MFFQDFRPFLSSSPLDQDNRANERGHQTHTDFWGARPPRLPLGRRYRSRGSSRPDRSPAIEGILQHIFAGFFANSAIPGSPHPFSWSGMLHSNPGDYAWGQTGLDAIVTQLLGQLENTGPPPADKEKITSLPTVTVTQEQVDMGLECPVCKEDYTVEEEVRQLPCNHFFHSSCIVPWLELHDTCPVCRKSLNGEDSTRQSQSTEASASNRFSNDSQLHDRWTF

SEQ ID NO: 22105 - protein, 135 aa, Homo sapiens [sequence omitted]

SEQ ID NO: 22106 - protein, 233 aa, Homo sapiens
MAQPPLPLSIKGAASMSDKLPYKVADIGLATWGHKALDIVENGCREHAVAVFAEAGMPVFTWKGKMKEGYPWCIEQTLYFKDGPLNMILDDGGDLTNLIHTKWHQVDQDVMIASKVAVVAGYGGVGKGCAQALQGFGACIIITETDPISALQAAMEGYEVTTMDEACQEGNIFVTTTTCVNIILGRHFEQMKDDAILCNTEQFDVEIDVSFVGSNSFNQMNVKLTKLTEKQAQ

SEQ ID NO: 22107 - protein, 268 aa, Homo sapiens
MTDAAVSFTKDFLAGGVAAAISKMGVAPIERVKLLLEVQHASKQITADMQYKGIIDCVVHILKEQGVLSFWHRNLVNVLRYFPTQALNLAFKDKHKQIFLGGVDKRTQFGSYFAGNPASGGAAGATSLCFVYPLDFAHTCLAADVGFNVSVQGIIIYRAAYFGIYDTAKGMLPDPRNTHIIISWMITQTVTAIAGLTSHPFDTVRCRMMMQSGRKGIDVMYTGTLDCWRKIVGDEGGKDFFKGAWSSVLRGMDGAFVLVLYGEIKKYT

SEQ ID NO: 22108 - protein, 221 aa, Homo sapiens
MKRRAVMGPPQVQAWKALDLWESSQVMEGKAVVPMGRNPMMRKATQGQLENSPALEKLLPPLQGNVGFAFTKEDLTEVRDLLLANKVPAATRAGAIGPCEVTVPAQNTGLGPEKISFFQALGITTKISRGTTEILSDVQLIKTGDRVGASEATLLNTPNISPFSFGLVIQQVFNNGSIYNPEVLDITEETLYSGFLEGVRNVATLSSSSNIFSHADLLENI

SEQ ID NO: 22109 - protein, 423 aa, Homo sapiens
MADYLIRGGTSYMPEDGLTAQQLFTGAAARDRLTYNNFLILPGFIDFIADKVDLTSALTWKITLKMPLISSPMDAVTEADMAIAMALMGGIGFIHHHCTPEFQANEVRKVKKFERGFIMDPVVLSPSHTVGDVLEAKMQHGFSGIPITETGTMGSKLDSHKQLLCGAAVGTREDDKYRLDLLTQVGVDVIVLDLSQGNSLYQMAMVYYIKQKYPHLQVIGGNMVTAAQAKNLIDAGVEGLHVGMGCSSICITQEVMAYSWPQGTAVYKVAEYARHFANGGIQTMGNMVKALALGASTVMMGSLLAATTEVPSKYFFSDGVWLKKYRGMGSLDALEKSSGSQKQYFMEGDKLKIAQGVSSSIQDKGSIQKFVSYLIAGIQHGCQDTGVCNLSVLLSMMYSGERKFEKWTMLAQIKACGTSELLT

SEQ ID NO: 22110 - protein, 345 aa, Homo sapiens
MDLKQSHSVRLNDGHVMPMLGFGTYAPDHTPKSKAGEATEVAIDAGFRHIDAAFFYQNEEEVGKAIREKIADGPVKREDIFYTTELWTTFFRPELVRPALEGSLKKLQLDYVDLFIIHNPLAMKLLRRQKGNSHRKPSSLSSVFQPGEELLPKDASGNIIFDTVDLRDTWEALEKCKEAGLTKSIGVSNFNHKLLELILNKPGLKYKPTCNQSKLLEFCKSKDIVLVAYRALASHRDPNWMDPDSPYLLEEPTLKSIAKKYNRSPGQSFSEKRIKENFQVFDFELTPEDMKATDGLNRNFRYAKLQLPSVLVTEVSPVASTKLRSSGISPDLRGKTLTPVSSSSI

SEQ ID NO: 22111 - protein, 265 aa, Homo sapiens
MTVETVVLTETLLVLGAEVQWSSCNIFSTQDHAAAAIAKAGIPVNAWKGETEEKYLWCTKQTLYFKDKLLNMILDITGGLTNLTHTKYPQLLSGIRDISEETMTEVHNLYKMMANGILKVSTINVNDSVTKSKFDNLYGCHQSLPRWHQAIGVMIASKVAVVAVYGDVGKGCAQALQGFGAHVIITEIDPINALQAAMQRYEGTTMDKAYKYPIEVHFLPRKLDEAVAEAHLGKVNMKLTKQTEKQAQYLGMSCDSLFKLDHYHY

SEQ ID NO: 22112 - protein, 281 aa, Homo sapiens
MAIFVELNTKAKMPIVGLGTWKSPLGKVKEVVKVAIDAGYRHIDCAYVYQNEHEVGEAIQEKIQEKAVKREDLFIINKLWPTFFERPLGYKSGDDFFRKDDKGNMIGGKAMFLDAWEAMEELVDEGLVKALGVSNFNHFQIERLLNKPGLKYKPVTNQVECHPYLTQEKLIQYCHSKGITIMAYSPLGSPDRLWAKPEDPSLLEDPKIKEIAARHKKPQPRNVTVIPKSVTPARIVENIQAFDFTLNDEEMATTLSFNRNWRARNMLQSSHLEDYPFDAEY

SEQ ID NO: 22113 - protein, 236 aa, Homo sapiens
MKFRGQEDKANYYSWKCLMIQDKNKYNTPKYRMIVFLMIVCVTNKYCQIAYTRIEEDVILHTAYARKLPKYDVKVGLTNYTAMYCTGLLLACRLLSRSRSVTYGMDKICEGQVEVTGNEYNVESTDGQPSAFTCYLDVGLARTTTGNKVFGSLKRAVDGGLSIPHSTKQFPGYDSESKDFNAAVHQKYIIGQNVADYMHYLMKDDEDGYRKQFSQYINKSVTPDLKEMHKKAHAAM

SEQ ID NO: 22114 - protein, 789 aa, Homo sapiens
MIVCVTNKYCQIAYTRIEEDVILHTAYARKLPKYDVKVGLTNYTAMYCTGLLLACRLLSRSRSVTYGMDKICEGQVEVTGNEYNVESTDGQPSAFTCYLDVGLARTTTGNKVFGSLKRAVDGGLSIPHSTKQFPGYDSESKDFNAAVHQKYIIGQNVADYMHYLMKDDEDGYRKQFSQYINKSGALTFRDVAIEFSLEEWQCLDTEQQNLYRNVMLDNYRNLVFLGIAVSKPDLITCLEQEKEPWNLKTHDMVAKPPVICSHIAQDLWPEQGIKDYFQEVILRQYKKCRHENLLLRKGCKNVDEFKMHKKGYNRHNQCLTTSHSKIFQCDKYVKVFHKFSNSNRHKIRHTSKKPFKCKECGKLFCILSHLAQHKKIHTGEKSYKCEEYGKAFNESSNCTTHKRITEKKPYKCKECGKAFNWFSHFTTHKRIHTGEKPYQCEKCGKFFNQSTNLTTHKRIHTGEKPYKCEECGKAFNQSSNLTEHKKIHTKEQPYKCEKCGKAFKWSSTLTKHKRIHNGEKPYKCEECGKAFNRSSTLNRHKITHTGGKPYKYKECGKAFNQSSTLTIHKIIHTVEKFYKCEECGKAFSRISHLTTHKRIHTGEKPYKCEECGRAFNQSSTLTTHKRIHTGEKPYECEECGKAFNRSSTLTTHKIIHSGEKIYKCKECDCGKAFKQSLYLTTHKIIHTEEKPYKCEECGKAFNQSSNLTKHKIIHTGEKPYKCEEYMIHTREKLYKPESFNSAFDNTSNFSRCQRNAGKVIHTGENFYKCKQSGKTFNQCSHFIAQDIYT

SEQ ID NO: 22115 - protein, 137 aa, Homo sapiens
MFRGSVEILSEVPLIKTGDKAGASEATLVNMWNISPSSFELIIQPVFDNCSIYNPEVLDMAEETASLLPGGVCLQIGYPTVASVPYPIISRAPTTREKQQAEEPCAGGGGWCMLCEISVGDFTADTLRIEKWRKTKG

SEQ ID NO: 22116 - protein, 195 aa, Homo sapiens
MEEIYQVKFRRRREGKTDYYARKRLVIQDKNKYNTPKYWMIVHVINRYIICQIAYGCIEGNVIVRAAHAHELPKYGVKVGLTNYAAAYCTCLLLACRLLNRFGMDKIYEGQVEATSDEYNVESIDGQPGAFTCYLGAGLARTTTGNKVFGTLKEAAVGGLSIPHSTKQFPDYDSESKGFNAEVHRKDIMGQNVAA

SEQ ID NO: 22117 - protein, 217 aa, Homo sapiens
MPTEDRVTWKSNYFLKIIQLLDGYPKCFMVGADNLGSKQMQQILKSLRGKAMAIQGHLENSRALEKLLPRIQGNVGFVFTKEDLTEIRDMLVASKASSLKPLGTTEILSDVQLIKTGVKVGASEATLLNMRNISPFSFGLVIQQVFDNGSIYNTEVLDITEEILNPHFLEGVRNIANVCLQIGYPAVASVPHSTITKIEAKEELEELDEDTGFGLFD

SEQ ID NO: 22118 - protein, 619 aa, Homo sapiens
MTATRGETGSRTREMTVAIEELGLRTREMTAANGEPGLRTREMTPAGAFYSATEEAQGVPFVSSPARGRQWCCPRWHSWSDWRQNTFVTEPGSEESSPPAEMSEQTAALDTSSPRNKAPARSDRTVSNNDLASIFQCPVCLDYALPPILQCERGHLVCRSCHSKLTSCPTCRGPLGLIRNLAMEKVAKFVLFPCRYACLGCEITLPHTEKADHEEVCEFRLYSCPCPGTVCKWQGTMDAIMPHLTKMHEYITTIEGEDIIFLATSINLVGAYDWVMIQSCFGVRFMLVLQKQEDHNGGQQFFAVVQLLGASKEAENFAYQLELKGNRRRLTWEATPLPIHEDIAKAIKNRDCLIFDANTALLFAENDDLSINVVIKKSISRLDVWMPDSTRLGEKVTQKGGRWTPQTVTPHPLFPVPNGWWITILGPRAAAEFAWNFSSTQDQTKWLMLHPHPRRGEINPSTLQSPPDTENLPILPLDEKVELSKSCCSSMKMNKAIRMAERLKNVIRKYKNHFSGMLRRASEHMELPFDTEIKKVDFINHCYALVNKLDLSYGGMLSNKKGMPKTRLPILILCGIMMKDNCAFEEEIWEVLNMIDTYFWRKFFIFGESRNFIIKDLVK

SEQ ID NO: 22119 - protein, 230 aa, Homo sapiens
MLLTKIPTISQRIAYSSFHSTYTEHPVIDKYELVQKAKLMEQAEKYDDMAACMKSITEQGDELSKEERNLLSITYKIVEGAHSTISFGNVLDPQCFTESKVFYLKIKGHYYFFVAEVSAGDDKKEIVDQSQQAYREAFEISKKEMQPTYPTRLGLAFNFSVFHYEILNSPDKACSLTRTAFDKAIAEFDTFSTEPYKDSTVVLKLLRNGLTLQTSDTQGDEAEAREGGEN

SEQ ID NO: 22120 - protein, 217 aa, Homo sapiens
MCSFLFNLNNDFVVDATCKGNKIRFANHSVNPNCYAKVMMVNGDHRIGVFVRRAIQTCEELFFDYRYSQADALNEAVTQVRTDSSLTDKESWRSGIYNRTTQVFLAPVDDIKEGSDTSSLTPLLTGKSKKILLRLEKFPHPICLFHTSVSAIAPFELIQVNSSGQEEEKRNYNIIILLLEAADYGPLTVMCQMHCVTTKTLHIWGALQDSSRRQLLA

SEQ ID NO: 22121 - protein, 242 aa, Fagus sylvatica
STFAAAPLVPIIRDNLNLTKADIGNAGVASVSGSIFSRLAMGAICDLLGPRYGCAFLIMLSAPTVFCMSFVSNAGGYIAVRFMIGFSLATFVSCQYWMSTTFNSKIIGLVNGTAAGWSNMGGGATQLLMPLLYDLIQRAGATPFTAWRIAFFIPGWLHVIMGILVLILGQDLPDGNLSTLQKKGDVAVDKFSRVLWYAVTNYRTWIFVLLYGYSMGVELSIDNVIAEYFYDRFNLKLHTAGL

SEQ ID NO: 22122 - protein, 213 aa, Brassica rapa subsp. pekinensis
MVRGKTQMKRIENATSRQVTFSKRRNGLLKKASELSVLCDAEVSLIIFSPKAKLYEFASSNMQDTIDRYLRHTKDRVSTKPVSEENLQHLKHEAANMMKKIEQLEASKRKLLGEGIGSCSIEELQQIEQQLEKSVKCIRARKTQVFKEQIEQLKQKEKALAAENKKLTEKWGSHEIEVWSNKNQESGKGDEESSPSSEVETELFIGLPCSSRK

SEQ ID NO: 22123 - protein, 213 aa, Cardamine flexuosa
MVRGKTQMKRIENATSRQVTFSKRRNGLLKKAFELSVLCDAEVSLIIFSPKGKLYEFASSNMQDTIDRYLRHTKDRVSSKPVSEENMQYLKFEAANMMKKIEQLEASKRKLLGEGIGTCSIEELQQIEQQLEKSVKCIRARKTQVFKEQIEQLKQKEKALAAENGKLSEKWGSHETEVWSNKNQESGRGDEESSPSSEVETQLFIGLPCSSRK

SEQ ID NO: 22124 - protein, 175 aa, Draba nemorosa var. hebecarpa
MVRGKTQMKRIENATSRQVTFSKRRNGLLKKAFELSVLCDAEVSLIIFSPKGKLYEFASSNMQDTIDRYLRHTKDRISSKPVSEENMQHLKHEAANMMKKIEQLEASKRKLLGEGIGTCSIEELQQIEQQLGKSVKCIRARKTQVFKEQIEQLKQKEKALAAENEKLSEKWGSNE

SEQ ID NO: 22125 - protein, 105 aa, Vitis vinifera
VGRVIGDVVDSFCSTVKMTVTYNSNKQVYNGHELFPSSVTIKPKIEVEGGDMRSFFTLIMTDPDVPGPSDPYLREHLHWIVTDIPGTTDSTFGREIVNYEMPRPN

SEQ ID NO: 22126 - protein, 396 aa, Lycopersicon esculentum
MDGSVPQTDTMMSDVAAPPAQQPPPPSQPLAGMDNIPATLSHGGRFIQYNIFGNIFEVTAKYKPPIMPIGKGAYGIVCSALNSETNESVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLIMELIGTPSEAEMEFLNENAKRYIRQLPLYRRQSFTEKFPHVNPAAIDLVEKMLTFDPRRRITVEDALAHPYLTSLHDISDEPICMTPFSFDFEQHALTEEQMKELIYRESIAFNPEYQRM

SEQ ID NO: 22127 - protein, 394 aa, Lycopersicon esculentum
MDGSAPQTDTVMSDAAAGQQPAMPPLPMAGMENIPATLSHGGRFIQYNIFGNIFEVTAKYKPPIMPIGKGAYGIVCSALNSETNEHVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIFMELMDRKPLFPGRDHVHQLRLLMELIGTPSEAEMEFLNENAKRYIRQLPLYRRQSFVEKFPHVNPAAIDLVEKMLTFDPRRRLTVEDALAHPYLTSLHDISDEPVCMTPFSFDFEQHALTEEQMKELIYREGLAFNPEYQHM

SEQ ID NO: 22128 - protein, 373 aa, Lycopersicon esculentum
MVDANMGAAQFPDFPKIVTHAGQYVQYDIFGNLFEITNKYQPPIMPIGRGAYGIVCSVFNAELNEMVAVKKIANAFDNYMDAKRTLREIKLLRHLDHENVIGLRDVIPPPLRREFSDVYIATELMDTDLHQIIRSNQGLSEDHCQYFMYQLLRGLKYIHSAHVIHRDLKPSNLLLNANCDLKICDFGLARPNVENENMTEYVVTRWYRAPELLLNSSDYTAAIDVWSVGCIFMELMNRKPLFAGKDHVHQIRLLTELLGTPTESDLSFLRNEDAKRYVRQLPQHPRQQLATVFPHVNPLAIDLVDKMLTLDPTRRITVEEALAHPYLAKLHDAADEPVCPIPFSFDFEQQGIGEEQIKDMIYQEALALNPEYA

SEQ ID NO: 22129 - protein, 540 aa, Zea mays subsp. mays
MGLGVVAELVRLGVLSSTSDHASVVSINLFVALLCACIVLGHLLEENRWVNESTALIVGLGTGTVILMISRGVVIHVLVFSEDLFFFYLLPPIIFNAGFQVKKKQFFRNFITITLFGAVGTLISFTVISLGALGLISRLNIGALELGDYLALGAIFSATDSVCTLQVLSQDETPFLYSLVFGEGVVNDATSVVVFNALQNFDITHIDAEVVFHLLGNFFYLFLLSTVLGVATGLISALVIKKLYFGRHSTDREVALMMLMAYLSYMLAELFALSGILTVFFGCIVMSHYTWHNVTESSRITTKHAFATLSFLAETFLFLYVGMDALDIDKWRSVSDTPGKSLAISSILMGLVMVGRAAFVFPLSFLSNLAKKTEHEKISWKQQVVIWWAGLMRGAVSMALAYKKFTRAGHTQVRGNAIMITSTIIVVLFSTMVFGLLTKPLINLLIPHRNATSMLSDDSSPKSLHSPLLTSQLGSDLEEPTNIPRPSSIRGEFLTMTRTVHRYWRKFDDAFMRPMFGGRGFVPFVPGSPTERNPPDLSKA

SEQ ID NO: 22130 - protein, 540 aa, Zea mays subsp. mays
MGLGVDAETVRLGVLSSTSDHASVVSNNFFVALLCACIVLGHLLEENRMVNESITALLVGLGTGTVILMISRGVSIHVLVFSEDLFFIYLLPPIIFNAGFQVKKKQFFRNFITIILFGAIGTLISFVIISLGAMGLFKKLDVGPLELGDYLAIGAIFSATDSVCTLQVLNQDETPLLYSLVFGEGVVNDATSIVVFNALQNFDITHINAEVVFHLLGNFLYLFLLSTVLGVATGLISALVIKKIYFGRHSTDREVALMMLMAYLSYMLAELFALSGILTVFFGCIVMSHYTWHNVTESSRITTKHAFATLSFLAETFIFLYVGMDALDIEKWRSVSDTPGKSIAISSILMGLVMLGRAAFVFPLSFLSNLAKKNEHEKISWKQQVVIWWSGLMRGAVSMALAYNKFTRAGHTEVRGNEIMITSTITVVLFSTVVFGLLTKPLIRLLMPHRHLTMLSDDSTPKSLHSPLLTSQLGSSIEEPTQIPRPTNIRGEFTTMTRTVHRYWRKFDDKFMRPMFGGRGFVPFVPGSPTERNPHDLSKP

SEQ ID NO: 22131 - protein, 225 aa, Asparagus officinalis
MGRGKIEIKKIENPTNRQVTYSKRRSGIMKKAKELTVLCDAQVSLIMFSSTGKFSEYCSPGSDTKAIFDRYQQATGINLWSAQYEKMQNTLKHLKEINHNLRKEIRQRTGEELDGMDIEELRGLEQNLDEAIKLVRHRKYHVISTQTDTYKKKLKHSQEAHRSLLRDLDMKDEHPVYGFVDEDPSNYEGALALANGGSHVYAFRVQPSQPNLHGMGCGPHDLRLA

SEQ ID NO: 22132 - protein, 228 aa, Tulipa gesneriana
MGRGKIEIKKIENSTNRQVTYSKRRSGIMKKANELTVLCDAEVSLLMFSSTHKLSEFCSESTNQKKIFDRYQQMTGINLWSAQYEKMQNTFNHLSQINRNLRREIKQRMGEELDGLDFSELRGLEQNLEEALKIVRGRKYHVIGTQTETYKKKVKNSEETNKNLLRDLVNIEMKDEHQVYGYIDDDPNSYEGGLALANGGSSMYEFRVQPSQPNLHGMGYGLHDLRLA

SEQ ID NO: 22133 - protein, 231 aa, Tulipa gesneriana
MGRGKIEIKKIENSTNRQVTYSKRRSGIMKKANELTVLCDAEVSLIMFSSTKKLSEFCSESTNQKKIFDRYQQMTGINLWSAQYERMQNTFNHLSQINRNLRREIKQRMGEQLDGLDSNELRGLEQNLEAALKLVRGRKYHVLGTQIETFKKKVKNSAETNNNLLRDLVDIEMKNEHHVYGYVDDNPNSYEGGLALANGGSSMYEFRIQPSQPNLHGMGYGLHDLCLSRNP

SEQ ID NO: 22134 - protein, 211 aa, Tulipa gesneriana
MGRGKIEIKRIENSTNRQVTFSKRRNGIIKKAREISVLCDAWVSVVIFSSSGKMSEYCSPTITLPKMLDKYQQNCGNKLWDAKHQNLSEEIDRIKKENDNMQIELRHLKGEDLNSLQPKELIPIEEALENGFRSVREKQDDVLMTRKKNMRLMEEDNKRLNYVLHHQQQQAMDENIRDMELAYHQKHREFNSQMPMTFRVQPIQPNLHENK

SEQ ID NO: 22135 - protein, 133 aa, Homo sapiens
LNFFRDVPDFRVLACGGDGTVGWVLDCIEKANVGKHPPVAILPLGTGNDLARCLRWGGGYEGENLMKILKDIENSTEIMLDRWKFEVIPNDKDEKGDPVPYSIINNYFSIGVDASIAHRFHIMREKHPEKFNS

SEQ ID NO: 22136 - protein, 345 aa, Danio rerio
MPTVSQNSLFGMGNPLLDISAVVDKDFLDKYGLKPNDQILAEEKHKALFDEIVNKSKVEYHAGGSTQNSVKIAQWMIQEPHKVATFFGCIGTDHFGEILKQKAAEAHVDAHYYEQNQEPTGTCAACITGDNRSLVANLAAANCYNKEKHLDIDRNWSLVEKARVYYIAGFFLTVSPDSILKVAKHASDNNKIFGLNLSAPFISQFSKEPLMKVLPYVDIIFGNETEAATFAKEQGFETEDIAEIAHRVQNLPKVNKNRQRIVVFTQGREDTVATVGDKVKMFPVLDIDQNDIVDTNGAGDAFVGGFLSALVQDQPLEECIRAGHYAAHVIIRRSGCTFPEKPDFH

SEQ ID NO: 22137 - protein, 350 aa, Mus musculus
GTRANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLHARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 22138 - protein, 363 aa, Anthurium andraeanum
MATEVMTAVPAGSRVESLASSGIQAIPPEYVRPAEERVSLTDALEAARRAEDGPQIPTVDVAGFSSGDEAARRACAEAVRRAATDWGVMHVVNHGIPLELIRRMQAAGEAFFALPIEEKEKYANDQSSGNIQGYGSKLANNASGQLEWQDYFFHLIFPEDKANFSIWPKQPANYVEETREFGRQLRVVASKMLAMLSLGLGVEEGKLEAEVGGMEDLLLQMKINYYPRCPQPELAVGVEAHTDVSALSFILHNMVPGLQVHNEGQWVTARCVPDSIIMHVGDVVEILSNGQYKSILHRGLVNKEKVRVSWAVFCEPPRDKILLQPLPDILGQGHPAQFPPRTFSQHIQHKLFRKTQGDFATPN

SEQ ID NO: 22139 - protein, 232 aa, Helicoverpa armigera
VQHVSKQISADQRYKGIIDAFVRIPKEQGPLSFWRGNLANVIRYFPTQALNFAFKDKYKQVFLGGVDKNTQFWRYFAGNLASGGAAGATSLCFVYPLDFARTRLAADVGKGDGQREFKGLGDCLGKIFKSDGLTGLYRGFGVSVQGIIIYRASYFGFYDTARGMLPDPKNTPLVISWAIAQTVTTVAGIISYPFDTVRRRMMMQSGRAKGDILYRSTIHCWATIAKTEGTGA

SEQ ID NO: 22140 - protein, 259 aa, Sparus aurata
SNFHEAMRIGAEVYHNLKNVIKAKYGKDATNVGDEGGFAPNILENNEALELLKTAIEKAGYPDKIIIGMDVAASEFYKAGKYDLDFKSPDDPARYIPGDQLGDLYKSFIKGISSPVHRGSLRQDDWAAWSKFPAAVDIQVVGDDLTVTNPKRIQQAVEKKACNCLLLKVNQIGSVTESIKACKLAQSNGWGVMVSHRSGETEDTFIADLVVGLCTGQIKTGAPCRSERLAKYNQLMRIEEELGAKAKFAGKDYRRPKIN

SEQ ID NO: 22141 - protein, 1213 aa, Dictyostelium discoideum
MIELNNHSKINKNENNTNTRNNSSNNNNNNNNINKTNTNKYFEYNQNSIIYSSIPNSFLSHHPNSVGSQCLSLNSFLPPKPPILLSIFNSDTIGNNNNNNYSSSSSRNNSSGCSSSNNNNNNNNNNNNNNNNNNNNNNNNCNIEQYKNNQKQPKQQQQQKDQTIATQHRISLSSSSSSSSLSSSSSSSSVKQSFQIVKRLFGSLSEYMFPQKDEILYETDPYYLYQDDTQSNDSNEFYDDTDIGSDIDEANLNNTYNIQNCNKTLYNKQQQQAHFVNMNKNVNSNNGTGNSNQSNNVNKNQQNNNNNNNNNSHNNNNGNQNSSSSSSNSGASGSGGNGNNNNNNNNNNNNNNNNNNNSNSNSNNNSKSNNNNKKEGKDGATMNGSHPLIPFRKKPAQVPSPCFRMNSPNSDNDQYLDQLALENSSKKSLVVYNTDNLDQWKHSHLNENFDILQNDLIDIQQQQQQQQQQDNTLQYSSPINKRQEQEQQHIPFQFTTEQQQQLQQQQQQQQQNKTKQHPILLQRQQQQKQKQQQQQQIQQEQIGNNNSNNNNNINNNNNINNNYNNVNDLMNKFEIDQKQHDSQQNLVEEKRTPSFHEHNIIFNSFNFICSIVLDGSNIKSTEKYKAKLIIGFCFTILSFIPSWIIFFWLSGINKPAVMAIIAMPMSISSLVILKRTGSIHYPCHILCFTLCFALTINSYYTGGHQSTIRLLMSTVPIISALVLGRKASIQWSLMVLSIYLLFFVANLYGHEYVQGIPSIIIRSHMNFIIDVTIIIMTLIFTLCYQYFIDEAHRETKLKNAQLTIAKDAAIEAYQARQEFLATMSHEIRTPLNGLIGMATLLRDSHNLPPEEKTMAKAVKSCGDILLRLVNDILDLSKLEANQMGLEHIPFRMRELTQQICHVLSGQANEKNIHLSCEVSDKIPSILLGDSGRILQILMNLTGNALKFTQSGYVKIIIDLIEEESELVSLKKGEYNISFRVKDTGIGVPVESHQKIFEAFVQADPSDSRKYGGSGLGLYLCAKLVRLMKGEIGVYNNPDCDGSTFWFILPLEEGTDQSMQQMNNGARHKAFPQDCVKVLIAEDNIINQRVAVKFLEKIGIKAEVAGNGNEVLEILERQHYDLIFMDFQMPILDGLRCSKTIREFEQNHKWNRICPSIFICGLTANTMSTDKKRCFDHGMNHFISKPFQLEQLRSAIEMAIEHKQRNLMNLNIRN

SEQ ID NO: 22142 - protein, 271 aa, Homo sapiens
RRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 22143 - protein, 255 aa, Lycopersicon esculentum
MASPREENVYMANVADEAERYEEMVEFMEKVVAALNGEELTVEERNLLSVAYKNVIGARRASWRIISSIEQKEESRGNEDHVASIKKYRSQIENELTSICNGILKLLDSKLIGSAATGDSKVFYLKMKGDYYRYLAEFKTGTERKEAAENTLSAYKSAQDIANGELAPTHPIRLGLALNFSVFYYEILNSPDRACNLAKQAFDEAIAELDTLGEESYKDSTLIMQLLRDNLTLWTSDMQDDGTDEIKEPSKADNE

SEQ ID NO: 22144 - protein, 264 aa, Mesembryanthemum crystallinum
MSSESSREENVYMAKLAEQAERYEEMVEFMEKVAKMTDTEELSVEERNLLSVAYKNVIGARRASWRIISSIEQKEESRGNEDHVSTIKEYRGKIETELSKICDGILNLLESHLIPSASTAESKVFYLKMKGDYHRYLAEFKTGAERKEAAENTLLAYKSAQDIALAELAPTHPIRLGLALNFSVFYYEILNSPDRACNLAKQAFDEAISELDTLGEESYKDSTLIMQLLRDNLTLWTSDNAEEGGDEIKEAAAKRESGEEKPQQ

SEQ ID NO: 22145 - protein, 255 aa, Nicotiana tabacum
MASPREENVYLAKLAEQAERYEEMVEFMEKVVGAGDDELTIEERNLLSVAYKNVIGARRASWRIISSIEQKEESRGNEDHVASIKTYRSKIESELTSICNGILKLLDSKLIGTAATGDSKVFYLKMKGDYYRYLAEFKTGAERKEAAENTLSAYKSAQDIANGELAPTHPIRLGLALNFSVFYYEILNSPDRACNLAKQAFDEAIAELGTLGEESYKDSTLIMQLFCDNLTLWTSDMQDDGTDEIKEPSKAEEQQ

SEQ ID NO: 22146 - protein, 260 aa, Nicotiana tabacum
MAVAPTAREENVYMAKLAEQAERYEEMVEFMEKVSNSLGSEELTVEERNLLSVAYKNVIGARRASWRIISSIEQKEESRGNEEHVNSIREYRSKIENELSKICDGILKLLDAKLIPSAASGDSKVFYLKMKGDYHRYLAEFKTGAERKEAAESTLTAYKAAQDIATTELAPTHPIRLGLALNFSVFYYEILNSPDRACNLAKQAFDEAIAELDTLGEESYKDSTLIMQLLRDNLTLWTSDMQDDGADEIKEDPKPDEAKN

SEQ ID NO: 22147 - protein, 258 aa, Solanum tuberosum
MASPREENVYMAKLAEQAERYEEMVEFMEKVVAAADGAEELTVEERNLLSVAYKNVIGARRASWRIISSIEQKEESRGNEDHVASIKEYRSKIESELTSICNGILKLLDSKLIGSAATGDSKVFYLKMKGDYHRYLAEFKTGAERKEAAENTLSAYKAAQDIANAELAPTHPIRLGLALNFSVFYYEILNSPDRACNLAKQAFDEAIAELDTLGEESYKDSTLIMQLLRDNLTLWTSDMQDDGTDEIKEAAPKPDNNE

SEQ ID NO: 22148 - protein, 266 aa, Neospora caninum
MAEEIKNLRDEYVYKAKLAEQAERYDEMAEAMKNLVENCLDEQQPKDELSVEERNLLSVAYKNAVGARRASWRIISSVEQKELSKQHMQNKALAAEYRQKVEEELNKICHDILQLLTDKLIPKTSDSESKVFYYKMKGDYYRYISEFSGEEGKKQAADQAQESYQKATETAEGHSPATHPIRLGLALNYSVFFYEILNLPQQACEMAKRAFDDAITEFDNVSEDSYKDSTLIMQLLRDNLTLWTSDLQADQQQQEGGEKPAEQADQ

SEQ ID NO: 22149 - protein, 214 aa, Schistosoma mansoni
SNNELTNEERNLLSVAYKNVVGARRSSWRVISSIEQKTEGSERKQQMAKDYREKIEKELKDICHEVLTLLDKFLIPKATTAESKVFYLKMKGDYYRYLAEVATGDERQKVIEESQRAYNDAFDIAKNQMQPTHPIRLGLALNFSVFYYEILNAPDRACHLAKQAFDDAIAELDTLNEDSYKDSTLIMQLLRDNLTLWTSDTGGDDDANAPDEHQ

SEQ ID NO: 22150 - protein, 252 aa, Schistosoma mansoni
MTTSWVLQSKDLSNTDLVHIAKLAEQAERYDDMAAAMKRYTEASGNLGNEERNLLSVAYKNVVGARRSAWRVIHGSEMKAVNDRTKKQIAEEYRIKMEKELNTICNQVLALLEDYLLPNASPDDSKVFFLKMQGDYYRYLAEVATDDARTEVVQKSLDAYTKATTAAENLPTTHPIRLGLALNFSVFFYEIQNDAAKACELAKSAFDSAIAELDQLQDDSYKDSTLIMQLLRDNLTLWASDQTAEGDVENDS

SEQ ID NO: 22151 - protein, 257 aa, Glycine max; identical to SEQ ID NO: 1308

SEQ ID NO: 22152 - protein, 247 aa, Glycine max
AEGLNREQYVYLANVSEQAERYEEMVEFMQKVVVGSTPASELTVEERNLLSVAYKNVIGSLRAAWRIVSSIEQKEEGRKNDDHVSLVKHYRSKVENELTQVCATILSLLDSNLVPSASASESKVFYLKMKGDYHRYLAEFKVGDERKTATEDTMLSYKAAQDIASADLPPTHPIRLGLALNFSVFYYEILNQSDKACAMAKQAFEEAIAELDTLGEESYKDSTLIMQLLRDNLTLWTSDVQDQLDEP

SEQ ID NO: 22153 - protein, 258 aa, Glycine max; identical to SEQ ID NO: 2188

SEQ ID NO: 22154 - protein, 261 aa, Glycine max; identical to SEQ ID NO: 1803

SEQ ID NO: 22155 - protein, 381 aa, Oryza sativa; identical to SEQ ID NO: 1186

SEQ ID NO: 22156 - protein, 303 aa, Sus scrofa
MATSRYEPVAEIGVGAYGTVYKARDPHSGHFVALKSVRVPNGGGAGGGLPISTVREVALLRRLEAFEHPNVVRLMDVCATARTDRETKVTLVFEHVDQDLRTYLDKAPPPGLPVETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFSPRGPRPVQSVVPEMEESGAQLLLEMLTFNPHKRISAFRALQHSYLHKAEGNPE

SEQ ID NO: 22157 - protein, 408 aa, Xenopus laevis
MPVISNPAVEKSTKDEGTASCSVRSRKRKADVTIFLQDPDETLDSLEMTKKKQYQDRGPWSNEMTCKSPHKLIPTPEKEEHEPNPTNYSHFASLRFSPVSVSPLPRLGWANQDDVWRNMLNKDRIYLRDKNFFQKHPQLQPNMRAILLDWLMEVCEVYKLHRETFYLAQDFFDRFMATQKNVIKSRLQLIGITSLFIAAKLEEIYPPKLHQFSFITDGACTEDEITRMELIIMKDLGWCLSPMTIVSWFNVFLQVAYIRELQQFLRPQFPQEIYIQIVQLLDLCVLDICCLEYPYGVLAASAMYHFSCPELVEKVSGFKVTELQGCIKWLVPFAMAIKEGGKSKLNFFKGVDIEDAHNIQTHSGCLELMEKVYINQALLEEQNRTSPIPTGVLTPPQSNKKQKSDRAD

SEQ ID NO: 22158 - protein, 233 aa, Dianthus caryophyllus
MGRGRVELKRIENKINRQVTFAKRRNGLLKKAYELSVLCDAEVALIVFSNRGKLYEFCSTSCMNKTLERYQRCSYGSLETSQPSKETESSYQEYLKLKAKVDVLQRSHRNLLGEDLGELSTKELEQLEHQLDKSLRQIRSIKTQHMLDQLADLQKKEEMLFESNRALKTKLEESCASFRPNWDVRQPGDGFFEPLPLPCNNNLQIGYNEATQDQMNATTSAQNVHGFAQGWML

SEQ ID NO: 22159 - protein, 214 aa, Dianthus caryophyllus
MGRGKLEIRKIENKTNRQVTFSKRRNGIMKKAQELTVLCDAKVSLLMISSTHKLHHYLSPGVSLKKMYDEYQKIEGVDLWRKQWERMQEQHRKVLELNSLLRREISRRMGGDLEGLTLVELSALQQEMEEAIIQIRNKKYHTIKNQTGTTRKKIKNLEERHTDLVMELEAKFRGPQFAIGEDDPRNYEAAAAAAVYGNDVAAANLFALSRHPIT

SEQ ID NO: 22160 - protein, 113 aa, Sus scrofa
MSASVLSVISRFLEEYLSSTPQRLKLLDAYLLYILLTGALQFGYCLLVGTFPFNSFLSGFISCVGSFILAVCLRIQINPQNKADFQGISPERAFADFLFASTILHLVVMNFVG

SEQ ID NO: 22161 - protein, 438 aa, Aspergillus oryzae
MPITKIHARSVYDSRGNPTVEVDVVTETGLHRAIVPSGASTGQHEAHELRDGDKTHWGGKGVLKAVENVNKTIAPAVIEENLDVKDQSKVDEFLKKLDGSANKSNLGANAILGVSLAIAKAGAAEKGVPLYAHISDLAGTKKPYVLPVPFQNVLNGGSHAGGRLAFQEFMIVPSAAPSFSEALRQGAEVYQKLKTLAKKKYGQSAGNVGDEGGVAPDIQTAEEALDLITEAIEQAGYTGKMKIAMDVASSEFYKADVKKYDLDFKNPDSDSSKWLTYEQLADLYKTLASKYPIVSIEDPFAEDDWEAWSYFYKTSDFQIVGDDLTVTNPLRIKKAIETKACNALLLKVNQIGTLTESIQAAKDSYADNWGVMVSHRSGETEDVTIADIAVGLRSGQIKTGAPARSERLAKLNQILRIEEELGNNAIYAGEKFRTSVNL

SEQ ID NO: 22162 - protein, 440 aa, Alnus glutinosa
MAEITHIKARQIFDSRGNPTVEAEVTTANGVVSRAAVPSGASTGVYEALELRDGGSDYLGKGVLKAVDNVNKIIGPALIGKDATEQTAIDIDFMFQQLDGTVNEWGWCKQKLGANAILAVSLAVCKAGASVKKIPLYKHIANLAGNPKLVLPVPAFNVINGGSHAGNKLAMQEFMILPVGASSFKEAMKMGVEVYHHLKAVIKKKYGQDATNVGDEGGFAPNIQENKEGLELLKTAIAKAGYVVIGMDVAASEFYEKDKDITNFKEENNDGSQKISADQLKDLYKSFVDEYPIVSIEDPFDQDDWEHYSKLTAEIGEKVQIVGDDLLVTNPKRVEKAIKEKACNALLLKVNQIGSVTESIEAVKMSKRAGWGVMAHRSGETEDTFIADLSVGLATGQIKTGAPCRSERLAKYNQLLRIEEELGSEAVYAGANFRTPVEPY

SEQ ID NO: 22163 - protein, 446 aa, Plasmodium falciparum [sequence omitted]

SEQ ID NO: 22164 - protein, 339 aa, Homo sapiens
MTDRSPFETDMLTLTRYVMEKGRQAKGTGELTQLLNSMLTAIKAISSAVRKAGLAHLYGIAGSVNVTGDEVKKLDVLSNSLVINMLQSSYSTCVLVSEENKDAIITAKEKRGKYVVCFDPLDGSSNIDCLASIGTIFAIYRKTSEDEPSEKDALQCGRNIVAAGYALYGSATLVALSTGQGVDLFMLDPALGEFVLVEKDVKIKKKGKIYSLNEGYAKYFDAATTEYVQKKKFPEDGSAPYGARYVGSMVADVHRTLVYGGIFLYPANQKSPKGKLRLLYECNPVAYIIEQAGGLATTGTQPVLDVKPEAIHQRVPLILGSPEDVQEYLTCVQKNQAGS

SEQ ID NO: 22165 - protein, 357 aa, Mizuhopecten yessoensis
MGCTMSAEDRAAAERSRDIEKKLKEDGIQAAKDIKLLLLGAGESGKSTIVKQMKIIHEGGFTSEDNKQYKPVVYSNTIQSLVAIVRAMSTLNIPYGDNEREEIKSDAKIVLDVIARMEDTEPFSEELLAAMKRLWTDTGVQECFGRSNEYQLNDSAKYFLDDLDRLGSKDYMPTEQDILRTRVKTTGIVEVHFSFKNLNFKLFDVGGQRSERKKWIHCFEDVTAIIFCVAMSEYDQVLHEDETTNRMQESLKLFDNICNNKWFTDTSIILFLNKKDLFEEKIKKSSLTICFNEYTGNQTYEEAAAYIQAQFEAKNKSSSKEIYCHQTCATDTNNIQFVFDAVTDVIIANNLRGCGLY

SEQ ID NO: 22166 - protein, 359 aa, Cryphonectria parasitica
MDSQRPNDVSPEAMQARIQQARREAEGLKDRIKRKKDELADTSLRDVAHRSHEAIPRNQLMKTKRTLKGHLAKIYAMHWSTDRRHLVSASQDGKLIIWDAYTTNKVHAIPLRSSWVMTCAYAPSGNYVACGGLDNICSIYNLNQNRDGPTRVARELSGHAGYLSCCRFINDRSILTSSGDMTCMKWDIETGTKQIEFADHLGDVMSISLNPTNQNTFISGACDAFAKLWDIRAGKAVQTFAGHESDINAIQFFPDGHSFVTGSDDATCRLFDIRADRELNVYGSESILCGITSVATSVSGRLLFAGYDDFECKVWDVTRGEKVGSLVGHENRVSCLGVSNDGISLCTGSWDSLLKIWAY

SEQ ID NO: 22167 - protein, 377 aa, Nicotiana plumbaginifolia
  unsure (1)..(377): unsure at all Xaa locations
MSVTELKERHMAATQTVNDLREKLKQKRLQLLDTDVSGYARSQGKTPVTFGPTDLVCCRILQGHTGKVYSLDWTPEKNRIVSASQDGRLIVWNALTSQKTHAIKLPCAWVMTCAFSPSGHSVACGGLDSVCSIFNLNSPIDKDGNHPVSRMLSGHKGYVSSCQYVPDEDTHLITSSGDQTCVLWDITTGLRTSVFGGEFQFGHTADVQSVSISSSNPRLFVSGSCDTTARLWDTRVASRAQRTFYCHEGDVNTVKFFPDGNRFGTGSEDGTCRLFDIRTGHQLQVYYQPHGDGDIPHVTSMAFSISGRLLFVRYSNGDCYVWDTLLAKVVLNLGAVQNSHEGXISCLGLSADGXXLCTGSWDTNLKIWAFGGHRSVI

SEQ ID NO: 22168 - protein, 377 aa, Solanum tuberosum
MSVAELKERHMAATQTVNDLREKLKQKRLQLLDTDVSGYAKRQGKSPVTFGPTDLVCCRILQGHTGKVYSLDWTPEKNRIVSASQDGRLIVWNALTSQKTHAIKLPCAWVMTCAFSPSGQSVACGGLDSACSIFNLNSPIDKDGIHPVSRMLSGHKGYVSSCQYVPDEDTHLITSSGDQTCVLWDITTGLRTSVFGGEFQSGHTADVLSVSISSSNPKLFVSGSCDTTARLWDTRVASRAQRTFHGHESDVNTVKFFPDGNRFGTGSDDGSCRLFDIRTGHQLQVYNQPHGDGDIPHVTSMAFSISGRLLFVGYSNGDCYVWDTLLAKVVLNLGSVQNSHEGRISCLGLSADGSALCTGSWDTNLKIWAFGGHRSVV

SEQ ID NO: 22169 - protein, 325 aa, Medicago sativa
MAEGLVLRGTMRAHTDVVTAIATPIDNSDMIVTASRDKSIILWHLTKEDKTYGVPRRRLTGHSHFVQDVVLSSDGQFALSGSWDGELRLWDLNAGTSARRFVGHTKDVLSVAFSIDNRQIVSASRDRTIKLWNTLGECKYTIQDGDAHSDWVSCVRFSPSTPQPTIVSASWDRTVKVWNLTNCKLRNTLAGHSGYVNTVAVSPDGSLCASGGKDGVILLWDLAEGKRLYSLDAGSIIHALCFSPNRYWLCAATESSIKIWDLESKSIVEDLKVDLKTEADAAIGGDTTTKKKVIYCTSLNWSADGSTLFSGYTDGVVRVWGIGRY

SEQ ID NO: 22170 - protein, 317 aa, Oreochromis niloticus
MTEQMTVRGTLKGHSGWVTQIATTPKYPDMILSASRDKSIIMWKLTRDETNYGIPQRSLKGHSHFVSDVVISSDGQFALSGAWDGTLRLWDLTTGLTTRRFVGHTKDVLSVAFSADNRQIVSGSRDKTIKLWNTLGVCKYTIQDEGHTEWVSCVRFSPNSSNPIIVSCGWDKMVKVWNLANCKLKTNHIGHTGYLNTVTVSPDGSLCASGGKDGQAMLWDLNEGKHLYTLDSGDVINALCFSPNRYWLCAATGPSIKIWDLEGKIIVDELRQEVISTNSKAEPPQCTSLAWSADGQTLFAGYTDNLIRVWQVTIGTR

SEQ ID NO: 22171 - protein, 326 aa, Nicotiana plumbaginifolia
MSHESLVLRGTMRAHTDWVTAIATPVDNSDMIVTSSRDKSIIVWSLTKDGPQYGVPRRRLTGHGHFVQDVVLSSDGMFALSGSWDGELRLWDLQAGTTARRFVGHTKDVLSVAFSADNRQIVSASRDKSIRLWNTLGECKYIIQDGDSHSDWVSCVRFSPNNLQPTIVSGSWDRTVKIWNLTNCKLRATLAGHTGYVNTTAVSPDGSLCASGGKDGVILLWDLAEGKKLYSLESGSIIHSLCFSPNRYWLCAATESSIKIWDLESKTIVDDLKVDLKQESEMSAEGTASGKNKVIYCTSLGWSADGSTLFSGYTDGLIRVWGIGRF

SEQ ID NO: 22172 - protein, 316 aa, Neurospora crassa
MAEQLILKGTLEGHNGWVTSLATSLENPNMLLSGSRDKSLIIWNLTRDETSYGYPKRRLHGHSHIVSDCVISSDGAYALSASWDKTLRLWELSTGTTTRRFVGHTNDVLSVSFSADNRQIVSGSRDRTIKLWNTLGDCKFTITEKGHTEWVSCVRFSPNPQNPVIVSSGWDKLVKVWELSSCKLQTDHIGHTGYINAVTISPDGSLCASGGKDGTTMLWDLNESKHLYSLNANDEIHALVFSPNRYWLCAATSSSIIIFDLEKKSKVDELKPEFQNIGKKSREPECVSLAWSADGQTLFAGYTDNIIRAWGVMSRA

SEQ ID NO: 22173 - protein, 312 aa, Leishmania major
MNYEGHLKGHRGWVTSLACPQQAGSYIKVVSTSRDGTVISWKANPDRHSVDSDYGLPNHRLEGHTGFVSCVSLAHATDYALTASWDRSIRMWDLRNGQCQRKFLKHTKDVLAVAFSPDDRLIVSAGRDNVIRVWNVAGECMHEFLRDGHEDWVSSICFSPSLEHPIVVSGSWDNTIKVWNVNGGKCERTLKGHSNYVSTVTVSPDGSLCASGGKDGAALLWDLSTGEQLFKINVESPINQIGFSPNRFWMCVATERSLSVYDLESKAVIAELTPDGAKPSECISIAWSADGNTLYSGHKDNLIRVWSISDAE

SEQ ID NO: 22174 - protein, 312 aa, Leishmania infantum
MNYEGHLKGHRGWVTSLACPQQAGSYIKVVSTSRDGTAISWKANPDRHSVDSDYGLPSHRLEGHTGFVSCVSLAHATDYALTASWDRSIRMWDLRNGQCQRKFLKHTKDVLAVAFSPDDRLIVSAGRDNVIRVWNVAGECMHEFLRDGHEDWVSSICFSPSLEHPIVVSGSWDNTIKVWNVNGGKCERTLKGHSNYVSTVTVSPDGSLCASGGKDGAALLWDLSTGEQLFKINVESPINQIAFSPNRFWMCVATERSLSVYDLESKAVIAELTPDGAKPSECISIAWSADGNTLYSGHKDNLIRVWSISDAE

SEQ ID NO: 22175 - protein, 327 aa, Brassica napus
MAEGLVLKGTMRAHTDMVTAIATPIDNSDTIVSASRDKSIIVWKLTKDDKSYGVRQRRLTGHSHFVEDVVLSSDGQFALSGSWDGELRLWDLAAGVSTRRFVGHTKDVLSVAFSLDNRQIVSASRDRTIKLWNTLGECKYTISEGGEGHRDWVSCVRFSPNTLQPTIVSASCDKTVKVWNLSNCKLRSTLAGHTGYVSTVAVSPDGSLCASGGKDGVVLLWDLAEGKKLYSLEANSVIHALCFTPNRYWLCAATEQGIKIWDLESKTVVEDLKVDLKAEAEKSDGSGTAATKRKVIYCTSLNWSADGSTLFSGYTDGVIRVWGIGRY

SEQ ID NO: 22176 - protein, 353 aa, Mizuhopecten yessoensis
MACCLSEEAKEQKRINCEIEKELRKAKRDARRELKLLLLGTGESGKSTFIKQMRIIHGTGYSEEDKRGFIKIVYQNIFMAMHSMIRAMDTIKISFEVADNEENAIMIRQVDYETVTTLDSQSVEAILSLWADAGIQECYDRRREYQLTDSAKYYLDAVDRIAEPNYLPTLQDILRVRVPTTGIIEYPFDLDSIIFRMVDVGGQRSERRKWIHCFENVTSIMFLVALSEYDQVLVESDNENRMEESKALFRTIITYPWFQNSSVILFLNKKDLLEEKIMHSHLVDYFPEFDGQKKDAQGAREFILRMFVDLNPDPDKIIYSHFTCATDTENIRFVFAAVKDTILQLNLKEYNLV

SEQ ID NO: 22177 - protein, 89 aa, Blepharisma japonicum
KGLGKVGAKKRHRRVIRENNQGITKPAIRRLARRGGVKRTLSGLVYDETRNVLKVFLESVVRDAVTYTEHAKRETVTALDVVYALKRQG

SEQ ID NO: 22178 - protein, 390 aa, Ovis aries
AFVSAVLMGFSKLGKSFEMLILGRFIIGVYCGLTTGFVPMYVGEVSPTELRGALGTLHQLGIVVGILIAQVFGLDSIMGNQELWPLLLSVIFIPALLQCILLPFCPESPRFLLINRNEENRAKSVLKKLRGTADVTRDLQEMKEESRQMMREKKVTILELFRSAAYRQPILIAVVLQLSQQLSGINAVFYYSTSIFEKAGVQQPVYATIGSGIVNTAFTVVSLFVVERAGRRTLHLIGLAGMAGCAVLMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 22179 - protein, 203 aa, Rhizobium leguminosarum
MKLYHHPLSGHAHRAHLFLSLLGVPYELVEVDLAAGAHKAPDFLKLNPFGQVPVLDDNGTVIADSSAILVYLARKYGRTDWLPEEAVAAARIQKWLSVAAGEIAYGPCAARLVTVFGADFRTDEVIARAHRILALVEAELGARRFLLGDNATIADIALYSYIANAPEGNVDTSAYQAVRAWLARIEALPGFVGFRRTKIGLAA

SEQ ID NO: 22180 - protein, 540 aa, Chlorella kessleri
MAGGGPVASTTTNRASQYGYARGGLNWYIFIVALTAGSGGLLFGYDIGVTGGVTSMPEFLQKFFPSIYDRTQQPSDSKDPYCTYDDQKLQLFTSSFFLAGMFVSFFAGSVVRRWGRKPTMLIASVLFLAGAGLNAGAQDLAMLVIGRVLLGFGVGGGNNAVPLYLSECAPPKYRGGLNMMFQLAVTIGIIVAQLVNYGTQTMNNGWRLSLGLAGVPAIILLIGSLLLPETPNSLIERGHRRRGRAVLARLRRTEAVDTEFEDICAAAEESTRYTLRQSWAALFSRQYSPMLIVTSLIAMLQQLTGINAIMFYVPVLFSSFGTARHAALLNTVIIGAVNVAATFVSIFSVDKFGRRGLFLEGGIQMFIGQVVTAAVLGVELNKYGTNLPSSTAAGVLVVICVYVAAFAWSWGPLGWLVPSEIQTLETRGAGMSMAVIVNFLFSFVIGQAFLSMMCAMRWGVFLFFAGWVVIMTFFVYFCLPETKGVPVETVPTMFARHWLWGRVMGEKGRALVAADEARKAGTVAFKVESGSEDGKPASDQ

SEQ ID NO: 22181 - protein, 534 aa, Chlorella kessleri
MAGGAIVASGGASRSSEYQGGLTAYVLLVALVAACGGMLLGYDNGVTGGVASMEQFERKFFPDVYEKKQQIVETSPYCTYDNPKLQLFVSSLFLAGLISCIFSAWITRNWGRKASMGIGGIFFIAAGGLVNAFAQDIAMLIVGRVLLGFGVGLGSQVVPQYLSEVAPFSHRGMLNIGYQLFVTIGILIAGLVNYGVRNWDNGWRLSLGLAAVPGLILLLGAIVLPESPNFLVEKGRTDQGRRILEKLRGTSHVEAEFADIVAAVEIARPITMRQSWRSLFTRRYMPQLLTSFVIQFFQQFTGINAIIFYVPVLFSSLGSASSAALLNTVVVGAVNVGSTMIAVLLSDKFGRRFLLIEGGITCCLAMLAAGITLGVEFGQYGTEDLPHPVSAGVLAVICIFIAGFAWSWGPMGWLIPSEIFTLETRPAGTAVAVMGNFLFSFVIGQAFVSMLCAMKFGVFLFFAGWLVIMVLCAIFLLPETKGVPIERVQALYARHWFWKKVMGPAAQEIIAEDEKRVAASQAIMKEERISQTMK

SEQ ID NO: 22182 - protein, 438 aa, Ovis aries
  unsure (1)..(438): unsure at all Xaa locations
FRLVEKKTGKVWAGKFFKAYSAKEKENIRQEISIMNCLHHPKLVQCVDAFEEKANIVMVLEIVSGGELFERIIDEDFELTERECIKYMKQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDIKNRLNCTQCLQHPWLXXXTKNMEAKKLSKHRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYQEDGNCSLIISDVCGDDDAKYTCKAVNSLGEATCTAELIVETMEEGEGEGGEEEEEE

SEQ ID NO: 22183 - protein, 360 aa, Canis familiaris
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGADLLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVVSFVPPPLDQEEMES

SEQ ID NO: 22184 - protein, 444 aa, Emericella nidulans
MSQILTAPQAEALHKAMLAYLSVINAPQTAETLREELHFDESYNEATCKKFEGVLEKKWTGIARLQRRINDLEAEVRSLQAELEASPSAARAKNQDPTNWLPKPSSTHTLTSHRDAVTCVAFHPVFTSLASGSEDCTIKIWDWELGEIERTLKGHIRGVSGLDYGGQKGNTLLASCSSDLTIKLWDPSKDYANIRTLSGHDHSVSSVRFLTSNDNHLISASRDGTLRIWDVSTGFCVKVIKSATESWIRDVSPSFDGKWLVSGGRDQAITVWEVSSAEPKAALLGHENFIECCVFAPPASYEHLATLAGLKKPPPATSSCEFVATGARDKTIKLWEARGRLIKTLHGHDNWVRGLVFHPGGKYLFSVSDDKTIRCWDLSQEGRLVKTISGAHEHFVSCIRWAPSPNTDNPDPAGEKAGKKDAVKPSYRCVIATGCADNSVRVFS

SEQ ID NO: 22185 - protein, 955 aa, Flaveria brownii
MSSLFVEGMPLKSANESCLPASVKQRRTGDLRRLNHHRQPAFVRGICRRKLSGVSRIELRTGGLTLPRAVLNPVSPPVTTTKKRVFTFGKGNSEGNKDMKSLLGGKGANLAEMASIGLSVPPGLTISTEACEEYQQNGKKLPPGLWDEILEGLQYVQKEMSASLGDPSKALLLSVRSGAAISMPGMMDTVLNLGLNDEVVDGLAAKSGARFAYDSYRRFLDMFGNVVMGIPHSLFDEKLEQMKAEKGIHLDTDLTAADLKDLAEQYKNVYVEAKGEKFPTDPKKQLELAVNAVFDSWDSPRANKYRSINQITGLKGTAVNIQCMVFGNMGNTSGTGVLFTRNPSTGEKKLYGEFLVNAQGEDVVAGIRTPEDLVTMETCMPEAYRELVENCVILERHYKDMMDIEFTVQENRLWMLQCRTGKRTGKGAVRIAVDMVNEGLIDTRTAIKRVETQHLDQLLHPQFENPSAYKSHVVATGLPASPGAAVGQVVFSAEDAETWHAQGKSAILVRTETSPEDVGGMHAAAGILTARGGMTSHAAVVARGWGKCCVSGCADIRVNDDMKVFTIGDRVIKEGDWLSLNGSTGEVILGKQLLAPPAMSNDLETFMSWADQARRLKVMANADTPNDALTARNNGAQGIGLCRTEHMFFASDERIKAVRKMIMAVTPEQRKAALDLLLPYQRSDFEGIFRAMDGLPVTIRLLDPPLHEFLPEGDLEHIVNELTADTGMSKDEIYSRIEKLSEVNPMLGFRGCRLGISYPELTEMQVRAIFQAAVSMNNQGVTVIPEIMVPLVGTPQELRHQIGVIRGVAANVFAEMGLTLEYKVGTMIEIPRAALIADEIAKEAEFFSFGTNDLTQMTFGYSRDDVGKFLPIYLSQGILQHDPFEVLDQKGVGQLIKMATEKGRAANPNLKVGICGEHGGEPSSVAFFDGVGLDYVSCSPFRVPIARLAAAQVVV

SEQ ID NO: 22186 - protein, 953 aa, Flaveria bidentis
MMSSLSVEGMLLKSARESCLPARVNQRRNGDLRRLNHHRQSSFVRCLTPARVSRPELRSSGLTPPRAVLNPVSPPVTTAKKRVFTFGKGRSEGNRDMKSLLGGKGANLAEMSSIGLSVPPGLTISTEACEEYQQNGKSLPPGLWDEISEGLDYVQKEMSASLGDPSKPLPLSVRSGAAISMPGMMDTVLNLGLNDEVVAGLAGKSGARFAYDSYRRFLDMFGNVVMGIPHSLFDEKLEQMKAEKGIHLDTDLTAADLKDLVEKYKNVYVEAKGEKFPTDPKKQLELAVNAVFDSWDSPRANKYRSINQITGLKGTAVNIQSMVFGNMGNTSGTGVLFTRNPSTGEKKLYGEFLINAQGEDVVAGIRTPEDLGTMETCMPDAYKELVENCEILEGHYKDMMDIEFTVQENRLWMLQCRTGKRTGKGAVRIAVDMVNEWLIDTRTAIKRVETQHLDQLLHPQFEDPSAYKSHVVATGLPASPGAAVGQVCFSAEDAETWHAQGKSAILVRTETSPEDVGGMHAAAGILTARGGMTSHAAVVARGWGKCCVSGCADIRVNDDMKIFTIGDRVIKEGDWLSLNGTTGEVILGKQLLAPPAMSNDLEIFMSWADQARRLKVMANADTPNDALTARNNGAQGIGLCRTEHMFFASDERIKAVRKMIMAVTPEQRKVALDLLLPYQRSDFEGIFRAMDGLPVTIRLLDPPLHEFLPEGDLEHIVNELAVDTGMSADEIYSKIENLSEVNPMLGFRGCRLGISYPELTEMQVRAIFQAAVSMTNQGVTVIPEIMVPLVGTPQELRHQISVIRGVAANVFAEMGVTLEYKVGTMIEIPRAALIAEEIGKEADFFSFGTNDLTQMTFGYSRDDVGKFLQIYLAQGILQHDPFEVIDQKGVGQLIKMATEKGRAANPNLKVGICGEHGGEPSSVAFFDGVGLDYVSCSPFRVPIARLAAAQVIV

SEQ ID NO: 22187 - protein, 956 aa, Flaveria pringlei
MMSSLFVEGMLLKSADESCLPAKGKQRRTGDLRRLNHHRQPAFVRWICRRKLSGVSRIEFHSGGLTPPRAVLNPVSPPVTTTKKRVFTFGKGRSEGNKDMKSLLGGKGANLAEMASIGLSVPPGLTISTEACEEYQQNGKKLPPGLWDEILEGLRYVQKEMSASLGDPSKPLLLSVRSGAAISMPGMMDTVLNLGLNDEVVAGLAGKSGARFAYDSYRRFLDMFGNVVMGIPHSLFDEKLEEMKAEKGVHLDTDLTAADLKDLVEQYKNVYVEAKGEKFPTDPKKQLELAVNAVFDSWDSPRANKYRSINQITGLKGTAVNIQCMVFGNMGNTSGTGVLFTRNPSTGEKKLYGEFLVNAQGEDVVAGIRTPEDLATMETCMPEAYRELVENCKILERHYKDMMDIEFTVQENRLWMLQCRTGKRTGKGAVRIAVDMVNEGLIDTRTAIKRVETQHLDQLLHPQFENPSAYKSHVVATGLPASPGAAVGQVVFSAEDAETWHAQGKSAILVRTETSPEDVGGMHAAAGILTARGGMTSHAAVVARGWGKCCVSGCADIRVNDDMKVLTIGDRVIKEGDWLSLNGSTGEVILGKQLLAPPAMSNDLETFMSWADQVRRLKVMANADTPNDALTARNNGAQGIGLCRTEHMFFASDERIKAVRKMIMAVTPEQRKAALDLLLPYQRSDFEGIFRAMDGLPVTIRLLDPPLHEFLPEGDLEHIVNELAVDTGMSEDEIYSKIEKLSEVNPMLGFRGCRLGISYPELTEMQVRAIFQAAVSMNNQGVTVIPEIMVPLVGTPQELRHQIGVIRGVAANVFAEMGLTMDYKVGTMIEIPRAALIAEEIAKEAEFFSFGTNDLTQMTFGYSRDDVGKFLQIYLSQGILQHDPFEVLDQKGVGQLIKMATEKGRAANPNLKVGICGEHGGEPSSVAFFDGVGLDYVSCSPFRVPIARLAAAQVVV

SEQ ID NO: 22188 - protein, 949 aa, Mesembryanthemum crystallinum
MASAFKGILIRSPPDVCAETVAKVSQCNRAQLVKNSSTGFKNIFKLSEARKFHAPVASHLRSQAVMAPASDPTSTAIKRVFTFGKGRSEGNKGMKSLLGGKGANLAEMASIGLSVPPGLTISTEACQEYQEHGKQLSAGLWEEILEGLRVIEKDMGSYLGDPSKPLLLSVRSGAAISMPGMMDTVLNLGLNDDVVAGLAAKSGERFAYDSYRRFLDMFGNVVMGISHSSFEEKLEKLKQAKGVKLDTELTASDLKEVVEQYKNVYLEVKGEKFPADPERQLQLAIQAVFDSWDSPRAIKYRNINQITGLKGTAVNIQCMVFGNMGNTSGTGVLFTRNPSTGEKKLYGEFLINAQGEDVVAGIRTPEDLDTMRSCMPEAYKELVENCEILERHYKDMMDIEFTVQENRLWMLQCRSGKRTGKGAVKIAVDLVKEGIVDTYTAIKMVEPQHLDQLLHPQFEDPSAYKDRVIATGLPASPGAAVGQIIFSADEAESWQAQGKSVILVRNETSPEDVGGMHAAIGILTARGGMTSHAAVVAGGWGKCCVSGCSEIRVNDTDKVLLVGDKVISEGDWLSLNGSTGEVILGKVPLSPPALSGDLETFMSWADDIRVLKVMANADTPEDALAARNNGAEGIGLCRTEHMFFASDDRIKTVRKMIMAVTSEQRKVALDQLLPYQRSDFEGIFRAMDGLPVTIRLLDPPLHEFLPEGDVEQIVSELTLETGMAEDEIFSRIEKLSEVNPMLGFRGCRLGISYPELTEMQARAIFQAAVSMSNQGVKVFPEIMVPLVGTPQELGHQVSLIRNVAEKVFSETGSSLSYKVGTMIEIPRAALVADEIAMEAEFFSFGTNDLTQMTFGYSRDDVGKFLPVYLSKGILQSDPFEVLDQKGVGQLIKLATEKGRSARPSLKVGICGEHGGEPSSVAFFAEAGLDYVSCSPFRVPIARLAAAQVV

SEQ ID NO: 22189 - protein, 409 aa, Pseudomonas pseudoalcaligenes
MSKTIPIVDAQHAGSAYQHVPGHPDPQLSAVAKGTPTGEYLRRYWQPVALSADVTDRPQMVRILGEDLVLFRDKAGRPGLLYPRCMHRGTSLYYGHVEEAGIRCCYHGWLFAVDGTCLNQPCEPEGGLRREAARQPWYPVEERYGLVFAYMGPPEKKPVLPRYDILEDLEEGEFIEVISGGFVSYADHVEDPNVPYHWLQNWENIMDPYHVYILHSTFSGIQFAENFKILPRVDFEAVDGGVIYHAWRDLEDGRQLERINSALFPNISAIPMIDLSPGQGRWIGWHVAVDDQHYRGFFAARTRQPGNFAPIKMHNGKSWTELSEQEKQDFPGDFEAQFGQGRVTLHGEEHLATSDHGIALLRRQMKQQIAIVQQGGDPAGVHFNEADALVRIRSGNFYTTSDKTETAAD

SEQ ID NO: 22190 - protein, 1229 aa, Nitrosomonas europaea ATCC 19718
MILTSLTQRFAIWFTLVALLPIALVGYGLLHIFEGEIRKSAIQQVSSIADKKVEQIDSYLRERILDATFIQTSDTTRQAIDEFSQIFSQFGVDSETYRALDARHQAHYERYLEGTGYYDLFLISPDGWIVFSVSHESDFATSLLTGPYQDSGLGQVFRQTKETHQSSLSSFEYYPPSHGAIAAFVAVPIMIEGNFHGVLALQIYSEHIFDVLTNNVGLGESGETVVTYMENKHLARVMAPLREDPDAALKRTISLDEPQFSLAIRNSLSGEHGGGVVTDFHGNPVIAAWRYLPRVDWGMVVQIDTEEAFASVMQMRVMGLVVLGLTFLMAILGALLFNRRVVTPLKNLNECAQAINAGNLQHHIPDEGWDEIGQLASAFNMMTERLDISYRHLEARVAERTARLEQLNAELAIKEEETRSVVEHMVDCVVTTDERGVMLSVNPVMEKLFGYTVEEAIGQNVAVLVPKPDRDMHEYYMQRYCHTGYGQQYVGRPQQPGGHHVGLGREVEGVHKDGTLLPVYLAVSEYFVGDKRHFTGIMRDMREHVKIRQDLEQARRDAELANQAKSAFLAAMSHEIRTPMNGVIGMIDVLSQTSLSSYQKEMTDLIRESAFVLLEIIEDILDFSKIEAGRLEIEQRPISLEKVVERACGTLTHMAASKEVELILFVDPALPKNVAGDALRLRQILINLINNAIKFSSGMSRPGCVIVKAVPADRANGDVVTVLFQVIDNGIGMDDATRERLFTPFSQGDTSTTRRFGGTGLGLTICRRLVELMKGDITVESQPGKGSTFKARIPFRMIQEGAVQQDEPDEVDLSGLSCIVMGSEDGLSPQLATYLKYAGAAVERISGLSATLERIGQLPAGEWLLVADASDGEFPVDELRAAFGDRPDASAGDQLRFVIVRRGRRHRGRMEEEGVVTLDGNVLYRRVFLHAVAVAAGRAKLEEDQTAAVEVVSKVVPLSREEALQQGRLILVAEDNEINQKVIHQQLTLLGFAADIVINGREALQSWKNGEYALILTDLHMPEMDGYQLTQSIRSEKTGHYQIPIIALTANALKGEAEKCRALGMDDYLSKPVQLEQLKSVLEKWLPRSKQTEQQEERILPPSAATGKVVVDINVLKSLVGSDQAVINEFLQDFLHDTRKIAEQLHSAITGGQADKAKFAAHKLKSSARSVGALALGEWCAQMEMAAKEGDVEKLVELLPGFEQELAQVESYIKKVLAQPDVEAQKDEI

SEQ ID NO: 22191 - protein, 487 aa, Nitrosomonas europaea ATCC 19718
MRLIQKALTFDDILLVPAYSEVLPKDVDLATQLTRTLRIKIPIVSAAMDTVTEARLAIAIAQEGGIGIIHKNMPIKAQAAQVAQVKRFESGVVTDPIIVSPDMTVRKVLELIRQHNISGLPVVKSKKVVGIVTNRDLRFETNLDQPVKNIMTPKKHLVTVREGVSKEDALALLHKHRLEKALIVSENFELRGMITVKDITRTTEHPYASKDNQERLYVGAAIGVGEGSDERAAALVEAGADVIVVDTAHGHSQGVLDRVRWVKKKFPEIQVIAGNVATATAAKALVDHGADAVKVGIGPGSICTTRVVAGVGVPQISAIDNVATALLGTGVPLIADGGIRYSGDIAKALAAGASSVMLGGLLAGTEESPGEIELLKGRSYKSYRGMGSLSAMQQGSSDRYFQEAERHEADKLVPEGVEGRVPYKGYLANVIHQLTGGVRSSMGYLGCRTISDMHTKAEFIEITSSGIRESHVHDVQITKEAPNYHVE

SEQ ID NO: 22192 - protein, 751 aa, Nitrosomonas europaea ATCC 19718
MAKAKVSGSAKKNIVTSTEVTETKSGKSRVETPDNGVKVTGKNAKNTFSAETEVVSVKKEATSASRKKSVKAAKSDDDSVLVGQNKNTLLPAEKSEDLGAVDEVSEKTRVSKRNKSTLSEKQITDLSESAVSVSSDNDIELRRMRLKKLIMQGKERGYLTYSEINDHLPDDMLDADQIESIISMINDMGISVHDEAPDAEALLMSDAATAVTDEDVVEEAEAALSSVDSEFGRTTDPVRMYMREMGSVELLTRESEIEIAKRIEDGLRHMIQAISACPTIIENILELAADVENGRLRADELVDGFLDDDTDEIMGKEMSEESLDQDFDSEDGEDEQVAAASADMLKMKAEVLERFAVIRQTYDGMKKIINKKDGRQDKKYKQLQEKISTELMAMRFSAKMVEKLCDTQRDIVNDIRNCERKIAELCVTRAGMPRNYFIKAFPGNETDIDWISSEVESGQPYSQSLEHFRPAVMEQQQKMLELQKQAGIPIKELKEINRRMTTGEAKARRAKREMTEANLRLVISIAKKYTNRGLQFLDLIQEGNIGLMKAVDKFEYRRGYKFSTYATWWIRQAITRSIADQARTIRIPVHMIETINKMNRISRQILQETGQEPEPAVLAEKMEMPEEKIRKILKISKEPISMETPIGDDEDSHLGDFIEDASTMEPADAAVYAGLRTVTKDVLDSLTPREAKVLRMRFGIEMNTDHTLEEVGRQFDVTRERIRQIEAKALRKLRHPARSDRLRSFLDSGNS

SEQ ID NO: 22193 - protein, 613 aa, Nitrosomonas europaea ATCC 19718
MNDPISRRAFLKRSGALGTFAALDWMLPIYARSDSLSVVTPTTQLSGDVINLTIARTPFRIDDHIATATTINGTVPGPLLHLREGQDITLNVTNHLDETSSIHWHGILLPPEMDGVPGISFPGIEPGATFSYRFTIRQYGTYWFHSHSGGQEQAGVYAPMIIDPIEPDPVKYDREYVIMLSDWSFSSVDSMIEKLKKQPGYFNFQKRTLGDFIQDAMRDGWRPALDDYLMWARMRMDPTDLADVTGHAYTYLMNGLTPAANWTGLFHPGERIRLRFIQVGVMTFQDIRIPGLGMTVVQADGQNVQPVEVDEFRIGPAETYDVIVEPKEERAYTIFAETLDRSGFARGTLAPRPGMAAEVPSRRPRSLRTMADMGMQHMSGVDHGNHAPGNATMGEPEEGTQHDTPDRHGEHAKEGIHGRHDRHAQPGFPDSRPVRHGTDDHGSGNQFIPDFTQSRMDEPGIGLGNDGRRVLVYTDLKSLKPYPDQREPERELEIHLTGHMERFIWSFDGEKYSDAKESILFRHGERLRWIFVNDTMMEHTMHLHGTWMYLENGAGAYLPRKHTVLVKPAERVSVAITADAPGPWAFHCHLLLHMETGMFRVVEILDAAPGTES

SEQ ID NO: 22194 - protein, 334 aa, Nitrosomonas europaea ATCC 19718; identical to SEQ ID NO: 868

SEQ ID NO: 22195 - protein, 312 aa, Nitrosomonas europaea ATCC 19718
MTASEKTVLPELSYLRTTISNVVIELRNLRETSLEHRQRLNNPPKLPSRKTLADIIDKLSAALFPNRLGQPDLTGESIDYFVGYTLDTALRDLSAEVIRELHFASGLEAVSHTVRERAVEITHVFAGQLPAIRHILDSDIRAAYEGDPAAHNIDEVLVCYPGITAIIHYRLAHELHKLGVPLIARMISEIAHSLTGIEIHPGARIGDSFFIDHGTGVVIGETAIIGRKVRLYQAVTLGAKHFPVDEQGALIKGNQRHPVVEDDVVIYAGATILGRITIGHGSTIGGNVWLTHDIPPGSHITQAQMRHEKVPG

SEQ ID NO: 22196 - protein, 280 aa, Nitrosomonas europaea ATCC 19718
MNEIMALPVMAGGDLDSYIRATSSFPVLSREEEASLAKRMREEGDVNAAHQLVLSHLRVVVTIARGYLGYGLPHADLIQEGNIGLMKAVRRFDPERGVRLISFAIHWIRAEIHEFIMRNWRLVKIATTKQQRKLFFNLRSMKKGLDTMSQAEVASMAEQLGVKAEEVVEMETRFSGRDISLEPVTDSDEDDFSPIAWLTDGSDPSRELEKEQLERLTHARLKNSLDSLDERSRRIIEARWLREDKAATLHELADELGVSAERVRQIEAKAMKKMRAEIAI

SEQ ID NO: 22197 - protein, 361 aa, Nitrosomonas europaea ATCC 19718
MITQQQIETVLGQIIDPTTGKDYLTSKAVSDIQIKQDNVSVNIELGYPAKSVLNTVHQQIEQAIRTVPGIGSITVNVTSNIIAHSAQRKLKLIPGVKNVIAVASGKGGVGKSATAVNLALALAAEGATVGILDADIYGPSQPQMLGVSGRPDSPDGKTIEPMQAHGIQMMSIGLLIDVETPMVWRGPMVTQALQQLLNDTRWHDLDYLVIDLPPGTGDIQLTLAQKIPVTGAVIVTTPQDIALLDARKGLKMFEKVGIPILGIVENMSLHTCSHCGHTEPIFGTGGGEKMCRDYNVELLGALPLDIRIREHTDAGKPSVVAEPDGQIADIYRTIARLVAAKISDMARDYSDVFTQIIMEDD

SEQ ID NO: 22198 - protein, 478 aa, Nitrosomonas europaea ATCC 19718
MSATINPVVDNSVFTDCKVADLSLADWGRKEIAIAETEMPGLMALREQYADKKPLAGARIAGSLHMTIQTAVLIETLVALGAEVRWASCNIFSTQDHAAAAIAARNIPVFAYKGESLEEYWDYAHQIFEWASDGSHTANMILDDGGDATLLLILGSKAERDPSVIANPTNEEEQVLFASIRSRLASHPGWYSRNLAAIRGVTEETTTGVHRLYEMEKKGELPFPAINVNDSVTKSKFDNLYGCRESLVDGIKRATDVMIAGKIAVVCGYGDVGKGCAQSLRGLGATVWITEIDPICALQAAMEGYRVVTMDDACDKADIFVTATGNLRVITHDHMLKMKDQSIICNIGHFDSEIDIASVQKYQWENIKPQVDHVIFPTGRRIIVLAQGRLVNLGCATGHPSFVMSSSFTNQVLAQIELWQNGKDYQKKVYVLPKRLDEMVARLHLGKLGVKLTELTDEQAHYLNLDKNGPYKPEMYRY

SEQ ID NO: 22199 - protein, 371 aa, Nitrosomonas europaea ATCC 19718
MRRIRAAVVYQKGGPFQIEDLRLEAPRTDEVLVRIVATGMCHTDMVARDQLYDVPLPVVLGHEGSGIVEQIGDGVRKVAVGNHVVLTYMWCGHCKPCLRGDLTYCEHFYALNFGGVREDGSTSTCLANDTRRPIHDHFFGQSSFGTFALVHERNVIKVPETAPLELLGPLGCGIQTGAGAVINTLKVSPGSSFVAFGGGAVGLSAVMAAHAAGATTIISVDVVPSRLALAMELGATHTINSRETDPVEAVHKIINGGADFTLESSGRPAVLRQAIDALAIRGTCGIVGAPALGTEASFDVNGVMTTGKRIIGIVEGDSKPDLFIPALVELYQQGKFPFDRLVKFYSLDQINQAAEDSEKGITIKPIIRLQS

SEQ ID NO: 22200 - protein, 368 aa, Nitrosomonas europaea ATCC 19718
MKTRAAVAWQAGQPLTIEEVDLAGPRTGEVLVEIKATGICHTDYYTLSGADPEGLFPAILGHEGAGIVVEVGADVKSLRPGDHVIPLYTPECRECKFCLSRKTNLCQAIRATQGRGLMPDGTSRFSLDGKAIMHYMGTSTFSNYIVVPEIALAKIREDAPFDKACYIGCGVTTGIGAVLFTAKVEVGANVAVFGLGGIGLNVIQGARMAGADKIIGIDLNPEREALGRQFGMTHFIDPSQVENVVDAVIQLTDGGADYSFECIGNTTVMRQALECTHKGWGRSIIIGVAKAGAEISTRPFQLVTGRKWEGSAFGGARGRSDVPRIVDWYMDGKISIDPLITHILKLEEINEGFKLMEAGESIRSVVVF

SEQ ID NO: 22201 - protein, 391 aa, Nitrosomonas europaea ATCC 19718
MKKSFAAVQQQTETSIVFDTHPEVSIDLSLVEARLKQGYQKPFLLIDSNIIRNKARRFKTSMPRVRPHYAAKANPDPRVLKTLIEEGVGFEIASIAELDLLMSLGVPAAEIFYSNPMKSRAYIEYAAAKGVEWYVLDSIEELRKIVSIKPDAKLYLRIDTPNIGSDWPLAGKFGTHLVDVSEIIDEAVRLKADLAGVTFHVGSQCRNPQNWRVGIERAQTVFASMREAGLKPRLLNLGGGYPVRHVKPIPSIEVIAEVINEAIADLPEDIHVMAEPGRYLVSDSACFVCRVVGTATRNGKRWMYWDAGIFGGIIEVSEGLRYEILTQRNGSLIPWSVAGPTCDSVDVLMHDEMLPEDIQENDFIFIPNAGAYTTSYASNFNGFPLPDVVVI

SEQ ID NO: 22202 - protein, 363 aa, Nitrosomonas europaea ATCC 19718
MYLIYTKRTVFMKNSISLFSSYRFTHIILMLIVLALIPLTSQAEKREFDLSIEDTRIVLVGKRDFHTFAFNGQVPAPLIHVMEGDDVTVNVTNMTTLPHTIHWHGMLQRGTWQSDGVPHATQHAIEPGDTFTYKFKAEPAGTMWYHCHVNVNEHVTMRGMWGPLIVEPKNPLPIEKTVTKDYILMLSDWVSSWANKPGEGGIPGDVFDYYTINAKSFPETQPIRVKKGDVIRLRLIGAGDHVHAIHTHGHISQIAFKDGFPLDKPIKGDTVLIGPGERYDVILNMDNPGLWMIHDHVDTHTTNGDKPDGGIMTTIEYEEVGIDHPFYVWKDKKFVPDFYYEESLKKDLGMHNSKVFKGEPIEE

SEQ ID NO: 22203 - protein, 428 aa, Nitrosomonas europaea ATCC 19718 [sequence omitted]

SEQ ID NO: 22204 - protein, 324 aa, Nitrosomonas europaea ATCC 19718
MKLTENMSFPVRLKQSCLAGVTALFFLLQIPFAHADADKDADFLKAALTGDTSGVENMLNEGIQTDLQSPEGFTALSVAAQTGHKEVVKLLLNRKATVDLANVQGGTPLLLASKNGHQEIVDLLLAKGANPNLQDKNGLAPLMLAAAKGNTGIVRSLLEHQAQPDLQNNAKATALHMAATNDYADIIDMLLAKGASVDLQDANGASALILASLSGHLSIVRKLLAHGAQPDLKATNDFTALILSAQNGQNPVIEVLLEKGVHIDFQNKDGMTALMSAVLNENIDTVKLLLEKGADTKLKNTSGKTALDIAKLPAIIELLKAAKS

SEQ ID NO: 22205 - protein, 409 aa, Nitrosomonas europaea ATCC 19718
MTHPKHAPMTQFPIRNHCLVIGDLPLTRLAQRIGTTPFYAYDRKLISARIQFLRQHLPAGIHLHYAMKANPMPAVVQHLAGLVDGMDVASVGEMKVALDAGITPENISFAGPGKSRQELICAIAAGIVINVESEYELETIAQLAEETGFQPKVAVRVNPDFELKSSGMKMGGGSKQFGIDAECVPAVLQRIAQLRFDFEGLHIFSGSQNLRVEALREAHEKTLQLGLQLASTSPVPVRAINIGGGFGVPYFPGESPLDLNAVGTNLQRLLAEIPSQFSAIRFVIELGRYIVAEAGIYVCRVLEKKISRGQTFLVTNGGLHHHLAASGNFGQVIRKNYPVAIGNKMKIDETEIVSVVGPLCTPLDLLADRMELSRAEPGDLVVVFQSGAYGLTASPTAFLSHPASLEVLI

SEQ ID NO: 22206 - protein, 614 aa, Nitrosomonas europaea ATCC 19718
MYPLLDRIEIPAQLRTLKRNQLPQLADELRNFLVESVAGTGGHLSSNLGTVELTIALHYVFDTPFDRLIWDVGHQTYAHKILTGRRTGMARLRMQGGIAGFPRRDESEYDAFGTAHSSTSISAALGMAVAARLKGVKQHAIAVIGDGAMSAGMAFEALNNAGVMDANLLVILNDNDMSISPPVGALNNYLAKLMSGRFYATARRAGEKMLGVVPPVLELAKRAEEHVKGMVTPSTLFEEFGFNYIGPIDGHDLDILLTTLNNIKQLDGPQFLHVVTRKGKGYKQAEEDPILYHGVGKFQPDQGIVSKPSAKLAYTQIFGDWLCDMAAKDSRLIGITPAMREGSGLVRFSKEYPDRYFDVGIAEQHAVTFAAGAACEGLKPVVAIYSTFLQRAYDQLIHDVAIQNLPVVFAIDRAGLVGADGPTHAGSFDLSYLRCIPNITVMTPADENECRQMLYTAFQLDTPAAVRYPRGSGPGVQIQQEMQTIPLGKGEIRRQGKQIALLAFGSMLTPCLEAGDELDATVVNMRFVKPLDQELVATLAAEHELLVTIEENTIMGGAGSAVMESLSSLDKNVRLLQLGLPDSFIDQGDPAHMLSDCGLDKAGIIQSIKERFSL

SEQ ID NO: 22207 - protein, 246 aa, Nitrosomonas europaea ATCC 19718
MKDKVILVTGGARRVGAAICRWLHRKGARLVVHYRDSSADAQRLKQELEQGHPDSVALLQADLLDTGGIPALVDQAARQFGRLDALVNNASSFFPTPVGDCTEQAWHDLVGSNLKAPLFLSQAVAPYLKKNRGCIVNIIDIHTEQPLKRYVIYNAAKGGLAALTRSLAMELAPEVRVNGISPGPILWPETGEWQDETARRHIIDRTLLKRMGEPDDIARTVSFLIEDAPFITGQIIAVDGGRSINL

SEQ ID NO: 22208 - protein, 713 aa, Nitrosomonas europaea ATCC 19718
MMTDQKLYILMMSVHGLVRGHDMELGRDADTGGQITYVVELARALGRNSHIAQIDLLTRQIEDPNISPDYAAEIEELGPNARIVRLPCGPRKYLRKELLWPHLDQMVDRCLHYLRQQGRLPDLIHTHYADAGYVGQHLSNLLGIPQIHTGHSLGRPKRARLLASGRKEQAIERQFNLSRRIAAEEEVLVHASLIITSTSQEIEDQYGMYKNTDPRRCQVIPPGTDTSRFSPPGRKPLDPAIQAGIDRFLNTPEKPVILTICRPDTRKNLHGLIQAYGSDPSLQDMANLVIIAGSREDIRAMEESQRKIMNDVLLDIDRYDLWGKIAIPKHFMVEDVPEVYRLAVRRRGIFVNSALTEPFGLTLIEAAASGLPIIAPEDGGPRDIITNCRNGLLVNTLNPSDIASALKDALSDRKRWRNWSRNGIASVRRHYTWDAHVSKYLREADKLLYRERKRLRRQLAATLHAGRSPMPLARKVIISDIDNTLLGDEQGLAEFLQWLRMHAGNISFGIATGRTVESAVRILKKWRVPMPDILITSVGSEINYWPSLRPDKGWSNHIRHRWRREALAEALKEIPGLALQAPENQREFKLSYLVTPERMPPLKQLYQHLHKQNLHAKLIYSHEAFLDVLPVRASKGLAVRYLAYKWGLPLQSFLIAGDSGNDEEMLVGDTLGVVVGNHSPELESLRDREQIYFAKNTYALGILEGMKHYHFDQ

SEQ ID NO: 22209 - protein, 794 aa, Nitrosomonas europaea ATCC 19718
MTTIDTLATCTQQNRDAVYTLLRRYFTANRTLLLQSDLREGLLQTEQDCGQSDMLRAFVFRLQEGIFSSPWAYLALRPEIAKWEFMRIHQEHLIPEKLTISEFLKFKETVVKGEATESVLEVDFGPFNRGFPRLKESRSIGQGVIFLNRKLSSEMFSRIEAGHTSLLHFLGVHAIEGQQLMFSNNSHDIHAVRNQLRQALEMLETLDGTTPWIELAPKMNQLGFAPGWGHNANRVAETMNMLMDILEAPSPSALEEFLACIPMISRLLILSPHGYFGQDNVLGLPDTGGQVVYILDQVRALEKEMHDRLQLQGVQVEPKILIVTRLIPDAGDTTCNQRLEKVSGCTNTWILRVPFRKHNGEIIPHWISRFEIWPHLEIFAGDVEREALAELGGHPDLIIGNYSDGNLVATLLSRRLGVTQCNIAHALEKTKYLHSDIYWQENEDKYHFSCQYTADLLAMNSADFIVTSTYQEIAGTREAEGQYESYQAFSMPDLYRVIHGIDLFDPKFNIVSPGANADIYFPYSDPNRRLHSLIPEIESLIFDDATNLPARGYLQDPDKPLIFTMARLDRIKNITGLVELYAASPRLRSLANLVIVGGKIDPQHSSDHEEQEQIHRMHQLMDEHELDQQVRWLGMRLDKNLAGELYRYIADKRGIFVQPALFEAFGLTIIEAMASGLPTFATRYGGPLEIIQNNRSGFHIDPNQGAATADLIADFFEKNLENPQEWERISQGALDRVASRYTWKLYAERMMTLSRIYGFWKFVSGLEREETDRYLNMFYHLQFRPLANRLAHEI

SEQ ID NO: 22210 - protein, 409 aa, Nitrosomonas europaea ATCC 19718
MILVDALAGKRLLLGITGGIAAYKAAELVRLLMQEGVEVQVVMTESACRFVGTATLQGLTGRQVFTELWDTGMLNGMAHINLSREVDALLIAPASADFIAKIAHGLADDLLSALCLARDCPLLIAPAMNVQMWENAATRRNLATLRQDGVTVLGPGSGYQACGEIGEGRMLEPEDLLDKVRCFFQPKYLSGKRVLVTAGPTFEALDAVRGLTNLSSGKTGIAIAQAALEAGAQVTLVCGPVCPPFPAVDKLTHIVSASEMFSAVKAEVEGHDIFISVAAVADYRPAECHPSKLKKTVADITLTLVPNPDILQYVANLPNPPFCVGFAAETEAIEQYAAEKRKRKKLPLIVANNAVETIGSNESSLILLDDEGTHYLPKANKNIQARLVMAHIAHLYDKRKGYTHHNETS

SEQ ID NO: 22211 - protein, 288 aa, Nitrosomonas europaea ATCC 19718
MNTSMNTVRIIPAMAVPEGAGVIVHRTIGTPVLRNYDPFLLLDHIGSDNPDDYIAGFPPHPHRGFITFTYMLDGHMQHQDSMGNTGDLGPGSAQWMKAASGVIHSEMPKQENGLLRGFQLWINLPAINKMDHPEYQEFPAAAFPVVETADYRLKVLIGRFGDTVAPIRDDLTQVTYFDVQLQPGRHFQHRLPAQNTSFIYLFEGNGQFNGQDIGLHSLIAAGTDGGTFDFVAGKKGARFIVVSGKPLHESVVQHGPFVMNTREQIDQALKDFQSSQFVRDRAWVKRNQ

SEQ ID NO: 22212 - protein, 1237 aa, Nitrosomonas europaea ATCC 19718
MTMHERADLLKRLLAERILMLDGAMGTMIQSYKLTESDYRGERFADFPHDLKGNNDLLCLTRPEVIRSIHRAYLEAGSDIIETNTFNSNAPSMADYHMQDLVYELNVAGARLACEEARAMETQQPDRPRFVAGVIGPTTKTASLSPDVNDPGFRAITFDDLVESYTESVRGLIDGGADILLVETIFDTLNAKAALFAIDQYFETHGLRLPVMISVTITDASGRNLSGQTPEAFWNSVRHARPLSVGINCALGAELMRPYVEELSNVAEVFTSAHPNAGLPNPLAETGYDETPEYTARLIKDFAQSGFVNIVGGCCGTTPKHIAAIAEAVRDIPPRPLPDIPKKLRLSGLEPLNIDEHSLFVNVGERTNVTGSKAFARLILNGGYAEGLVIARSQVENGAQIIDINMDEAMLDSQKAMVTFLNLLAAEPDISRLPIMLDSSKWSVIEAGLKCVQGKAVINSISLKEGEAEFLHHARLARRYGAAVIVMAFDETGQADTLQRKVEICTRCYHTLIEQADFPPEDIIFDPNIFAIATGIEEHSNYAVDFIEATHVIRQTLPYAKVSGGVSNVSFSFRGNEPIREAIHTAFLYHAVKAGMTMGIVNAGQLGVYSDIPPDLLEHVEDVLLNRRPDATERLVEFAEHFKGQKKEQIEDLSWRDEPVRQRLIHALVRGISTYIVEDTELVRQEIDSQGGKPIEVIEGPLMDGMNVVGDLFGAGKMFLPQVVKSARVMKQAVAYLLPYIEAEKKISGDSKPKGKVVIATVKGDVHDIGKNIVSVVLQCNNFEVINMGVMVPSAQILETARREQVDMIGLSGLITPSLEEMAHVAREMEREQFTVPLLIGGATTSRMHTAVKIAPHYGGVTVWVPDASRAVGVCSNLMSQDLRDDYVRQVKAEQEKSRVQHRNKKGPSKLLTFEEARANALKTDWARYTPPAPDFLGLRTLNNYPLETLVPHIDWTPFFQAWELHGRYPAILQDELVGEAASNLFRDAQNMLRKIVEQKWLTANAVIGLFPANTVNGDDIEIYADRSRSQVIMTWHTLRQQTAKPAGRPNLALADFIAPRETGLDDTIGLFAVSAGFGIDERIRAFEAANDDYSAIILKALADRLAEAFAEHMHARVRREFWGYVKDESLDNEQLIDEQYLGIRPAPGYPACPDHTEKGPLFALLEAEKRSGIVITESFAMVPTAAVSGFYLSYPESSYFAVGKIGKDQVEDYARRKGWTLEEAERWLAPVLAYER

SEQ ID NO: 22213 - protein, 247 aa, Nitrosomonas europaea ATCC 19718
MLLEHKIALVTGASRGIGKAIALELGKHGATVIGTATSETGAGHISQYLSEARISGMGLIMDVSNIEHIKSGIETIQQSLGDVAILINNAGITRDNLLARMKDDEWDNVIQTDLKSVFCLSRAVLRTMMKARSGRIINISSVVGATGNPGQTNYAAAKAGMIGFSKSLAKEIGSRNITVNCVAPGFIDTDMTRSLSPDQQQSLIQHIPLGRFGRPEDVAAAVVFLASPAADYITGATLHVNGGMYME

SEQ ID NO: 22214 - protein, 308 aa, Nitrosomonas europaea ATCC 19718
MTDISVAGDLLLKSTHLQINEVVAELRNVRTTALLDRQGHLKPPRLPSRKILAGVIEGLRTALFPNRLGPSDLAVEGVDHYVGHILNSTLRALLVQIQHELHFNSGTEELDQETYAQAAEITQAFAKRLPAVRRLLDGDVLAAYEGDPAARGIDEVLVCYPGVAAITWHRLAHELYQLNMPLIARMISEIAHSQTGIEIHPGAQIGERFFIDHGTGVVIGETSIIGRNVRLYQAVTLGAKHFPVDENGTLVKGIARHPIVEDDVVIYAGATILGRITIGHGSTIGGNVWLTRSVPPGSLITQAQTHND

SEQ ID NO: 22215 - protein, 413 aa, Nitrosomonas europaea ATCC 19718
MTKTRHLTILGSTGSIGESTLDVVARHPGRYQVVALTADRNVEKMFEQCIQFHPPYAVMLDAQSAEQLEDRLHAAGLDTRVLSGIESLEKVASLPEIDTVMAAIVGAAGIRPTLAAARTGKHILLANKETLVMAGRVFMDTLRQHHATLLPIDSEHNAIFQSLPQHFNGDLAGSGVRRILLTASGGPFRTVDLKILETVTPEQACAHPNWVMGRKISVDSATMMNKGLEVIEAHWLFNAVPEKIQVVIHPQSVIHSMVEYIDGSVLAQLGNPDMRTPIAHALSYPERMESGVQSLDMFKVARLDFESPDFKRFPCLRLAYEALAAGGNMPAVLNAANEVAVEVFLAGRIPFTAIPVMIEDVMKSTERRDVPDLEGVLLADLQARATAREWLACNIRQSTGQPGKPASSLSAGQ

SEQ ID NO: 22216 - protein, 417 aa, Nitrosomonas europaea ATCC 19718
MSSFSSFEYRDSQLFVESVPLAEIAAKFGTPCYVYSSAAIRTTYQIFDHAFGQRDHLICYAVKANSNLAILNLLARLGSGFDIVSGGELQRVLKAGGDPQKTVFSGVGKTPEEIRAALAANILCFNVESEMELMVLNEIAGQMGKIAPVSLRVNPDVDANTHPYISTGMKENKFGIPAAEAGRIYSLAHQLPHIQVSGLDCHIGSQLTEIAPFIEAADKMLDLLARLQTMGVTIKHLDLGGGLGIRYDRESPPSIEAYIKALCTIAENHPQQLLIEPGRSMVGNAGLLLTRVHYLKHTSHRNFAIVDAAMNDMLRPALYQAYHSILPVTKRTGETKTYQIVGPVCETGDFLGHDRNLALTKNDLLAVMSAGAYGMSMSSNYNTRPRAAEVMVDGSTVHLIRARETVEDLYALEKLPI

SEQ ID NO: 22217 - protein, 443 aa, Nitrosomonas europaea ATCC 19718
MQTYTPYSEAMVFSMLEHAHAAHLAWRQVPLHERTALLLKLADVLRENSESYARLMTEETGKTIRAARAEIEKCAWACEIYADKAAAWLAEEEIAADGIKHRVVIEPLGVILAVMPWNFPFWQVMRFLIPALLAGNGALLKHATNVTGSALKIQEAVNEAGFPKGLFVTLLVSHTVVEQVIAHPLCQGVSLTGSAEAGRAVASVAGRHLKKVVLELGGSDPFIVLGDADIPAAAKAAVIGRFQNNGQSCIAAKRLIVLKEIEEVFTSTLLAEVEKLVVGDPLDEATDIGPLVSEQAAETMEQFVLDAVAKGAMVRTGGTRKGAYFTPTVLTGVHSAMEVMTQEVFGPVLPVITADTVEEAITLANATRFGLGASVWSRDLEKGEQVARQLAAGATFVNSITKSDPRMPFGGIRESGLGRELSYWGVREFANIKTVNVYGGEEV

SEQ ID NO: 22218 - protein, 288 aa, Nitrosomonas europaea ATCC 19718
MKKILGIYDAPPLHWVGDGFPVRSLFSYSNHGKLLSPFLLLDYAGPVDFAPAERPRGVGQHPHRGFETVTIVYHGEVAHRDSTGQGGVIGPGDVQWMTAGAGILHEEFHSESFTRSGGQLEMVQLWVNLPAKDKMIAPHYQAILSADIPVVALPDDAGSIRVIAGCYQDHTGPARTYTPMNVWDVRLKRGKVTELPLPEGWNTALAVLHGKISVNGSPLVQAAQLVSLDRAGDTVSLDVREDATVLLLSGEPIDEPVVGYGPFVMNSQTEIDQAIADFNSGHFGQLSR

SEQ ID NO: 22219 - protein, 791 aa, Nitrosomonas europaea ATCC 19718
MTDHPDYILWLNQVGMNDIASVGGKNASLGEMIGNLARAGVKVPGGFATTTRAYREFLEIDGLGDRISQKLSGLDVGDVTALADTGKSIRSWLLAAPLPDNLLKAVAGAYQKLVSDMGEEVSFAVRSSATAEDLADASFAGQQETLLNVHGLENLISAIREVFASLYNDRAIAYRVHHGFHHDQVFLSAGVQKMVRSDRGASGVMFTLDTESGFREVVFVTSTYGLGETVVQGIVNPDEFIVYKPNLEARLPAILSRRSGTKAIEMIYSDGQTGQATEIRPVPPDRSQRFSLSDEQIESLARQAVIIERHYNRPMDIEWALDGIDGQIYIVQARPETVKSRAEQSIEQFRLDERGQVLVQGRAIGQKIGQGRARVILNAGQMSEVQPGDVLVTDMTDPDWEPIMKRAAAIVTNRGGRTCHAAIIARELGIPAVVGCEQATAKISNGHAVTVSCAEGDTGFVYEGLLPFQRMSSEIGTLSELPVRMMLNIGNPAQAFAFSRLPNQGVGLARLEFIINNAIGIHPRALLEFDTLPDDLQASIRKRMAGYPDPVSFYVEKLVEGIATLAAAFHPHPVIVRLSDFKSNEYANLIAGDRFEPHEENPMIGFRGASRYLADSFRACFELECRALRKVRDDMGFANVEVMVPFCRTLEEAQQITELLAANGLKRGSNGLRLIMMCEIPSNAVLAEEFLEYFDGFSIGSNDMTQLTLGLDRDSGLVAHLFDERNPAVKRLLKMAIDACHRQGKYIGICGQAPSDYPDFARWLVEQRISSLSLNQDTVVDTWLYLAGEKQ

SEQ ID NO: 22220 - protein, 505 aa, Nitrosomonas europaea ATCC 19718
MPVDEKKGPFSAINNRSAGEAEAGGEIIHETGQLRRSMSVWNCFTLGFSVVSPVVGLYAIFGVQNLVTGGGWIAALILSLFMQLMVATVYAELSSQFPIAGGAYKWSRHLIGPRTGQYAGAIYVSSTIAMLTTTAYTGGMWLSAVIVGGDIQGASAVLWGVVFLLICTTVNIVNQKVYKVINLLGVSAEVLGSICVALVLFFFFRIYPVSELFQHLGTGLAPTSLTAFLAALAIAGWAFIGFDSCSTIAEEAHNPERMIPRAIFLSLLAVGSVVLFNSSALTLSISHDTLVEASATSDPISPIITSTIGAWAAKPFLVIVMTAFLSCGSSVVNYVSRIVFSMAREGNLPAFFSQVTRKTQLPRNAIGGTVLMAGLGLLFGLNDGAVATIIAFGTGGLYAMFSMTTGVGLYARLMGRWNPALGAFRLGRWGLVINTVAFVWALFELINIGWPREYVAAPGAPWWQLWAVPLVLGTILALTTLHVQMGHKRRMKRALSGTVTDDLQK

SEQ ID NO: 22221 - protein, 354 aa, Bacillus anthracis str. Ames
MVMKEQVVEALEGIVDPFLHKTLKETGAIKEVTVKPEKKHVSVKIAIVKTGTAEQMQLQSGIVKLVKELGAATVGLRFAEFTEEELAQFAPEQEEQTESLLSPNSKTTFLAVASGKGGVGKSTVSVNLAIALARLGKKVGIIDADIYGFSVPDMMGIEKRPVVRGDKIIPVERLGVKVISMGFFVEDNAPVIWRGPMLGKMLNHFFTEVEWGDLDYLVLDLPPGTGDVALDLHSMLPACKEIIVTTPHPTAAFVAARAGAMALRTEHSILGVVENMAYFESKTTGEKEYVFGRGGGDKLATELQTEVLGRIPLQQPDWNKEDFAPSVYEDTHTTGLIYRTIAETVIDKTAFAQK

SEQ ID NO: 22222 - protein, 461 aa, Bacillus anthracis str. Ames
MESAIQLEKEQQRKKKHPPGLYLLFFTEMWERFSYYGLRGLLTLYLTTALVSGGLGFSPAWALSIYGFYTGACYFTPMIGGYLTDRFLGRRKAITIGGITMAIGNLTLFAMQNQVGLYLGLALIIIGNGFFKPNISTLVGELYEENDPKRDSAFTIFYMGINVGSFLAPLVCGFLSENLFKTTVDGVVHYGFRYGFLAASIGMIIGQILFTTLSNRFLGDIGKKPTRDLQTTDGQPSVGDTPLTKKEKQRTAVIVILTCFVVFFWAGFEQAGSSLTLYTNKFVDRSVFGWEVPTSWFQSVNPLFIILLAPVISALWAKLATRKRGDLKIPTKMGLGMILLGIGYIILVIATLKTGSDEHNITEKANLLFIVFTYLFHTLGELFLSPVGLSMVSALAPVKLASLLMGVWLASSGIANILGGQLASFTTSLGYAEVFTVIGAVAIVLGCVLLLISKKLVKWMD

SEQ ID NO: 22223 - protein, 303 aa, Bacillus anthracis str. Ames
MPYFYVFLLLLTSLLWGGNFVVGKSLVDHASPMTLTSLRWIIAIVCLLPMVWFKEKKIIPPRAAILPLILMGISGVALFNIFQFLALEKTSATNVGLISTLNAISIALFSVLFLKEKVNTLQILSMILSFFGVILVLLKGNFALLFSLHFNSGDLWMIAAVCIWGIYSVCSKWATKTTTPLMATLYSGIFGVILLLPFNIGSFTVTNINTSFITSLLYTGLISTVLCMVFWNIGVQKLGATTSGIFLNFNPIFTAILAFLFLGEELTWIQIVGTMIVMTGCYLFSHFKTVTVQPTGTLLRKHS

SEQ ID NO: 22224 - protein, 438 aa, Bacillus anthracis str. Ames
MYLHGTSRINGQGHLEIGGCDTTQLAKQYGTPLYVYDEESIRGKCRAFHRAFKESGFSYQVAYASKAFLCMEMCRVAREENMSLDVVSGGELYTALQAGFPASRIHFHGNNKTEEEIVMALQANIGCFVVDNFLELEILHDLAVQHGKFVNILIRVTPGVEAHTHEYITTGQDDSKFGFGVSNGQAMQAIELALQKSNYNVLGIHSHIGSQIFETAGFVRAIEVLHQFLEEVRERTNYVVKVLNVGGGFGIRYTESDTPLTLETYVRAVTSAVREQFTVCNYPLPEIWVEPGRSIVGDAGTTLYTVGSVKDIPGIRKYVSVDGGMTDNLRPALYNARYEAMLANRGNDENEETVSIAGKCCESGDMLIWDITLPKVASADLLAISCTGAYGYSMANNYNRIRRPAVVFVKGGTSQIVVERETYENIIGNDRIRIKELV

SEQ ID NO: 22225 - protein, 591 aa, Bacillus anthracis str. Ames
MLWRSVVGKLWMTILLLVSFVLGFVAILLSQFFRTYYVDMSEARLQKVATSVSELIEEGADVKTIENIAYKFSDPLSRIIIVEEGKEISSSPKQEGLVTLTIDDLKEDKELAAVFTDKKEIKNKVRKASNSRKNKNTENDIMIVGKPVQSKNESAVFVYESLQVPIQGMERTTDFIFLSAGIAIILTTFFAFFLSTRITAPLRKMREVAFEVSRGKFDAKAPMVSQDEIGELATALNQMGKQLKFNMNALQQEKEQLASILSSMADGVITLNQEGEVVVINPPAEHFLQVWQEEKEIELSKKLPSELVELFHLVVESEQQQVVGINLQKGNYVVLMTPLYNQTKIRGAVAVLRDMTEERRLEKMRQDFIANVSHELRTPMVMLQGYSEAILDDIVQTKEEINEFVQIIYDESVRLGKLVNELLDLARMESGNVELHIGEVDIHPFVEKIGRKFQGIAKDKEVALTVDFKDSIEQYPFDADRMEQVLTNLIDNAIRHTNAGGHVTLVIDTKNNGLIFEVQDSGAGIPEEDIPFLFDRFYKADKARTRGKKGGTGLGLAIAKNIVQGHGGKISVSSVVGEGTTFSVYLPNRII

SEQ ID NO: 22226 - protein, 303 aa, Bacillus anthracis str. Ames
MSVKKDWIAPLALLFVSFIWGATFVVVQNAMSFVGPFTFNGIRFLFAGIILLFVQILFSKKASKQHIKQSSLAGLIVGFFLCIGYVLQTFGLLYTTSSKAGFLTGLSIVMVPILSFIFLKQKATIFIVIGIAVATAGLYLLTAGDSFQLNIGDILVLGCAVAFAAHILVNGFFSKKISPLLLSTSQVLAVGLFSSICAFLFEDWEKLFSVALWTNSSFLFALFLTSLFATSIAFFIQTSAQKHTSPTRVAIIFAMEPVFAALTGVLVANEQLSISAIIGCLCIFLGMVFVELPSKTKKEAQAA

SEQ ID NO: 22227 - protein, 389 aa, Bacillus anthracis str. Ames
MKSPNFQLSLQTSNLIIGFMVWVILSSLMPYIKVDIPLTAGQISMVTAVPVILGSVLRIPIGYWTNRFGARKLFFISFILLLFPVFYISVANSMMDLIIGGLFVGIGGAVFSVGVTSLPKYFPKESHGFVNGIYGVGNAGTAITSFLAPVIATSVGWRTTVQCYLVLLAAFALMNFLLGDRKEKKVNTPLMEQIKGVYKNEKLWFLCIFYFLTFGSFVAFTVYLPNFLVSHFGLEKVDAGMRTAGFIVLATIMRPIGGWLGDKFNPFKILIFVFIGLTLSGIILSFMPSMNVYTFGCLLVAFCAGIGNGTIFKLVPMYFSEQAGIVNGLVSALGGLGGFFPPLILTLLFQLTGHYAIGFMALSEVALACLIITVWMYSQEKLLVMLKNH

SEQ ID NO: 22228 - protein, 304 aa, Bacillus anthracis str. Ames
MNYKKWDLRIICAHAFTILIWGSAFPAIRMGLESYTPEHLTLLRLLIASVILLLFSFIYKLRLPDLKDIPAIFIFGALGFTFYHIALNYGEKTVNAGSASLIVSVTPIVTAIFASVFMNEKMKLNGWIGGVISFIGIAFISFSQGDAIQLNSGALFILLAAISESLFFVFQSSYLKKYGFLPFTIYTILSSTVCMLIFLPGMYQEILAAPLEVNLSVIYLGVFPTVLPYIALAYIISRAGASEATSSLYLTPITACFVAWIWLGEVPTLVSIIGGGITILGIVIVHIPVLRKEKHSNLANNQSV

SEQ ID NO: 22229 - protein, 305 aa, Bacillus anthracis str. Ames
MVIFNYILVCIIFGTTFLTIKIGIEAGAPPLFSAGIRFFLAGVILMIIFKLKRKEIMPHIFSRRIIYAGFCLTFMTFATLYWAEQYISSGLAAVLSATGPMMILLLQTKRNKTKLKKEQLLALIIALIGVVFVSLPGMHQEISFIWSIACFVLIIGELFYGIGSIRSKEILSDLQSVSLFLINGIQMFYGGVLLLIVSFIVEQPNVTVLASWSVQWPILYLIFIGSIGGHGLYYWLLSKTNPVFPSTWLYVSPLIAIIVGYIILGEPLNPIMGIGACFILVGVFLANRSTLRTYFKQGRLFEKEM

SEQ ID NO: 22230 - protein, 257 aa, Bacillus anthracis str. Ames
MEKMKNLDGKVALVTGASRGIGRAIAMRLANDGALVAIHYGRNKQAADETIREIESNEGKAFLIEADLNSIDGVKKLVEQLKNELQIRVGTSEIDILVNNAGIGTQGTIENTTEEIFDEIMAVNIKAPFFLIQQTLPLLRAEGRVINISSAEVRLGFTGSIAYGLSKGALNTMTLPLAKHLGERGITVNTIMPGYTKTDINAKLLDDPEIRNFAANSSVFGRIGQVEDIADAVAFLAASDSRWVTGQIIDVSGGFCL

SEQ ID NO: 22231 - protein, 286 aa, Bacillus anthracis str. Ames
MSISNEVLKSLNFERLPQVKNPKYVVFCDFDETYYPHSMDDSKRSNMKLLEKYLYEQGSKGDLVIGWVTGSSLESIVEKMKKGGIQYFPHFVASGLGTEITYFDSNGTTIDDQIWKERIIEGGFDSSKIERIIHLLEMKYEIFLRPQTQLGSSKYKFNFYYEEQNEFIDAKNLEKIEEIGEIFQVGVNINKCNPLAGDPENCYDVDFIPLGTGKDEIVKFILDKYELDKSNAIAFGDSGNDLRMLQAVRHGYLVENATEEAKKIHSMLAQGEYSIGILNTLKHIIN

SEQ ID NO: 22232 - protein, 469 aa, Bacillus anthracis str. Ames
MKSSIDSIQESKRLKNQQKEEKATWKAMSMFLVPLLLSNILQSVGQLFGMVVVGRWLGVNELAAISAFFPLFFLLVSFVIGIGSGSSILIGQAFGAHNEERLKAIVGTTLTFTFIIGVILAIVGNVFALNIMRLMGTPENIIDMSVHYARILFISMPVLFLYFSYTTFIRGTGDSKTPFYFLIVSTVLNIMLLPILIFGWVGIPKIGVYGAAYASVISTIITFIVMIIYLKKKNHPLQLDETVRKYLRMDWGLLKLLLRLGIPASINMILVSLSEIAVIAFVNRFGSDATAAYVVVNQVASYVQMPAVSLGITVSIFAAQSIGAKQFNRLQEVIRAGIVMNYIIGGILIAFIYLFSREILSLFLTSSNTIEIAHSLVMITLWSYLIFGHAQIIGATMRASGTVLWPTIIGVVSIWLVEVPVAYYLSYHTNLGIKGIWIGYPAAFIVSLLLQYGYYKLSWKKKRISRLVS

SEQ ID NO: 22233 - protein, 191 aa, Bacillus anthracis str. Ames
MNVLIVYAHPSPSSFNAAILKHVQKGLQETNHSVTVLDLYKEQFNPVLVFNEEKKRRDLVNEEETARYRALVEEADTLLFIYPIWWWGMPAILKGFIDRIFVAGFAYKYEGALPKGLLKGKKAWGINTLDSPLWYVALLYRSADWIIMKRGVLRFCGIRDIKRSVFQSVKTSKREKREKWLLQIEEKARTL

SEQ ID NO: 22234 - protein, 385 aa, Bacillus anthracis str. Ames
MVKYISILGSTGSIGTSALDVVSAHPEHFKIVGLTANYNIELLEQQIKTFQPRIVSVATKELADTLRTRISTNTKITYGTDGLIAVATHPNSNLVLSSVVGVSGLLPTIEALKAKKDIAIANKETLVAAGHIVTELAKQNGCRLIPVDSEHSAIFQCLNGENNKEIDKLIVTASGGAFRDKTREEMKTLQAKDALKHPNWLMGAKLTIDSATLMNKGFEVMEARWLFDIPYEKINVMIHKESIIHSLVEFIDGSVIAQLGAPDMRMPIQYAFHYPTRLPSSYEKLNLLEIGSLHFEKPDLEKFPCLQYAYECGKIGGITPAVLNAANEIANALFLKNEIAFFDIEKTIYKTVEAHHNVKDPSLDAILEADQWARQYANQLLIKKS

SEQ ID NO: 22235 - protein, 246 aa, Bacillus anthracis str. Ames
MEFLNGKTAVVTGAAQGIGKEIARVYAKLGAKVLISDVNEEKLQKTTRELLDEGYEVSLYRCDVSNQNEAKSLIEYAVQKFGTLHILVNNAGITRDAMLHKMEKSSWEQVLQVNLTGVFYCMQPALLYMRQQGYGRIINISSISREGNIGQANYAATKAGVVGLTKTAAKEVGSFGITCNAICPGFMDTDTTKTIPDKVKEKMVGAIPVGRIGTPEDIANAAAFLASEYASYITGEVLNVSGGLQV

SEQ ID NO: 22236 - protein, 259 aa, Bacillus anthracis str. Ames
MTRNKVEICGVDTAKLPVLKNDEMRKLFREMQSGEISAREKLVNGNLRLVLSVIQRFNNRGEYVDDLFQVGCIGLMKSIDNFDLGQNVKFSTYAVPMIIGEIRRYLRDNNPIRVSRSLRDIAYKALQVREKLIAENSKEPTAMDIAKVLEVTHEEIVFALDAIQDPVSLFEPIYNDGGDPIFVMDQLSDEKQKDEQWVEELALKEGMKRLNDREKMIIRKRFFQGKTQMEVAEEIGISQAQVSRLEKSAIKQMNKTIQG

SEQ ID NO: 22237 - protein, 630 aa, Bacillus anthracis str. Ames
MDLTQIQNPSFLKDMSISELEGLSEDIRKFLIEELSQTGGHIAPNLGVVELTIALHKLFDSPKDKFLWDVGHQSYVHKILTGRAKEFGTLRQYQGLCGFPKRCESEHDVWETGHSSTSLSAAMGMALARDLKKTKEYVIPIIGDGALTGGMALEALNHIGHEKTDMIVILNDNEMSIAPNVGALHNVLGRLRTAGKYHWVKDELEYILKKIPAVGGKVAATAEKIKDSLKYLLVSGVFFEELGFTYLGPVDGHDYEKLFETLQYAKKTKGPVLVHVITKKGKGYKPAESDVIGTWHGTGPYKIESGDFVKPKEVAPAWSAVVSETVLKLARTDERIVAITPAMPVGSKLEKFQKEFPDRMIDVGIAEQHATTMAAGMATQGMKPFLAIYSTFLQRAYDQVVHDICRQNLNVFIGIDRSGLVGADGETHQGVFDISFLRHLPNMVIMMPKDENEGQHLVYTAMQYEDGPIALRYARGNGLGVHMDEELKAIPIGSWETLKEGTQAAILTFGTTIPMAMEAAERLEKAGVSVKVVNARFIKPMDEAYLHDLLGKNIPILTIEEACLIGGFGTGVVEFASENGYHSALVERMGIPDRFIEHGSVTKLLEEIGLTTDAVVDRIHTMIPSKQKRA

SEQ ID NO: 22238 - protein, 299 aa, Bacillus anthracis str. Ames
MTRTYILLFICVVVWGSNFIFGAILVNTFHPVLLTTLRLLFINLFFLAYAIMCKKDLYIEKSEMKSVLLIGIIGVAINQWSFYEGLQTADPTTAALILALTPVMTSILAVFILNEPLTAKLVIGGGIATFGVFFVIGVGQRFVFSEGLIWIFITMLSFSLSIVLIRKLGNRDDMFFITFFSSIFGFLIMLPFLAFTFSHITLKYSIESWSLLIVTAILMHGICTLVWNNQLRKAQASTAAMFLNLEPFVTMVVGYIILQKSVTAIQIIGAVFIVCGVYTATFGYGKKSKGQKELFRKAT

SEQ ID NO: 22239 - protein, 301 aa, Bacillus anthracis str. Ames
MRRWGIELLILAVVIIWGINFTIAKYGLLEFTAIEFTALRMISAAPLMLLLTFFIEKSVYMERKDIPRLIIVSVVGIVLYQTLFMETVKYTSATNASLLISISPIFTTVFAIFLKQEKFSSRKLIGSIIAFGGAALVLVAGHSLASSFYGNGIGLITSICWGLYPVLAGPLIKKYSALRVTAWSALVGAIPLLLLSGPHVFTMPFHITHGMTLFALLYSIFFVTVFGLVMWYVGVQKIGASHTMVYMYITPRVAVLFAAVWADEYVSFQQIIGGIIIFFGLWFVKSEKVNIHSTAGEPISK

SEQ ID NO: 22240 - protein, 279 aa, Bacillus anthracis str. Ames
MKNLQSKAVLNNGVEMPWFGLGVFKVEEGPELVEAVKSAIKAGYRSIDTAAIYGNEKAVGEGIRAGIEATGISREDLFITSKVWNADQGYEETIAAYEESLKKLELDYLDLYLVHWPVEGKYKDTWRALETLYKEKRVRAIGVSNFQVHHLQDVMKDAEIKPMINQVEYHPRLTQKEVQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 22241 - protein, 321 aa, Bacillus anthracis str. Ames
MERSLSMELVRVTEAAALSSARWMGRGKKDEADGAATSAMRDVFDTIPMKGTVVIGEGEMDEAPMLYIGEKLGTGYGPRVDVAVDPLEGTNIVAAGGWNALAVIAIADHGNLLHAPDMYMDKIAVGPEAVGAVDIDAPIIDNLRAVAKAKNKDIEDVVATVLNRPRHQAIIEEIRKAGARIKLINDGDVAGAINTAFDRTGVDILFGSGGAPEGVLAAVALKCLGGEIHGKLLPQNEAELARCKKMGIEDINRILRMEDLVKGDDAIFAATGVTDGELLRGVQFKGSVGTTQSLVMRAKSGTVRFVDGRHSLNKKPNLVIK

SEQ ID NO: 22242 - protein, 259 aa, Listeria seeligeri
MPKVSQPDKEAKEKVYIWIAAYQENGDQDAQYNLVVHYKKLVESIARKYSQGKSFHEDLVQVGNIGLLGAIRRYDATFGKSFEAFAVPTIVGEIKRFLRDKTWSVHVPRRIKELGPKIKNAVEELTRELQSSPQISDIADFIGVTEEEVLEAMEMGKSYQALSVDHSIEADSDGSTITLLDVVGGTDDGFERVNQRMLLEKVLPVLDEREQKILQYTFIENRSQKETGELLDISQMHVSRIQRQAIKKLREALQNEEVE

SEQ ID NO: 22243 - protein, 259 aa, Listeria ivanovii
MPKVSQPDKEAREKVYIWIAAYQENGDQDAQYNLVVHYKNLVESIARKYSQGKSFHEDLVQVGNIGLLGAIRRYDATFGKSFEAFAVPTIVGEIKRFLRDKTWSVHVPRRIKELGPKIKNAVEELTRELQSSPQISDIADFIGVTEEEVLEAMEMGKSYQALSVDHSIEADSDGSTITLLDVVGGTDDGFERVNQRMLLEKVLPVLDEREQKILQYTFIENRSQKETGELLDISQMHVSRIQRQAIKKLREALQNEEVE

SEQ ID NO: 22244 - protein, 342 aa, Streptomyces hygroscopicus subsp. yingchengensis
MAQPPALPVIDISRFRAPDAADRDAFLAELRSAAHEVGFFYVTGHGVPAPLRDEVLSAARAFFALPVERRLEIENLNSPQFRGYTRTGTEYTAGSAYWREQIDIGPEREALALGPDDPDYLRLIGPNQWPSALPELRDIVLRWQAEALRVSREVLRALAAALGQDEGYFDQWFDDEAAVHVKIVHYPPRAAEDADQGVGAHKDYGYLALLQQDEVGGLQVQREDGEWIDAVPVPDAFVFNIGEMLEIATQGYLKATQHRVVSPQAGVHRYSIPFFLGPRLDAVVKPLNLPAELAALSRGVTDDPDNPLLAAFGENAVVGWLRSHPRVAERWWSDVLEKRESR

SEQ ID NO: 22245 - protein, 295 aa, Leptospirillum ferrooxidans
MSTVSEELVWKALGRVIEPDFKKDLVTLKMIENLKIDGGNLSFTIVLTTPACPLKDEMKNSCLAALASVPGITATEISFTARTTGGSFTGKTPIPGVKNVIAVSSGKGGVGKSTTSVNLAIALSQLGAKVGIMDADVYGPNIPMMLGITDTPRQVDKKLFPPSGHGITVMSMAFMVPPGTPLIWRGPMLHGIIQQFCQDINWGDLDYLVVDMPPGTGDAQLSLAQLVPLSGAIIVTTPQEVALSDSRRGLAMFQKVNVPILGIVENMSSFICPHCHGETDIFSKGGGETAAHEKA

SEQ ID NO: 22246 - protein, 99 aa, Pseudomonas putida
MKLVTAIIKPFKLDDVRESLSEIGVQGITVTEVKGFGRQKGHTELYRGAEYVVDFLPKVKIDVAIDDKDLDRVIEAITKAANTGKIGDGKIFVVNLEQA

SEQ ID NO: 22247 - protein, 188 aa, Mus musculus
GTRGVLQACMDGFRLVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 22248 - protein, 331 aa, Oryza sativa
MAPASKAERKAVLDAGAWMFNVVTSVGIIMVNKALMATHGFSFATTLTGLHFATTTLMTLVMKWLGHIQPSYLPLPELVKFVFFANLSIVGMNVSLMWNSVGFYQIAKLCIIPVLCILEILFDKVRYSRNTKLSIVLVLVGVAVCTVTDVSVNSRGLLAAVIAVWSTALQQHYVHHLQKKYSLGSFNLLGHTAPAQAASLLILGPFVDFWLTNRRVDTFNYTTIVTFFIVLSCTIAVGTNLSQFICIGRFTAVSFQVLGHMKTILVLTLGFLFFGKEGLNFHVVLGMMLAVIGMIWYGNASSKPGGKERQVYSVPSEKTQKSSQSELDQKV

SEQ ID NO: 22249 - protein, 360 aa, Hypocrea virens
MSRSNPPNNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVAARWYRAPEIMLTFKEYTKAIDVWSVGCILAEMLSGKPLFPGKDLTFPDHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDTLSKEQLKQLIYQEIMR

SEQ ID NO: 22250 - protein, 240 aa, Oryza sativa (japonica cultivar-group)
MGRGKIVIRRIDNSTSRQVTFSKRRNGIFKKAKELAILCDAEVGLMIFSSTGRLYEYSSTSMKSVIDRYGKSKDEQQAVANPNSELKFWQREAASLRQQLHNLQENHRQLMGEDLSGLNVKELQSLENQLEISLRSVRTKKDHVLIDEIHELNRKGSLVHQENMELYKKISLIRQENAELYKKIYETEGPSEVNRDSPTPYNFAVIEKTNVPVQLGLSTLPQHSDAEQSTAPKLGLQLNP

SEQ ID NO: 22251 - protein, 241 aa, Oryza sativa (japonica cultivar-group)
MGRGKIVIRRIDNSTSRQVTFSKRRNGLLKKAKELSILCDAEVGLVVFSSTGRLYEFSSTNMKTVIDRYTNAKEELLGGNATSEIKIWQREAASLRQQLHNLQESHKQLMGEELSGLGVRDLQGLENRLEISLRNIRMRKDNLLKSEIEELHVKGSLIHQENIELSRSLNVMSQQKLELYNKLQACEQRGATDANESSSTPYSFRIIQNANMPPSLELSQSQQREGECSKTAAPELGLHLP

SEQ ID NO: 22252 - protein, 416 aa, Eschscholzia californica subsp. californica
MDPDAFTVGLYKWDPRGVVAPPPQPPPSNRLFEAIMTPTPMSYTIRPREYQQQQQIITGGIEDFFQAYGIRYYTAAKIAELGFTVSTLLDMKDEELDDMMNSIYHIFRWDLLVGERYGIKAAVRAERRRLEDDESRRRHLLTSETTTNPIDALSQEGLSEEPVQQEKEAAGSGGGGAWEVVLKEKKKIMKKKKQQRRRKQIEQGVADPEEDDDDDDEEEEDNNGGGGGGIERQREHPFIVTEPGEVARGKKNGLDYLFHLYEQCRDFLIQVQNIAKERGEKCPTKVTNQVFRFAKKAGASYINKPKMRHYVHCYAFHCLDEEASNALRKGFKERGENVGAWRQACYEPLVAMAARQGWDIDGIFNAHPRLSIWYVPTKLRQLCHAQRRTTTTNTTTVTTSSSVAALGAVTGPGHVF

SEQ ID NO: 22253 - protein, 419 aa, Hordeum vulgare
MTVDRKGAQAAAAAAATSAPFEIPALQPGRTCGAEESTRSHVLVEPIGSSDLLCNEYALLAQQNPKGDALPVASILRKKRPRRSRDGPNSVSETIKRWKEVNQQLEHDPQGAKRARKPPAKGSKKGCMQGKGGPENTQCGFRGVRQRTWGKWVAEIREPNRVSRLWLGTFPTAEVAAQAYDEAARAMYGPLARTNFPVQDAQAAPAVAVPVATEGVVRGSSASCESTTTSNHSDVASSSHNKQRQIQAPEISSRSDLLESTQSVEYSQQQSVPDAVSSIAMSTSEEDVYEPLEPISNLPDGEADCFDIEELLKLMEADPVEVDPVTVGSWNEFQDAGANARGSWNEFQCARANTGVSWNANAGMEMGQQEPLYLDGLDQGMLEGMLHSDYPFPVWISEDRPMHNPAFHDAEMSEFFEGL

SEQ ID NO: 22254 - protein, 242 aa, Populus tremuloides
MGRGRVQLKRIENKINRQVTFAKRRNGLLKKAYELSVLCEAEVALIIFSNRGKLYEFCSGSSMLKTLERYQKCNYGAPEPNVSAREALELSSQQEYLKLKARYEGLQRTQRNLLGEELGPLSSKDLESLERQLDMSLKQIRSTRTQYMLDQLNDLQHKEHMLTAANKSLKERLMEGYQLNSLQLNPSAEDVEYARQQAQPQGDGFFHALECEPTLQIGYQPENITMVTAGPSMTTYMPGWLA

SEQ ID NO: 22255 - protein, 356 aa, Mucor circinelloides
MGCCASVEESDSVGKLRNEEIDGQLRMEKLNNKNEVKLLLLGAGESGKSTILKQMKLIHDGGFTPEEKEAYKEIIFSNSVQSIHVLLEAMEILDIPLDDASNQGYFDYIMEQYQKMDYFSMPPELVKAIKQLWQDKGVQEAHSRRNEFQLNDSASYYFDSIDRIGDPNYLPTDQDVLRSRVKTTGIAESKFTFGTLTYRMFDVGGQRSERKKWIHCFEDVTAIIFLVAISEYDQVLIEDESVNRMQEALTLFDSICNSRWFERTSTILFLNKTDLFKQKLPTSPLVDYFPDYKGANDDYEEASNYIMQRFISLNSSAEKQVYTHLTCATDTEQVKFVMAAVNDIVLQTNLRDVGLI

SEQ ID NO: 22256 - protein, 1203 aa, Photorhabdus luminescens subsp. laumondii
MKCRCKAWRWFTPLVLLLPLSGWSLNLFEYRNAQELPANGLPVEFYSNITQESQEFLPLPIKEQAVLPSRFPTLKVGILCCIGAPLVIHRWDGKLEGIYADYLRLIETVLKRPVEVRLFGNWESAYKALQRGDIQLLSNSASSQSGNEANDTYPILVQPLALMMRKEQVNMPFANMNIMAAPSSDPNVIKQLRKHYRTILIAKNQQEGIQAVVDGEMDAYLDGQSQIAYLLAFRPFTGLTYRRDISFGERYDFLGHSGDGIVEAVNLILTSIPHAIRNKVYERWISGLALGNNNDAAIFSAQEKAWIKKNPVINVALNRNTPPYSFLDKNGQITGLDVDILRLLGEKSGIIFNFIPTDGAVGIKKRLEDGEAQMTSMLNTPERNRWLSFSHPYGTVEWVMITRNERNAPYEFEQLKHHRVAIQRGNALLSLLKQYPEIFIIEVDSVTQGIDMVLAGAADATFDSLISADYLQASRYGANISIQFFKGSLQPEQYAVIPAYPQLVDILNKSIDALPPNELRVLRLKWLSMANVTPYDDNKISPWVKLWGGALFVIALSSAFWGSYLAHQIKRRKIAESNLQNLLAYWETLFNNMPTPMFVCDPTMCITAANLYFRHEMGSVGSEVIGRSLFSLCFLKPVDEQEISLIFLRCLEGAPVHFSDRNIVIQGQDKDVYLWLESYSNTEGVVQGIIGGWFDVTERKLLAQELRQERDKAELASLEKSDFLAHMSHEIRTPLQAIIGILDLEVKKQTQPSTPLHIAWQAAISLQGIIGDVLDFSKIESGRMVLNLKPESLQVILENCVATFSHRAKEKELFFTYQFDLPSEYYHLLDATRVTQIINNLLGNAIKFTEQGGVQISASYQLIPESQQDEITLVVADTGCGIPETMYEAVLLPYVQVTQHNGGKTGTGLGLPISVQLVELMGGNLKITGAPSGGAQVTVMLPLTRTIIEKEAISEKTENIETELHESLNILVVDDLPANLQVLSLQLAPSGHRIALTESGEQAMKLVEEGYFDIVLTDCQMPMMNGYQLAQLLRTHERLRQLPPFIILGCTANAFSTEQARCLEAGMNGVLIKPLVQSKLLAEITRYYRQINEEATLTFDEIQALAQQNVAVECQLLSAIQQGMSEDIAELQQQENQQCHEKVVHHAHRMKGAFALMQYQQGIRVCLRIEKSEQCDVKIIAVLLTRAEYFQQQIKQKLGELHS

SEQ ID NO: 22257 - protein, 93 aa, Fragaria x ananassa
WESHIWDNGKQVYLGGFDTAHSAARAYDRAAIKFRGTEADINFSVGDYDEDIKQMSNYTKEEFVQILRRQSTGFARGSSKYRGVTLHKCGHWE

SEQ ID NO: 22258 - protein, 439 aa, Rhodotorula mucilaginosa
MAISKIHSRYVYDSRGNPTVEVELTTEKGTFRSIVPSGASTGVHEALELRDGDKSKWLGKGVLKAVANVNDTIAPALIEANIDVADQAKIDEFLLKLDGTPNKAKLGANAILGVSLAAAKAGAAQKDVPLYKHIADISKAKEGKFVLPVPFQNVLNGGSHAGGDLAFQEFMIVPSGAPSFSEGLRIGSEVYHHLKSLTKKKYGQSAGNVGDEGGVAPDIKTAKEALDLIVSAIEAAGYTGQVDIAMDVASSEFYKDGLYDLDFKNPNSDKSKWITGPQLAELYEQLLNEYPIVSIEDPFAEDDWEAWSHFFSKVEGKTQIVGDDLTVTNPIRIKKAIETKAADALLLKVNQIGTLTESIQAANDSYAAGWGVMVSHRSGETEDTFIADLSVGIRSGQTKTGAPARSERLAKLNQILRIEEELGDKAIYAGKDFHKAHSL

SEQ ID NO: 22259 - protein, 398 aa, Heterodera glycines
MLRIALLISILALFGDCMDMGKRKLGGISINEPSEYGTKEKEAIATKENAQTSKDPPTSAGGQNEAIPSPKKPSPKGKLKSDFGLNLAKAFPRPVPKGRRGKEKVGEKISVMNTAERIEKMDIAQDKAKMEIDNIDTNAKPKQNEDKAPTIFPKCADNVEVEVELDRNIFRFSTTLDTMMEDLGMYTAEGTNQKLPVSNVSSTVMREVIEWCEHHKNDASIEPIYEEIALDVPTGKDAEASAPNAQAGEVAEAAESNAKPNNEKRLVFPSWDENFLDKEWPELVDIILAANYLNIKLLLTFATTMVDNKWINGKTPQEIRKAFGVEEPYPPGHPEWARVEKENEWEESDEEREARHAKEREEEEERERKEEQKRKEEEAERLHQEQLQQQQNQEQQPQ

SEQ ID NO: 22260 - protein, 433 aa, Heterodera glycines
MNILLKSVLFISLLSLFGDCMKNSDQIGVKRKSAGIRIEEPNDVKGKGKVVETSRKGKEKVGEKISVMNTAERIEKMDLAQDKAKMDIDTNGKPKQNEENAPPKYVFIWSGNNEKKNLEVDLRVIRHSKKLSELFHAKSDQSVNAKHGKQEALPVPKQEAEKMLKEVEEWYAHHKNDEHKKAPVFVFKCKDNVSLVINVHLDAVRLSKELSNMLEDTADEGYPKPIPSPVQNFKSDIMLKLIKLCEEYKYKFDGLKKTTDVPTGEVAEASASNVQEGDVGEASASKVKAGTIAEEIQKFVPPPHIMQWDVKTDLEMVRAADFYNINRLINDDYIDNVYEIVKVKWINGKTPQEIRKGFGVEEPYPPGHPEWARVEKENEWEESDEEREARHAKEREEEEERERKEEQKRKEEEAERLHQEQLQQQQNQEQQPQ

SEQ ID NO: 22261 - protein, 305 aa, Trichomonas gallinae
QILIATSPKPSLSPVERLSVGFIAGTLSRTLTSPLDVVKMLMQVSSRGGSVKDTISKLMAEQGIAGFWRGNWAACIRLGPQSAIKFYTYEELEKRIGKGKPLVGFQRTIFGSLSGVISQVLTYPLDVIRTRITVYPGKYTGIFNCAFTMMKEEDFSSLYAGIVPTVMGVIPYEGAQFYAYGGLKQLYTTRIAPGKPISPFANCLIGAAAGMFSQTFSYLFDVIRKRMMLKGEKGKPIYNGMIDAFMTVYNKEGVPGLYRGVGLNLIKVVPFAALQFTILEETRKAFFKVRAAINQPKVEEIKGKV

SEQ ID NO: 22262 - protein, 360 aa, Aplysia californica
MADHLAERKPGLVTVELNKTIWEVPSRYTIQNPVGIGAYGQVVSANDKNTGMKVAIKKLARPFQTPIHAKRTYRELRMLKHMEHENVINLMDCFTPAVRLEDFNDVYLVSPLMGADLNNILKTQRLSDDHVQFLVYQILRGLKYIHSAGIIHRDLKPSNIAVNEDCELKILDFGLARHSDEEMTGYVATRWYRAPEIMLNWMHYNQTVDIWSVGCIMAEMLMGKPLFPGSDHIDQLTRILNLAGTPSEELMKEIKSNDARMFIKSLPVMKKKDFKSVFLGANPLAIDLMERMLDLNTRTRLNATEALAHEYFKQYADPNDEPEAEKYDQSFEEMELGIEEWKKRVFSELENFQCPAEPMS

SEQ ID NO: 22263 - protein, 719 aa, Capsicum annuum
MALCAYAFPGILNRTVAVASDASKPTPLFSEWIHGTDLQFQFHQKLTQVKKRSRTVQASLSESGEYYTQRPPTPIVDTINYPIHMKNLSLKELKQLADELRSDTIFNVSKTGGHLGSSLGVVELTVALHYVFNAPQDRILWDVGHQSYPHKILTGRREKMSTLRQTNGLAGFTKRSESEYDCFGTGHSSTTISAGLGMAVGRDLKGRNNNVIAVIGDGAMTAGQAYEAMNNAGYLDSDMIVILNDNRQVSLPTATLDGPVPPVGALSSALSRLQSNRPLRELREVAKGVTKQIGGPMHELAAKVDEYARGMISGSGSTLFEELGLYYIGPVDGHNIDDLISILKEVRSTKTTGPVLIHVVTEKGRGYPYAERAADKYHGVAKFDPATGKQFKGSAKTQSYTTYFAEALIAEAEADKDIVAIHAAMGGGTGMNLFLRRFPTRCFDVGIAEQHAVTFAAGLACEGLKPFCAIYSSFMQRAYDQVVHDVDLQKLPVRFAMDRAGLVGADGPTHCGAFDVTFMACLPNMVVMAPSDEAELFHIVATAAAIDDRPSCFRYPRGNGIGVELPAGNKGIPLEVGKGRILVEGERVALLGYGSAVQNCLAAASVLESRGLQVTVADARFCKPLDRALIRSLAKSHEVLVTVEKGSIGGFGSHVVQFMALDGLLDGKLKWRPIVLPDRYIDHGSPADQLAEAGLTPSHIAATVFNILGQTREALEVMT

SEQ ID NO: 22264 - protein, 638 aa, Synechococcus elongatus
MHLSELTHPNQLHGLSIAQLTQIAAQIRDKHLETVAATGGHLGPGLGVVELTLALYQTLDLEKDRVVWDVGHQAYPHKMLTGRYNNFHTLRQKGGIAGYLNRRESPFDHFGAGHASTSISAALGMAIARDLKGENFKVVAIIGDGALTGGMALEAINHAGHLPHTNLMVVLNDNEMSISPNVGAIPRYLNKIRLSPQVQFITDNLEEQFKHIPFFGENLTPEMQRLKEGMKRLAVPKVGAVFEELGFTYVGPVDGHNLEELIATFQHAHTIPGPVLVHVATVKGKGYAIAEKDQVGYHAQNPFDLVTGKAKPSSKPKPPSYSKVFGETLTKLAENDPRIVGITAAMATGTGLDILQKRVPKQYIDVGIAEQHAVTMAAGMATQGMRPVAAIYSTFLQRAYDQIVHDVCIQKLPVFFCMDRAGIVGADGPTHQGMYDIAYLRCLPNMVLMAPKDEAELQRMIVTGINYTDGPIALRYPRGNGYGVALMEEGWEPLEIGKGELLRSGEDLLLVAYGSMVYPAMQVAEILKEHGMSAAVINARFAKPLDTELILPLAKQIGRVVTLEEGCLMGGFGSAVLEALQEADILVPVLRLGVPDILVEHASPDESKADLGLTPPQMAETIMQKFGVPQRATVVTAS

SEQ ID NO: 22265 - protein, 431 aa, Shewanella oneidensis
MAKIINVIGREIMDSRGNPTVEAEVHLEGGFIGMAAAPSGASTGSREALELRDGDKSRYLGKGVLTAVANVNGPIRTALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLAGEGKVFDSNGFSDFLKSLTEQYPIVSIEDGLDESDWDGWAYQTQIMGDKIQLVGDDLFVTNTKILTRGIENGIANSILIKFNQIGSLTETLAAIRMAKAAGYTAVISHRSGETEDATIADLAVGTAAGQIKTGSLCRSDRVAKYNQLLRIEEQLGEKAPYRGLKEIKGQA

SEQ ID NO: 22266 - protein, 636 aa, Synechococcus sp. PCC 7942
MHLSEITHPNQLHGLSVAQLEQIGHQIREKHLQTVAATGGHLGPGLGVVELTLALYQTLDLDRDKVVWDVGHQAYPHKLLTGRYHNFHTLRQKDGIAGYLKRTENRFDHFGAGHASTSISAALGMALARDAQGEDYRCVAVIGDGSLTGGMALEAINHAGHLPKTRLLVVLNDNDMSISPNVGALSRYLNKIRVSEPMQLLTDGLTQGMQQIPFVGGAITQGFEPVKEGMKRLSYSKIGAVFEELGFTYMGPVDGHNLEELIATFREAHKHTGPVLVHVATTKGKGYPYAEEDQVGYHAQNPFDLATGKAKPASKPKPPSYSKVFGQTLTTLAKSDRRIVGITAAMATGTGLDILQKALPKQYIDVGIAEQHAVVLAAGMACDGMRPVVAIYSTFLQRAFDQVIHDVCIQKLPVFFCLDRAGIVGADGPTHQGMYDIAYLRLIPNMVLMAPKDEAELQRMLVTGIEYDGPIAMRFPRGNGIGVPLPEEGWESLPIGKAEQLRQGDDLLMLAYGSMVYPALQTAELLNEHGISATVINARFAKPLDEELIVPLARQIGKVVTFEEGCLPGGFGSAIMESLQAHDLQVPVLPIGVPDLLVEHASPDESKQELGLTPRQMADRILEKFGSRQRIGAASA

SEQ ID NO: 22267 - protein, 635 aa, Chlorobium tepidum
MISQAYPLLSSIHSPADLKKLSLHELELVAAECRKKVIELVSQNGGHFGSSLGVVELTVALHYVYQSPTDRIIWDVGHQAYVHKILTGRLAQMETNRRYHGLAGFPKRSESPHDAFGTGHASTSISAAAGLAAARDLAGRKEKVVAIIGDGSLTGGMAFEAMNHLGDTKSDVLVILNDNQMAISPSTGGLKNYLVNLTLNKTYNRLRKFVWDSLSLLHNEIGETAKTAVHRIEDGIKAAFTPGAYFEALGFRYFGPIDGHNMEQLIKALREMRQLHHPKLLHVITTKGKGFKPAEENQPKWHASVGGFDIETGKNVKAPGKPAKPKYQEVFGEALVELALKDPTITAITAAMPSGTSLDLFQQAIPSRCFDVGIAEQHAVTFAAGLACGGFKPVFAVYSTFLQRAYDQLIHDVALQNLHVVFAIDRAGLVGEDGPTHHGAFDLSYLNVVPNLTIMAPGDEQELRNMLYTALYDIKGPVAIRYPRGSGSGATLHKEFTPVPVGRGRILRDGKSVALLGIGTMSNRALETAALLEAAGLDPLVCDMRFLKPLDTEIIDMAASRCTHIVTIEENSIIGGFGSNVVNYLHHAHPGIKCISFGLPDAFVTHGSMDELYREVGLDAESLSGKILEFYKDKP

SEQ ID NO: 22268 - protein, 359 aa, Geodia cydonium
  unsure (1)..(359): unsure at all Xaa locations
MGGCVSATPEEREAKTRSSVIDRQQRQDARQYENTIKILLLGAGESGKSTVVKQMKIIHGDGYSQTEXRSFKSVIYGNLAASMRVVLNAMEKLGIPYGNQASQEQARVILSLSNSLSSYESFPPDVTSAFISLWRDAGVQECFSRAYEYQLNDSAPYYFQNMDRLLREDYVPDEQDVLRSRVQTTGIIETSFRVKQLTYRVVDVGGQRSERRKWIQCFDDVRAVLFVCALSGYDMTLFEDGKTNRLEESLNLFQAICNNKFFVKTSMILFLNKADLFRDKITNSDRHLRLYFTQYTGPDRDVEAASRFIQSEFMERNLNKQKIIYPHLTTATDTTNIKVVFGVVLDTIIRENLEAANLL

SEQ ID NO: 22269 - protein, 355 aa, Geodia cydonium
MSCLLSEEERLQKRINTRINRELQRDHKDAKKEIKLLLLGTGESGKSTFIKQMRIIHGKGYSKQDCLEYKNLVFRNILMSMHSMLQATAELKIAYIDPDAQRHVQLLMALRPETAQSLGGETCEAIRKLWQDAGVQECYQRRNEYQLSDSTKYYLDDLPRISSNDYVPTTQDVLRVRVPTTGINEYPFTINKIIFKMVDVGGQRSERRKWIHCFDHVTSVMFLVAISEYDQILVEADSRVNRMVESLHLFNTIISYPWFNKSSIILFLNKKDLLEEKVMHSHLIDYFEEYDGPKCDHVSARESIAKMFISINDMRSADIYPHFTCATDTENIKFVFDVVKNHILQQHITEVVPGL

SEQ ID NO: 22270 - protein, 633 aa, Kitasatospora griseola
MALLTRIRGPRDLDRLTPAQLAELAEEIRAFLVEEVSKTGGHLGPNLGVVELTLAMHRVFDSPRDRILFDTGHQSYVHKLLTGRQDFSRLKMKGGLSGYPSRAESEHDVIENSHASTVLGYADGLAKANKIQGHKDRPVVAVIGDGALTGGMAWEALNNIADSQDLPIVIVVNDNERSYSPTIGGLANHLATLRTTQGYERFLSWGKDALQRTPVVGQAMFDTLHGAKKGLKDFIAPQGMFEDLGLKYLGPIDGHDLQALESAFTKARNFGGPVIVHCITEKGRGYHAAENNDEDRFHAVGVIHPDTGLPVKTSGKDWTSVFGEEMVALGRERRDLVAITAAMLHPVGLAPFAKAYPERIFDVGIAEQHAAVCAAGLATNGLHPVVAVYATFLNRAFDQVLMDVALHKLGVTFVLDRAGVTGTDGASHNGMWDMSILQVVPGLRLAAPRDAEQVRLQLREAVEVADAPTVVRYSKGNVGPAVPAVGTVGGMDVLRRPEADSADEAADVLIVSIGAMAPTCLEAAELLAQQGISSTVVDPRWVKPVDAALPGLAAQHRLVVTVEDNGRAGGVGSAIAQALRDADVDVPLRDFGIPQEFLDHASRGEILDEIGLTAPAIAKKIEALVSTRSFARS

SEQ ID NO: 22271 - protein, 649 aa, Kitasatospora griseola
MPLLSRITGPADLRRLHPEQLPPLAAEIRAFLIDNVTRTGGHLGPNLGVVELSIALHRVFDSPHDRILWDTGHQAYVHKLLTGRQDFSRVRAKDGLSGYPSRAESPHDLIENSHASTALGHADGIAKADQLLGVDRCTVAVIGDGALTGGMAWEALNNIAEAEDRPLVIVVNDNERSYAPTIGGLAHHLATLRTTKGYERFLAWGKDALQRTPVVGPPLFDALHGAKKGFKDAFAPQGMFEDLGLKYLGPIDGHDIAGVEQALRRARNFGGPVIVHCLTVKGRGYRPAEQDEADRFHAVNPIDPYTCLPISPSAGASWTSVFGKEMLALGAERPELVAVTAAMLHPVGLGPFAKAYPGRTFDVGIAEQHAVASAAGLATGGLHPVVAVYATFLNRAFDQVLMDVALHRLGVTFVLDRAGVTGNDGASHNGMWDLSVLQVVPGLRIAAPRDAARVREHVRQAVAVEDAPTVVRFPKGELGPEAPAIERIGGVDVLARTGPAPDVLLVAVGPMAAACLDAAALLAADGITATVVDPCWVKPVDPALVELAGAHRMVVTVEDNGRTGGVGAALAQAMRDADVDTPLRDLGIPQEFLAHASRGEILEEIGLTGTGVAAQTAAHARRLLPGTGTRPGAQEYRPRMPLTDWSEPA

SEQ ID NO: 22272 - protein, 381 aa, Geodia cydonium
MSCFGGGVEDDRTKEQKRQNKLIDQQLKKDKKAYRALHRLLLLGAGESGKSTVVKQMKILHKDGFSDEERKEKLVDIKSNIRDIVVTVTKAMSELDPPVSLGSPENEEHLQYLWSDEVTRKDYDYPEKFFEAVSKVWNDSGVQTCSARSNEYQLIDSAAYFMASEKQAQLKEPNYIPNDQDILRCRVLTSGIFETRFVVDKVHFYMFGVGGQRIERRKWIQCFNDVTAIIFVVACSSFNMVIREDLYTNRLRESLDLFEQIWNNRWLRTVSIILFLNKQDILKEKIDAGKRVENYFLEFNSYRPPDNLDLSKEPPGSSSTFLKARYFFRDMFLRITNKSHDGRHFCYPHFTTAVDTENIRRVFDSCRDIIQRMHLQKYELL

SEQ ID NO: 22273 - protein, 361 aa, Suberites domuncula
MSSSDYYSQRVGDTVFTVQKRYTNLTNIGSGAQGVVCSAFDTVTQEKIAIKKLVKPFQNETYAKRAFRELRLMKMVDHKNIIGLKNLFTPAKSLDDFQDVYIVMELMDANLCRVIGIELDHDRMSYLLYQLLCGIKHLHSAGIIHRDLKPSNIVVKEDCSLKILDFGLARTADQTFNMTPYVVTRYYRAPEVIVGMKYKENVDIWSVGCIFAEMIRGDILLPGKDYIDQWNKVTQVLGTPPSVFFKQLSSSVRLYCESQPRYAGKSWKDLFPDDVFPNDTPEDKAKTRHGRDLLSKMLQIDPQNRITVEQALAHPYVSIWYDPAEVHAPPPKRYDHALDEQSIPLDQWKTRIYEEVKTYNS

SEQ ID NO: 22274 - protein, 363 aa, Danio rerio
MTARSRPGYFRQEINKTIWEVPDRYKDLKQVGTGAYGTVCYALDRRTGAKVAIKKLHRPFQSDLFAKRAYRELRLLKHMKHDNVIGLVDVFTADLSLDRFHDFYLVMPFMGTDLGKLMKMERLSEERVQYLVYQMLKGLKYIHAAGIIHRDLKPGNLAINEECELKILDFGLARQTDSEMTGYVVTRWYRAPEVILSWMHYTQTVDIWSVGCIMAEMLLGKPLFKGHDHLDQLMEIMKVTGTPSKEFTAKLQSEDARNYVTKLPRFRKKDLRILLPNVNPQAIKVLDGMLLLDPESRITAAEALAFPFFSEFREPEEETEAPPYDHSLDEADQSLEQWKRLTFTEILTFQPAPAVAESKETAL

SEQ ID NO: 22275 - protein, 382 aa, Gallus gallus
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKSLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESDRDKLKTSQARDLLSKMLVVDPDKRISVDEALRHPYITVWYDPAEAEAPPPQIYDAQLEEREHAIEEWKELIYKEVMDWEERSKNGVVKDQPSAQMQQ

SEQ ID NO: 22276 - protein, 426 aa, Xenopus laevis
MSRSKRDSNFSVFEIGDSTFTVLKRYQNLKPIGSGAQGIVCAAFDAVLERHVAIKKLSRPFQNQTHAKRAYRELVLMKCVNHKNIIGLLNVFTPQKSLEEFQDLYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCILGEMIKGGVLFPGTDHIDQWNKVIEQLGTPCTEFMKKLQPTVRTYVENRPKYAGYSFEKLFPDVLFPADSEHNKLKASQARDLLSKMLVIDASKRISVDDALQHPYINVWYDPLEAEAPPPKIPDKQLDEREHTIEEWKELIYKEVLDWEERAKNGVIRGQPAPLGAAVTDGSQAHTSSSSGDASSMSTDPTLPSDTDSSLETSAGTLGCCR

SEQ ID NO: 22277 - protein, 384 aa, Danio rerio
MNRNKREKEYYSIDVGDSTFTVLKRYQNLRPIGSGAQGIVCSAYDHVLDRNVAIKKLSRPFQNQTHAKRAYRELVLMKCVNHKNIIGLLNVFTPQKTLEEFQDVYLVMELMDANLCQVIQMELDHERLSYLLYQMLCGIKHLHAAGIIHRDLKPSNIVVKSDCTLKILDFGLARTAATGLLMTPYVVTRYYRAPEVILGMGYQANVDVWSIGCIMAEMVRGSVLFPGTDHIDQWNKVIEQLGTPSQEFMMKLNQSVRTYVENRPRYAGYSFEKLFPDVLFPADSDHNKLKASQARDLLSKMLVIDASKRISVDEALQHPYINVWYDPSEVEAPPPAITDKQLDEREHSVEEWKELIYKEVLEWEERTKNGVIRGQPASLAQVQQ

SEQ ID NO: 22278 - protein, 376 aa, Ancylostoma caninum
MASTSVPENYYVVPIGETQMVILKRYENLRLIGSGAQGIVCAATDMVTNKPVAIKKLSRPFQNVTHAKRAYREFILMNLVNHKNIIGLLNAFSPQREVEEFNDLYIVMELMDANLCQVIQMDLDHERLSYLLYQMLCGIKHLHSAGIIHRDLKPSNIVVKSDCTLKILDFGLARTAVEAFMMTPYVVTRYYRAPEVILGMGYGENVDVWSVGCIFGELIRGRVLFPGADHIDQWTRIIELLGTPEPQFLARLQTTVRNYVENRQKYQPVPFETLFADNMFPPGADNARLTAAKARDLLSRMLVIDPEKRISVDDALAHEYVNVWYDASRGSCSSAGPSTILLVDGEHTVEEWRAMLFAELQNYYRTHDVYGVGQRR

SEQ ID NO: 22279 - protein, 533 aa, Ustilago maydis
MSIANASSSTASHDLDAADADPCPSACTSVSALCNMSTLPSPRPFGYRPTYVPAMVASGVSAVTVTTNSHRPPSKSHSISSVDSLASVSSNAPSTPTHDADDVRFEMAVIPKLVRASADAYLDRVGKPLPPSPAPQIVATSATTKTNAQAARSVAAAAAAAAAAAAVPPSHSALRNENHKNAISFRVGSKYKVCEIIGEGAYGVVCSAIHRATGQKVAIKKIQPFEHQMFALRTLRELKLLRFFQECDVSENIISILDIIKPSTYEAFTEVYLVQELMETDLHRVIRTQELSDDHCQYFTYQTLRALKPMHCADVIHRDLKPSNVLLNANCDLKVCDFGLARSVLTADQDTGFMTEYVATRWYRAPEIMLTFKQYTKAIDAWAVGCILAEMLTGRPLFPGRDYHQQLSLILDVLGTPTLEEFQNINSRRSRDYIRSMPFRKRREFRTLFPKASPEAIDFLQKTLTFDPRNRLTVEECLQHPYLSAYHDPDDEPGAPRLDPDFFYFDMQKESITKEDLRKELWYQVQEFQPLLR

SEQ ID NO: 22280 - protein, 501 aa, Equus caballus
MEQQDPIKKEGRLTPVLALATLIAAFGSSFQYGYNVAAVNSPAELMKAFYNETHYSRFSEYISEFSLTLLWSISVSMFPFGGFVGSLMVGPLVNRLGRKGTLLFNNIFSIVPAILMGTSKTARSYEMIILSRLLVGICAGLSSNVVPMYLGELSPKNLRGALGVVPQLFITVGILVAQIVGLRSLLATEEGWPILLGLTAIPAALQLLLLPFFPESPRYLLIQKKDAAAAKNALKRLRGWDDVDAEMEEIQLEDEAEKAAGIISVLTMFRMRSLRWQVISIIILMGGQQLSGVNAIYYYADQIYLSAGVKDQDVQYVTVGTGAVNVLMTICAVFVVEYLGRRALLLLGFSVCFIACCVLTVALALQDRVSWMPYISIVCVISYVIGHALGPSPIPALLITEVFLQSSRSAAYMVGGTVHWLSNFAVGLVFPFIQVGLGAYSFIIFAVICLLTTIYIFLIVPETKGKTFVEINHIFTKMNKVSDVHPAKDELKDIPLSAVEL

SEQ ID NO: 22281 - protein, 462 aa, Caenorhabditis elegans
MVRPEDFNSLELDNSLTDGETVHEMMAHKAGLTYNDFNILPGFINFGVHDVSLETNITKDLKIKAPLVSSPMDTVTESGMAIVMALYGGIGIIHGNFPKPEDQAAEVLKVKRFKQGYVMQPHCLSRDSTAFDMIQIKKKYGYTGAPVTEDGRVGSKLIGMVTSRDFDFITMDVAGQKGTPISDTNDVTPTTPITRIMVSVDQLHLGHINDAPELSQKKLKEHRLGKLPIVNDNGELCALLCRSDLLKARDYPMASYDSKGQLLCGAAVNTRGESQYTVDRVVEAGVDVLIIDSSNGSSTYQISMLRYIKEKHPHVQVIAGNVVTRAQAKLLIDQGADGLRIGMGSGSICITQDVMAVGRAQGTAVYDVARYANQRGIPIVADGGIRDVGYITKAISLGASAVMMGGLLAATTEAPGEYFWGPGGVRVKKYRGMGSLDAMEAHASSQDRYFTAHVFFSILSYF

SEQ ID NO: 22282 - protein, 267 aa, Humulus lupulus
MADANMGAGGGQFPDFPSVLTHGGQYVQFDIFGNFFEITTKYRPPIMPIGRGAYGIVCSVLNTELNEMVAVKKIANAFDIYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLLNANCDLKICDFGLARPNIENENMTEYVVTRWYRAPELLLNSSDYTAAIDVWSVGCIFMELMNRKPLFAGKDHVHQIRLLTELLGTPTESN

SEQ ID NO: 22283 - protein, 254 aa, Oryza sativa (indica cultivar-group)
MEAGYPGAAANGAAADGNGGAQQAAAAPAIREQDRLMPIANVIRIMRRVLPAHAKISDDAKETIQECVSEYISFITGEANERCQREQRKTITAEDVLWAMSRLGFDDYVEPLGVYLHRYREFEGESRGVGVGVGAARGDHHHGHVGGMLKSRAQGSMVTHHDMQMHAAMYGGGAVPPPPHPPPHHHAFHQLMPPHHGQYAPPYDMYGGEHGMAAYYGGMYAPGSGGDGSGSSGSGGAGTPQTVNFEHQHPFGYK

SEQ ID NO: 22284 - protein, 523 aa, Datisca glomerata
MPAVGGIVVGGSKKEYPGNLTPYVTITCIVAAMGGLIFGYDIGISGGVTSMDSFLKKFFPAVYRKKELDSTTNQYCQYDSQTLTMFTSSLYLAALLASIVASTITRKFGRRLSMLFGGILFCAGAIINGFAQAVWMLILGRMFLGFGIGFSNQSVPLYLSEMAPYKYRGALNIGFQLSITIGILVANVLNYFFAKIRGGWGWRLSLGGAMVPALIITVGSLLLPDTPNSLIERGNRDEARSKLQRVRGVDDVDEEFNDLVAASEESKQVEHPWTNLLRRKYRPHLAMAILIPFFQQLTGINVIMFYAPVLFNTIGFGSDASLMSAVITGCVNVAGTLVSIYGVDKWGRRFLFLEGGFQMLICQAVVAAAIGAKFGVNGNPGELPKWYAIVVVLFICIYVAGFSWSWGPLGWLVPSESFPLEIRSAAQSINVSVNMIFTFAIAQIFLTMLCHLKFGLFIFFAFFVVVMSIFVYFFLPETKGIPIEEMGRVWKSHWYWSRFVTDADYTIGSGVEMGKGAQELKNI

SEQ ID NO: 22285 - protein, 95 aa, Datisca glomerata
LQLSLLTPYVQELGIPHAWASVIWLCGPLSGLFVQLVGHMSDRCTSRFGRRRPFIVVGALPITVAVLIIGYSADIGSLIGDRGTVKPGAIATFVV

SEQ ID NO: 22286 - protein, 183 aa, Datisca glomerata
GADMAIYYPYSDEEKRLTALHDTIEKMLYDPEQNDEHIGILSDKSKPLIFTMARLDRVKNLTGFVELYGKSSRLRELANIVVIGGYFDVKKSKDREEIAEIEKMHDLIKKYDLGSQFRWISAQLDRALSGELYRYIADTRGAFVQPAVYEAFGLTVVEAMTSGLPTFATCHGGPAEIIEHGIS

SEQ ID NO: 22287 - protein, 512 aa, Medicago truncatula
MAGGVLPVDSTPVAVTAINIGGKLTLSIIITCIVAASGGLLYGYDLGVSGGVTTMVPFLQKFFPDILRKAASAEVNMYCVYDSQILTLFTSSLYLAGLVSSIAASKVTAAYGRRNVIIIGGALFIAGGAINGGSENIPMLILGRVLLGFGVGFTNQAAPLYLSETAPPKWRGTFNTGFQFFLGIGVVAAGCINYATAKHTWGWRLSLGLAVVPAAVMTIGSFLITDTPNGLVERGKIEQAKQALRKIRGSSVDIEPELEELIKWTEIAKSVQQEPFKTILKREYRPHLVMAFAIPFFQQLTGINIVAFYSPNLFHSVGFGHDGALLSAIILGSVSLLSNLISAGIVDRIGRRFLFISGGIMMLVCLIAVSIVLAVVTGVDGTKDISKGNAIVVLVLLCFYSAGFGWSWGPLTWLIPSEIFPVKIRTTGQSIAVAVQFIIIFVLSQTFLTMLCHMKFGAFVFYAFWVIVMTLFVIFFLPETKGIPLESMYTIWGRHWFWSRYVKGQEVLENLP

SEQ ID NO: 22288 - protein, 286 aa, Medicago truncatula
AVATAALIYVKEIPLSPEKVTGNGVTDEDGNVTKSSNPCFGELSGAFRERKRPMWILLLVTCLNWIAWFPFLLFDTDWMEKEEYGGTVGEGHAYDKGVRAGALGLMLNSVVLGAASLGVDVLARGVGGVKRLWGIVNFLLAICLAMTVLVTKLAQHSRVYADASHTDPLPPSGGITAGALALFSVLGIPLAITYSIPFALASIFSSSSGAGQGLSLGVLNLAIVIPQMIVSVLSGPWDALFGGGNLPAFVVGAVAALASGILSVVLLPSPPPDLAKSVTATGGGFH

SEQ ID NO: 22289 - protein, 509 aa, Taxus cuspidata
MDVFYPLKSTVAKFNECFPAILFIVLSAVAGIVLPLLLFLRSKRRSSVGLPPGKLGYPFIGESLLFLKALRSNTVEQFLDERVKNFGNVFKTSLIGHPTVVLCGPAGNRLILANEEKLVQMSWPKSSMKLMGEKSITAKRGEGHMIIRSALQGFFSPGALQKYIGQMSKTIENHINEKWKGNDQVSVVALVGDLVFDISACLFFNINEKHERERLFELLEIIAVGVLAVPVDLPGFAYHRALQARSKLNAILSGLIEKRKMDLSSGLATSNQDLLSVFLTFKDDRGNPCSDEEILDNFSGLLHGSYDTTVSAMACVFKLLSSNPECYEKVVQEQLGILSNKLEGDEITWKDVKSMKYTWQVVQETLRLYPSIFGSFRQAITDIHYNGYIIPKGWKLLWTPYTTHPKEMYFSEPEKFLPSRFDQEGKLVAPYTFLPFGGGQRSCPGWEFSKMEILLSVHHFVKTFSTFTPVDPAEIIARDSLCPLPSNGFSVKLFPRSYSLHTGNQVKKI

SEQ ID NO: 22290 - protein, 302 aa, Paracoccidioides brasiliensis
MTSERESKTFLARLCEQAERYDEMVTYMKEVANLGGELTVDERNLLSVAYKNVVGTRRASWRIISSIEQKEDSKGSEKHVAIISEYRQKIETELERVCQDVLDVLDQSLIPKAESGESKVFYHKMKGDYHRYLAEFASGNKRKVAATAAHEAYKNATDVAQTELTPTHPIRLGLALNFSVFYYEILNSPDRACHLAKQAFDDAIAELDSLSEESYRDSTLIMQLLRDNLTLWTSSDGAEPEPVAAGDGKDDKTAEGEEGPATATTTDAPAPEEVAAPAAADEEPKKEGTNGVLKYGFKKNLF

SEQ ID NO: 22291 - protein, 96 aa, Oryza sativa (indica cultivar-group)
AYAATPTNLKIIDLYVVFAVATALIQVVYMEIVGSFPFNSFLSGVLSCIGTAVLAVCLRIQVNKDNKEFKDLPPERAFADFVLCNLVPHLVIMNFL

SEQ ID NO: 22292 - protein, 756 aa, Rattus sp.
MDSGRDFLTLHGLQDDPDLQALLKGSQLLKVKSSSWRRERFYKLQEDCKTIWQESRKVMRSPESQLFSIEDIQEVRMGHRTEGLEKFARDIPEDRCFSIVFKDQRNTLDLIAPSPADAQHWVQGLRKIIHHSGSMDQRQKLQHWIHSCLRKADKNKDNKMNFKELKDFLKELNIQVDDGYARKIFRECDHSQTDSLEDEEIETFYKMLTQRAEIDRAFEEAAGSAETLSVERLVTFLQHQQREEEAGPALALSLIERYEPSETAKAQRQMTKDGFLMYLLSADGNAFSLAHRRVYQDMDQPLSHYLVSSSHNTYLLEDQLTGPSSTEAYIRALCKGCRCLELDCWDGPNQEPIIYHGYTFTSKILFCDVLRAIRDYAFKASPYPVILSLENHCSLEQQRVMARHLRAILGPMLLDQPLDGVTSSLPSPEQLKGKILLKGKKLGGLLPAGGENGSEATDVSDEDEAAEMEDEAVRSQVQHKPKEDKLKLVPELSDMIIYCKSVHFGGFSSPGTSGQAFYEMASFSESRALRLLQESGNGFVRHNVSCLSRIYPAGWRTDSSNYSPVEMWNGGCQIVALNFQTPGPEMDVYLGCFQDNGGCGYVLKPAFLRDPNTTFNSRALTQGPWWAPKRLRVRIISGQQLPKVNKNKNSIVDPKVIVEIHGVGRDTASRQTAVITNNGFNPRWDMEFEFEVTVPDLALVRFMVEDYDSSSKNDFIGQSTIPWNSLKQGYRHVHLLSKNGDQHPSATLFVKISIQD

SEQ ID NO: 22293 - protein, 284 aa, Danio rerio
MASSPEKSSSAQELKEQGNRLFLSRKYQEAVTCYSKAINRNPSVAVYYTNRALCYVKLQQYDKALADCKHALELDSQSVKAHFFLGQCQLELENYEEAIGNLQRAYNLAKEQRLNFGDDIPSALRIAKKKRWNSIEEKRISQENELHAYLSKLILAEKERELDDRVKQSDDSQNGGDISKMKSKHDKYLMDMDELFSQVDEKRKKREIPDYLCGKISFELMREPCITPSGITYDRKDIEEHLQRVGHFDPVTRSPLTQDQLIPNLAMKEVIDAFIQENGWVEDY

SEQ ID NO: 22294 - protein, 354 aa, Mus musculus
MVGEAAAPWMVLWVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLHARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 22295 - protein, 320 aa, Homo sapiens
RPLPSPSAAPSFPSPSRSLRAGRCGGGTRPSPTPGGGGAAGRGRGPRGPKREGKAWPRAGRSPGLARRRPPEHPVMDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNASQAESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 22296 - protein, 948 aa, Sorghum bicolor
MAASVSGATICLQKPGSKSRRARDATSSFARRSVAAPRSPHAAKASVIRSDAGAGRGQHCAPLRAVVDAAPIATKKRVFYFGKGKSEGDKSMKELLGGKGANLAEMSSIGLSVPPGFTVSTEACKQYQDAGCILPAGLWAEILDGLQFVEEYMGATLGDPQRPLLLSVRSGAAVSMPGMMDTVLNLGLNDEVAAGLAAKSGERFAYDSFRRFLDMFGNVVMDIPRSLFEEKLEHMKESKGVKNDTDLTAADLKELVGQYKEVYLTAKGEPFPSDPKKQLELAVRAVFNSWESPRAKKYRSINQITGLVGTAVNVQSMVFGNMGNTSGTGVLFTRNPNTGEKKLYGEFLINAQGEDVVAGIRTPEDLDAMKDVMPQAYEELVENCNILESHYKEMQDIEFTVQGNRLWMLQCRTGKRTGAGAVKIAVDMVSEGLVERRQAIKMVEPGHLDQLLHPQFENPALYKDKVIATGLPASPGAAVGQIVFTAEDAEAWHAQGKAAILVRAETSPEDVGGMHAAAGILTERGGMTSHAAVVARGWGKCCVSGCSAIRVNDAEKTVAIGDHVLSEGEWLSLNGSTGEVILGKQPLSPPALSGDLGTFMSWVDDVRKLKVLANADTPGDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGTPQELGHQVNVIKQTAEKVFANAGKTIGYKIGTMIEIPRAALVADQIAEQAEFFSFGTNDLTQMTFGYSRDGVGKFIPIYLAQGILQHDPFEVLDQRGVGELVKFATERGRQTRPNLKVGICGEHGGEPSSVAFFAKVGLDYVSCSPFRVPIARLAAAQVLV

SEQ ID NO: 22297 - protein, 530 aa, Nicotiana tabacum
MGDIEGEPGSSMHGVTGREPVLAFSVASPMVPTDTTAKFSVPVDTEHKAKIFKFYSFSKPHGLTFQLSWISFFTCFVSTFAAAPLVPIIRDNLNLTKMDVGNAGVASVSGSILSRLVMGAVCDMLGPRYGCAFLIMLSAPTVFCMSFVSSAGGYVAVRFMIGFSLATFVSCQYWMSTMFNSQIIGLVNGTAAGWGNMGGGATQLIMPIVYDIIRRAGATPFTAWRIAFFIPGWLHIVMGILVLTLGQDLPDGNRGDLQKKGDVSKDKFSNILWYAATNYRTWIFVLLYGYSMGVELSTDNVIAEYFFDRFDLKLHTAGIIAATFGMANLLARPFGGFSSDYAAKRFGMRGRLWVLWILQTLGGVFCVLLGRSNPLPIAVTFMILFSIGAQAACGATFGIIPFISRRSLGIISGMTGAGGNFGSGLTQLLFFTSSKYSTATGLTYMGLMIIGCTLPVTFCHFPQWGSMFFPPTKDPVKGSEEHYYAAEYTEAERQKGMHQNSLKFAENCRSERGKRVGSAPTPPNLTPNRV

SEQ ID NO: 22298 - protein, 530 aa, Nicotiana tabacum
MVDIEGSPGSSMHGVTGREPVLAFSVASPMVQTDTTAHFKVPVDSEHKAKVFKFYSFSKPHGLTFQLSWISFFTCFVSTFAAAPLVPIIRDNLNLTKMDVGNAGVASVSGSILSRLAMGAICDMLGPRYGCAFLIMLSAPTVFCMSFVSSAGGYVAVRFMIGFSLATFVSCQYWMSTMFNSQIIGLVNGTAAGWGNMGGGATQLIMPILYDIIRRAGATPFTAWRIAFFIPGWLHVIMGILVLTLGQDLPDGNLASLQKKGDVSKDKFSKILWYAATNYRTWIFVLLYGYSMGVELTTDNVIAEYFFDRFDLKLHTAGIIAATFGMANLLARPFGGWSSDIAAKHFGMRGRLWNLWILQTLGGVFCFLLGKANTLPMAIAWMIIFSLGAQAACGATFGIIPFISRRSLGIISGMTGAGGNFGSGLTQLLFFTTTKWSTETGLSYMGIMIIACTLPVSLVHFPQWGSMFLPPTKDPVKSTEEHYFTSEYTEAEKQKGMHQNSIKFAENCRSERGKRVGSALTPPNVTPNRV

SEQ ID NO: 22299 - protein, 254 aa, Populus alba x Populus grandidentata
TNYRTWIFVLLYGYSMGVELSTDNVIAEYFYDRFDLKLHTAGVIAATFGMANLVARPFGGYSSDVAARYFGMRGRLWVLWILQTLGGVFCIWLGRANSLPLAVTAMILFSIGAQAACGATFGIIPFISRRSLGIISGLTGAGGNFGSGLTQLVFFSSTSLSTAAGLSWMGVMICGCTLPVALVYFPQWGGMFFPPSKDVVKSTEESYYASEWDEDERQKGMHQQSLKFAENSRSERGNRIASAPTPPSTTPNRV

SEQ ID NO: 22300 - protein, 878 aa, Choristoneura fumiferana MNPV
MQRNLLSTINSMSARIKALERYEHALREIHKVILVMRPGFNLQVLDPDAMPALIVQFFSDLTDRNTTHNINYRYDYNVAGALPFQPPPPQPYHPYGHYWPQAPPQPPPQQPPPQQPPPQQPPPQQPPPQQPPPQQPPPQQPPPQQPPPQQPPPALVQQIELSADEIRELQKLHLNMQLETITWSHFAAFIGSVTHIVQMRIVNNTFLVDTIAALQNVKRLINYDFYEFLRCVAKETALLFEISPYLCRVFATFIRFFQNTHELIYMVTFTYVDAQSLTDSVNSLQTIVRKLFWFFAKIYVHFKRTEFVFITFDHFVSTLDELIMLVEALPNAAQNNAELDRFHSEMRALRANYTELQKQKVEIEQRLETANLHSQTVDNRNLELNQQILTLLPLKENLAALSLNVKELTKENVHLKAEIQLQNQPVGAPNNSYLNEFTEAQKKFQLEQKKRRDLEQQLRDIQATQATRSQSADNEHQNTISQLTASLAEKDAELATRDKEHAFAMDKKDKDYADKVRSAAEDYMSKLNTFQSQIEELRRELSERNIIFEQGRNEYYQAIDIIKVKDDQLTQANQIINNLNQRLEEANEQLTLQTNVIKTEKGDNLGKEEVETLLSAVNIMYKHAQLLDRNLGGRDLSQNVEDLRFEIAMQQRDALDQWFGILKQSIAPNDVLNFASLADVNDLKSQIVTKIPANMITTVDKKIISYEESGNVDNVTVISAVSRLVDEYERLGKENVQLTVDNKTLFSDNKTLVETCNQNLDSLKTDLAKNISNVDEINSLVNITPDLDNSAIQKVRDDLIVAQSRLKSLKESKSVDLNQLASASVKEEMSKLNNNILEINSLLSKHSAITEDIFKWKTTMLEVYESLARAAAEEGPLV

SEQ ID NO: 22301 - protein, 251 aa, Choristoneura fumiferana MNPV
MIVLLILLNFIVIIILILWLYVIINRRNKELPPTPWPTPPPTPPPTPPPTPSPTPPPTPSPTPPPTPSPTPPPTPSPTPPPTPSPTLPPTPSPTLPPTPSPTPPPTPSPTPSPTPSPTPSPTPSPTPSPTPSPTPSATPSPTPSATPLPTSSPTPPPTPSPLGEPMYFSSDITTIEQLQDHIRPLCSGWTRPRETYAVPWDCRRVIHCSYFGVLLHTVSCDTLTNSAYSFTADGCVPHHQSDCPFYPLNIL

SEQ ID NO: 22302 - protein, 131 aa, Brassica juncea
ILDRYGKQHADDVKALDFQSRALNYGSHNELLELVESTLVESNVDVSVDSLVQLEGHLENALSLTRARKTELMLKLVDSLKEKEKLLKEENQALASQMEKKNTAGAEADNMETSPGQISDINLPVTLPLLN

SEQ ID NO: 22303 - protein, 167 aa, Oryza sativa (japonica cultivar-group)
GRWSATRPGGGGGGGGGVREQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 22304 - protein, 252 aa, Lactococcus lactis subsp. cremoris
MLCICTCRIKVVLRGKFFLHKLCKKNNIPDIIHLHGSEFKKWFDESDDKKKEQIQTLLKESAGFIVLGDKWNKAVKEIEPKTNTVVVSNTVHIPDYTVEWKQPFTVLFMGVLIKRKGVADLINAIYLLNKENKLDNVRLVIAGSGAEEAELKAMCTQLGLDNYIEFAGWTAGEKKEKLFRESQMLVLPSYNEGLPIAILEAISCGMPVVATNVGDISSAVIDGENGYLIEPGDVLAIKQAIEKIVWDPNSPL

SEQ ID NO: 22305 - protein, 320 aa, Mus musculus
MSNESSKKQSSKKALFDPVSFSKDLLAGGVAAAVSKTTVAPIERVKLLLQVQASSKQISPEARYKGMLDCLVRIPREQGFLSYWRGNLANVIRYFPTQALNFAFKDKYKELFMSGVNKEKQFWRWFLANLASGGAAGATSLCVVYPLDFARTRLGVDIGKGPEQRQFTGLGDCIMKIAKSDGLIGLYQGFGVSVQGIIVYRASYFGAYDTVKGLLPKPKETPFLVSFIIAQIVTTCSGILSYPFDTVRRRMMMQSGESDRQYKGTIDCFLKIYRHEGVPAFFRGAFSNILRGTGGALVLVLYDKIKEFLNIDVGGSSSGD

SEQ ID NO: 22306 - protein, 545 aa, Mus musculus
MAEEEFSNTTHETFNFTLHTTLGVTTKLVLPTPAKPILPVQTGEQAQQEEQSSGMTIFFSLLVLGILMGAVIKVIEFKKLANWKEEEMFRPNMFFLLLLPPIIFESGYSLHKGNFFQNIGSITLFAVFGTAISAFVVGGGIYFLGQADVISKLNMTDSFAFGSLISAVDPVATIAIFNALHVDPVLNMLVFGESILNDAVSIVLTNTAEGLTRKHMSDVSGWQTFSQALGYFLKMFFGSAALGTLTGLISALIDLRKTPSLEFGMMIIFAYLPYGLAEGISLSGIMAILFSGIVMSHYTHHNLSPVTQILMQQTLRTVAFLCETCVFAFLGLSIFSFPHKFEISFVIWCIVLVLFGRAVNIFPLSYLLNFFRDHKITPKMMFIMWFSGLRGAIPYALSLHLGLEPMEKRQLIGTTTIVIVLFTILLLGGSTMPLIRLVDIEDARARRRSKKDVNLSKTEKMGNAIESEHLSELTEEEYEAHYIRQQDLKGFMWLDAKYLNPFFTRRLTQEDLHHGRIQMKSLTNKWYEEVRQGPSGSEDDEQELF

SEQ ID NO: 22307 - protein, 250 aa, Buchnera aphidicola str. Sg (Schizaphis graminum)
MIKHKAQKILKKEPILSNFYQKSILNHKKLSHSLSCILSDKLSTSMISEKDIYNIFNKIYANNISIINSVVKDIKAASQRDPVVKHYLTPLLYLKGFHALEAYRLSHYLWNIKRYELSAYLQSRISTVFSVDIHPAASIGSGIMLDHATGIVIGEGVIIENDVSIFHSVTLGGTGSNTGKNRHPIIRKNVTIGAGAKILGNIEVGQGVKVGAGSIVLKNIPPFVTVVGVPAKIIKKIKNSNKNLFQKEKK

SEQ ID NO: 22308 - protein, 372 aa, Mus musculus
ARRSSEEAGEAAYPVPLPAAGTMGAGASAEEKHSRELEKKLKEDAEKDARTVKLLLLGAGESGKSTIVKQMKIIHQDGYSLEECLEFIAIIYGNTLQSILAIVRAMTTLNIQYGDSARQDDARKLMHMADTIEEGTMPKEMSDIIQRLWKDSGIQACFDRASEYQLNDSAGYYLSDLERLVTPGYVPTEQDVLRSRVKTTGIIETQFSFKDLNFRMFDVGGQRSERKKWIHCFEGVTCIIFIAALSAYDMVLVEDDEVNRMHESLHLFNSICNHRYFATTSIVLFLNKKDVFSEKIKKAHLSICFPDYDGPNTYEDAGNYIKVQFLELNMRRDVKEIYSHMTCATDTQNVKFVFDAVTDIIIKENLKDCGLF

SEQ ID NO: 22309 - protein, 820 aa, Mus musculus
MMLRWSGVWGFHPPRIFPSLLMVVALVGLLPVLRSHGLQHSPTASTIRGSEPPRERSIGDVTTAPSEPLHRPDDHNLTNLIIEHGGKPSRKAFPVLDIDYPHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLLYAVCLVGGEQINNIGLLDTLLFGSIISAVDPVAVLAVFEEIHINELLHILVFGESLLNDAVTVVLYHLFEEFASYDSVGISDIFLGFLSFFVVALGGVFVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHQWNWTFVISTLLFCLIARVLGVLVLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKAVTSDRILPALSKDKEEEIRKILRSNLQKTRQRLRSYNRHTLVADPYEEAWNQMLLRRQKARQLEQKITNYLTVPAHKLDSPTLSRARIGSDPLAYEPKADLPVITIDPASPQSPESVDLVNEELKGKVLGLNRGPRVTPEEEEEDEDGIIMIRSKEPSSPGTDDVFTPGSSDSPSSQRIQRCLSDPGPHPEPGEGEPFIPKGQ

SEQ ID NO: 22310 - protein, 260 aa, Lycopersicon esculentum
MAVVAPTAREENVYMAKLADRAESDEEMVEFMEKVSNSLGSEELTVEERNLLSVAYKNVIGARRASWRIISSIEQKEESRGNEEHVNSIREYRSKIENELSKICDGILKLLDSKLIPSATSGDSKVFYLKMKGDYHRYLAEFKTGAERKEAAESTLTAYKAAQDIASAELAPTHPIRLGLALNFSVFYYEILNSPDRACNLAKQAFDEAIAELDTLGEESYKDSTLIMQLLRDNLTLWTSDMQDDGADEIKEDPKPEEKN

SEQ ID NO: 22311 - protein, 359 aa, Homo sapiens
MTLESMMACCLSDEVKESKRINAEIEKQLRRDKRDARRELKLLLLGTGESGKSTFIKQMRIIHGAGYSEEDKRGFTKLVYQNIFTAMQAMIRAMETLKILYKYEQNKANALLIREVDVEKVTTFEHQYVSAIKTLWEDPGIQECYDRRREYQLSDSAKYYLTDVDRIATLGYLPTQQDVLRVRVPTTGIIEYPFDLENIIFRMVDVGGQRSERRKWIHCFENVTSIMFLVALSEYDQVLVESDNENRMEESKALFRTIITYPWFQNSSVILFLNKKDLLEDKILYSHLVDYFPEFDGPQRDAQAAREFILKMFVDLNPDSDKIIYSHFTCATDTENIRFVFAAVKDTILQLNLKEYNLV

SEQ ID NO: 22312 - protein, 309 aa, Bos taurus
KSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILSDVQLIKTGDKEGASEATLLNMLNISPFSFGLVIQQVFDNGSIYNPEVLDITEETLHSRFLEGVRNVASVCLQIGYPTVASVPHSIINGYKRVLALSVETDYTFPLAEKVKAFLADPSAFVAAAPVAAAPAAAPAATTAAPAKVEAKEESEESDEDMGFGLFD

SEQ ID NO: 22313 - protein, 217 aa, Oryza sativa (japonica cultivar-group)
MSKRSRTMWDMQEFVGSVDTARVLMLLAQQSQHGLLGGGGFAAGAQPVVVRGGAHDRVFECKTCNRQFPTFQALGGHRASHKRPRQQQQHALGGGAGADDVGLCLGRQPTPPRPQPAKPRVHECPVCGLEFPIGQALGGHMRRHRAEAEAAATTTTTTTKNGDVGKAAAVKACDGGGVCLDLNLTPSENRAKCRNVVGLGAGGQGVHKALAMLDCFL

SEQ ID NO: 22314 - protein, 438 aa, Chamaecyparis nootkatensis
MDPKGLLEFLAENRESGTVLREEVPAGLRLSVDPARLVLNALEGFYPLNQGNKTEHGLAARRRSCILLLECLVPLLGSDHPEVASDIKEQAKMIADDWKSKLADVDIDASNGNSLEAQAFLQLLATFGISSEYDADELCKLVLSVSRRKQTPELCQSLGLEEKLPGVMDTLINNGKQIEAVNFAFTCGLVDTYPPVPLLKAYLKEARKAAQVKSGNTSVAAQNEANARELFALKAVVKCIEEHNLESEYPSDTLRKRVLQLEKAKTDKKRSADGIKSQYKKPRTNTAGGYLPTASGIDRSGVFATANAADMSLYRSADRVQYPSSVLSANSYNLPVQSGYDRSSQGIYGTSSLPRSYAYSSDNLGSSALGSGSYNAASYNAGSYNAASYNGASYNGASNYSSYPGSGLPPVHPTSTRPTSAYTSSTYPTSNYPSSYLQ

SEQ ID NO: 22315 - protein, 221 aa, Drosophila yakuba
LKRWELCCQDCRRALDIDGNLLKGHFFLGQGLMEIDSFDEAIKHLQRAYDLSKEQKQNFGDDITLQLRLARKKRWNVMEEKRIQQEIELQSYLNRLIKGDMESRLANLKLNGNGQDEQLKDKQQEIEQECDDHIQELNNIFSKVDERRKKREVPDFLCGKISFEILTDPVITPSGITYERKDIEEHLQRVGHFDPVTRVKLTQDQLIPNFSMKEVVDSFIA

SEQ ID NO: 22316 - protein, 221 aa, Drosophila simulans
LKRWELCCQDCRRALDIDGNLLKGHFFLGQGLMEIDNFDEAIKHLQRAYDLSKEQKQNFGDDITLQLRLARKKRWNVMEEKRIQQEIELQSYLNGLIKGDMESRLANLKLNGSVLDEQLKDKQQEIEQECDDHIKELNNIFSKVDERRKKRDVPDFLCGKISFEILTDPVITPSGITYERKDIEEHLQRVGHFDPVTRVKLTQDQLIPNFSMKEVVDSFIA

SEQ ID NO: 22317 - protein, 221 aa, Drosophila simulans
LKRWELCCQDCRRALDIDGNLLKGHFFLGQGLMEIDNFDEAIKHLQRAYDLSKEQKQNFGDDITLQLRLARKKRWNVMEEKRIQQEIELQSYLNGLIKGDMESRLANLKLNGSVHDEQLKDKQQEIEQECDDHIKELNNIFSKVDERRKKRDVPDFLCGKISFEILTDPVITPSGITYERKDIEEHLQRVGHFDPVTRVKLTQDQLIPNFSTKEVVDSFIA

SEQ ID NO: 22318 - protein, 221 aa, Drosophila melanogaster
LKRWELCCQDSRRALDIDGNLLKGHFFLGQGLMEIDNFDEAIKHLQRAYDLSKEQKQNFGDDITLQLRLARKKRWNVMEEKRIQQEIELQSYLNGLIKGDMESRLANLKLNGNVHDEQLKDKQQEIEQECDDHIKELNNIFSKVDERRKKREVPDFLCGKISFEILTDPVITPSGITYERKDIEEHLQRVGHFDPVTRVKLTQDQLIPNFSMKEVVDSFIA

SEQ ID NO: 22319 - protein, 221 aa, Drosophila melanogaster
LKRWELCCQDSRRALDIDGNLLKGHFFLGQGLMEIDNFDEAIKHLQRAYDLSKEQKQNFGDDITLQLRLARKKRWNVMEEKRIQQEIELQSYLNGLIKGDMESRLANLKLNGNVHDEQLKDKQQEIEQECDDHIKELNNIFSKVDERRKKREVPDFLCGKISFEILTDPVITPSGITYERKDIEEHLQRVGHFDPVTRAKLTQDQLIPNFSMKEVVDSFIA

SEQ ID NO: 22320 - protein, 510 aa, Gossypium hirsutum
MPSFDTILLRDLVAAACLFFITRYFIRRLLSNPKRTLPPGPKGWPIVGALPLLGSMPHVELAKLAKKYGPVMYLKMGTCNMVVASTPDAARAFLKTLDLNFSNRPSNAGATHIAYNSQDMVFAEYGPRWKLLRKLSNLHMLGGKALEDWSQVRAVELGHMLRAMCESSRKGEPVVVPEMLTYAMANMIGQVILSRRVFVTKGSESNEFKDMVVELMTSAGLFNIGDFIPSIAWMDLQGIEGEMKKLHNRWDVLLTKMMKEHEETAYERKGKPDFLDIIMDNRENSAGERLSLTNVKALLLNLFTAGTDTSSSIIEWALAEILKNPKILNKAHEEMDKVIGRNRRLEESDIPKLPYLQAICKETFRKHPSTPLNLPRVSTQACEINGYYIPKNTRLSVNIWAIGRDPDVWGNPLDFTPERFLSGRFAKIDPRGNDFELIPFGAGRRICAGTRMGIVLVEYILGTLLHSFDWMLPPGTGELNMDEAFGLALQKAVPLSAMVRPRLAPTAYVS

SEQ ID NO: 22321 - protein, 1011 aa, Bos taurus
PVRSITRTFASGKTEKVIFQALKELGLPSGKNDEIEPAAFTYEKFYELTQKICPRTDIEDLFKKINGDKTDYLTVDQLVSFLNEHQRDPRLNEILFPFYDAKRAMQIIEMYEPDEDLKKQGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRPLPSPNDLKRKILIKKQTTETEVEKKQLEALKSMMEAGESAAPVNMLEDDNEEEIESAEQEEEAHPEYKYGNELSADDLGHKEAIANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNSGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALGAGLEAKKGIELIPQVRIEDLKQMKAYLKHLKKQQKELSSLKKKHAKEHSTMQKLHCTQVDKIVAQYDKEKLTHEKILEKAMKKKGGSNCLEMKKETEIKIQTLTSDHKSKVKEIVAQHTKEWSDMINTHSAEEQEIRDLLLSQQCELLRKLLISAHEQQTQQLKLSHDRESKEMRAHQAKISMENSKAISQDKSIKNKAERERRVRELNSSNTKKFLEERKRLAMKQSKEMDQLKKVQLEHLEFVEKQNEQAKEMQQMVKLEAEMDRRPATVV

SEQ ID NO: 22322 - protein, 547 aa, Capsicum annuum
MGRKEEGDDGVERSEGGVVLVNPKPRKGFSAKALDLLEKGIVKLVHDSSKPLHYLQGNFAPTDETPPLNDLLVHGHLPECLNGEFVRVGPNPKFAPVAGYHWFDGDGMIHGLRIKDGKATYVSRYVRTSRLKQEEFFGGAKFMKVGDLKGLFGLFTVYMQMLRAKLEVLDISYGNGTANTALAYHHGKLLALSEADKPYALKVLEDGDLQTLGMLDYDKRLTHSFTAHPKVDPVTGEMFTFGYSHDPPYITYRVISKDGIMQDPVPITIPEPIMMHDFAITENYAIMMDLPLCFRPKEMVKNNKLAFTFDATKKARFGVLARYANNEALIKWFELPNCFIFHNANAWEEGDEVVLITCRLMNPDLDLVNGAVKEKLENFCNELYEMRFNMKSGAASQKKLSESAVDFPRINENYTGRKQRYVYGTTLNSIAKVTGIIKFDLHAEPKTGKSQLEVGGNVQGIFDLGPGRFGSEAVFVPSQPDTECEEDDGFLIFFVHDENTGKSAVNVIDAKTMSAEPVAVVELPKRVPYGFHAFFVTEEQILEQAKL

SEQ ID NO: 22323 - protein, 907 aa, Bos taurus
MQIIEMYEPDEDLKKQGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRPLPSPNDLKRKILIKKQTTETEVEKKQLEALKSMMEAGESAAPVNMLEDDNEEEIESAEQEEEAHPEYKYGNELSADDLGHKEAIANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNSGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALGAGLEAKKGIELIPQVRIEDLKQMKAYLKHLKKQQKELSSLKKKHAKEHSTMQKLHCTQVDKIVAQYDKEKLTHEKILEKAMKKKGGSNCLEMKKETEIKIQTLTSDHKSKVKEIVAQHTKEWSDMINTHSAEEQEIRDLLLSQQCELLRKLLISAHEQQTQQLKLSHDRESKEMRAHQAKISMENSKAISQDKSIKNKAERERRVRELNSSNTKKFLEERKRLAMKQSKEMDQLKKVQLEHLEFVEKQNEQAKEMQQMVKLEAEMDRRPATVV

SEQ ID NO: 22324 - protein, 285 aa, Colwellia maris
MSQAMQLTLPQSGSIEAYMRSAYSIPMLTAEKEHNLATRLYNENDLSAAQELIMSHLRFVIHVAKGYSGYGLPHADLVQEGNVGLMKAVKRFNPEVGVRLVSFAVHWIKAEIHEYVLKNWRIVKVATTKAQRKLFFNLRKNKKRLGWFSTEEVNTVAENLGVTTKDVMEMESRMSSYDQAFELSKDDDDNLGASNFSPAQYLQDKQSDLAVEVENDNWDNHANKRLSTALVTLDERSQDIIKTRWLTEDKTTLQELANKYQISAERVRQLEKNALSKLKNTMVFD

SEQ ID NO: 22325 - protein, 919 aa, Bos taurus
MQIIEMYEPDEDLKKQGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRPLPSPNDLKRKILIKKQTTETEVEKKQLEALKSMMEAGESAAPVNMLEDDNEEEIESAEQEEEAHPEYKYGNELSADDLGHKEAIANSVKKASDDLEHENSKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNSGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALGAGLEAKKGIELIPQVRIEDLKQMKAYLKHLKKQQKELSSLKKKHAKEHSTMQKLHCTQVDKIVAQYDKEKLTHEKILEKAMKKKGGSNCLEMKKETEIKIQTLTSDHKSKVKEIVAQHTKEWSDMINTHSAEEQEIRDLLLSQQCELLRKLLISAHEQQTQQLKLSHDRESKEMRAHQAKISMENSKAISQDKSIKNKAERERRVRELNSSNTKKFLEERKRLAMKQSKEMDQLKKVQLEHLEFVEKQNEQAKEMQQMVKLEAEMDRRPATVV

SEQ ID NO: 22326 - protein, 518 aa, Mus musculus
MAALMSEISPGANSAPLPGHPNKVICERVRLQSLFPLLPSDQNTTIQEDAHFKAFFQSEDSPSPKRQRLSHSVFDYTSASPAPSPPMRPWEMTSNRQPPSVRPNQHHFSGERCNTPARNRRSPPVRRQRGRRERLSRHNSISQDENYHHLPYAQQQAIEEPRAFHPPNVSPRLLHPAAHPPQQNAVMVDIHDQLHQGTVPVSYTVTTVAPHGLPLCTGQHIPACSTQQVPGCSVVFSGQHLPVCSVPPPMLQACSVQHLPVPYAAFPPLISSDPFLIHPPHLSPHHPPHLPPPGQFVPFQTQQSRSPLQRIENEVELLGEHLQVGSFTYPPSAHPPTLPPSAPLQFLTHDPLHQEVSFGVPYPPFMPRRLTGRSRYRSQQPMPPPPYHPSLLPYVLSMLPVPPAVGPTFSFELDVEDGEVENYEALLNLAERLGEAKPRGLTKADIEQLPSYRFNPSNHQSEQTLCVVCMCDFESRQLLRVLPCNHEFHAKCVDKWLKGNRTCPICRADASEVHRDSE

SEQ ID NO: 22327 - protein, 357 aa, Caenorhabditis elegans
MGNCESRELVAQAKQNKIINTELDKAKKTDENIIKLLLLGAGESGKSTVLKQMKIIHNSGFSQEEISNKRNVVCANTVQAMGALLDGMKQLQFDFSTRVCNAHEKLIRETLNDKAEYGPFSDAMFNALTELWADKGVQCAYDKREFFYLHDSAKYFLDRIARVHTPNYVPTENDILHTRVPTMGVIEVNFTIKGKFFRVFDVGGQRSQRKKWIHCFDDAKAMIYVASLSEYDQVLLEDNTTNRMHESIQLFKQVINNKYFVNTSVILFLNKIDLFEEKIVTKKRSLGIAFESFSGPSQDLNAAVAFVEKKYRSMAENKEKNIYCHHTCATDTQQVQYVLDAVLDTILSTKLKGCGLY

SEQ ID NO: 22328 - protein, 316 aa, Mus musculus
MASHLELNNGTKMPTLGLGTWKSPPGQVTEAVKVAIDLGYRHIDCAQVYQNEKEVGVALQEKLKEQVVKRQDLFIVSKLWCTFHDKSMVKGAFQKTLSDLQLDYLDLYLIHWPTGFKPGPDYFPLDASGNVIPSDTDFVDTWTAMEQLVDEGLVKTIGVSNFNPLQIERILNKPGLKYKPAVNQIECHPYLTQEKLIEYCHSKGIVVTAYSPLGSPDRPWGKPEDPSLLEDPRIKAIAAKYNKTTAQVLIRFPIQRNLVVIPKSVTPVRIAENLKVFDFEVSSEDMATLLSYNRNWRVCALMSCAKHKDYPFHAEV

SEQ ID NO: 22329 - protein, 326 aa, Cyanidioschyzon merolae
MLHKLFMYEALREAIDEEMARDKRVFVLGEDVGHYGGSYKVTKQLHTKYGDLRVLDTPIAENSFTGMAIGAAMTGLKPVVEGMNLSFLLLAFNQISNNAGMLHYTSGGNWSIPLVIRGPGGIGKQLSAEHSQRIEAYFQAVPGLKIVACSTPYNAKGLLKAAIRDNNPVLFLEHVLLYNLKQEIPKQEYVLPLDKAQVVREGSDVTIITYSRMLHHVMQAVKQLVAQGMNPEVIDLISLKPIDLETLVTSVSKTHKAIIVEECMQTGGIAAEVMAQIYSHAFDELDAPIRRLSSKDVPTPYNGYLEQACLVQPTQIVEAVKTLMST

SEQ ID NO: 22330 - protein, 232 aa, Mus musculus
PELLGVMRRLWADPGAQACFGRSSEYHLEDNAAYYLNDLERIAAPDYIPTVEDILRSRDMTTGIVENKFTFKELTFKMVDVGGQRSERKKWIHCFEGVTAIIFCVELSGYDLKLYEDNQTSRMAESLRLFDSICNNNWFINTSLILFLNKKDLLAEKIRRIPLSVCFPEYKGQNTYEEAAVYIQRQFEDLNRNKETKEIYSHFTCATDTSNIQFVFDAVTDVIIQNNLKYIG

SEQ ID NO: 22331 - protein, 669 aa, Alternaria alternata
KANEAFQKALREIGAIVTAVAMGDLSKKVLIHAKEMDPEITLFKRTINTMVDQLQEFASQVTFLAREVGTEGRLGGQANLPGVAGIWAELTDSVNGMAKNLTDQVREIAVVTTAVAMGDLSRKIERPARGEILQLQQTINSMVDQLQSFATQVTKVARDVGTEGKLGGQAEIAGVKGMWNELTVNVNAMAQNLTTQVRDIAQVTTAVAQGNLTRKVEAECKGEILELKNTINRMVDQLQQFAHEVTKIAREVGSEGRLGGQATVHGVEGTWKDLTENVNGMAMNLTTQVREIAEVTTAVARGDLSRKVKAEVQGEILSLKITINTMVDRLNTFAQEVSKVAREVGTDGILGGQAQVDNVEGKWKDLTNNVNTMAQNLTLQVRSISEVTQAIAKGDMSRRVHVDAEGEIRLLKDTVNDMVMRLDEWSLAVKRVARDVGVDGKMGGQADVRDIDGRWKEITTDVNTMAQNLTSQVRAFGDITNAAMEGKFTQITVEASGEMDELKRKINQMVSSLRESIQRNTAAREAAELANKTKSEFLANMSHEIRTPMNGIIGMTQLTLDTDLTHAQREMLTIVHNLAGQLLTIIDDILDISKIEANRMVMEEIPFSMRGTIFNALKSLASRADERKLNLAYDVPYKVPDYVVGDSFRLRQIILNLVGNAIKFTELGE

SEQ ID NO: 22332 - protein, 833 aa, Cowpox virus
MNSLIENSVLHVRKLLYTIHFNDIDHAPTTATSRDCENQYDSYDIYVRSVFKNNLVLERKYYDIVYKLINSTISHTINYDDQTYDNDIKSLLEATTRFHRHYISSSRKKKSSIDSIEQMYSQIIKDITTELINDENVVINVNDLCLIDYDDNDDNDDKDDKDDNKDDKDDNKDDKDDDDDSDSDDSDDSDDDDDDDSDDSDDDDSDDSDDEDEDSRYENSDKYSSNIFSVYFKAHNTIGIDIKLVKWMITKGVDINYKNEYGSGILHTYLGNMYVDTDVLELLCRSGKNINEQNNHLITPLHSYLRRDESISASVLKKVIELGADRNLRCCMKLTPIMTYIIYNAMNIDEEIIKIYMDDNKITNIPEILYLYIQMAQYVDLDVIKHFLNNSVILDYKDSVGRTCLHNYMLRNYINIDVVKLLLEHGNYLNETDNLGNTVLHTYLSRLCIVNKNLTYDSSINNNINIEVVKYLIRSGSDISLVNNLGYTPLTSYICTAQNYMYHDIIDCLMSDKVLNMVKHRIIQDLITREDISLPIIHHVITKYNIPVDSYTDEYENCNYETNDVYHRQMIKYYNKNIVPFSGMTAFHVAVCLRKDAMKYLLSIGYSIDKPTIKGLTALMLIFHRDRYSNCHIVKMLLDNRPSIDNIIIFLDKCYKNESLFSLCSTKNTSLYEMMASAFMLIGVNNCNKFIEHIKHDLETRNTSNYRSLSQTLDVLVDIRDNISLLMSTYINNYSTISIYDILISRTYNNDITSCIEICKRYTSDKYPLCNIINGYIDNAIGTNSIVKDIIYYLRTYPDICIPTSLLRSCIIDMHDLSGFRDELLSKLQSHNK

SEQ ID NO: 22333 - protein, 210 aa, Cowpox virus
MATPSLSACSSIEDDFNYGSSVASASVHIRMAFLRKVYGILCLQFLLTTATTAVFLYFDCMRTFIQGSPVLILASMFGSIGLIFALTLHRHKHPLNLYLLCGFTLSESLTLASVVTFYDVHVVMQAFMLTTAAFLALTTYTLQSKRDFSKLGAGLFAALWILILSGLLRIFVQNETVELVMSAFGALVFCGFIIYDTHSLIHKLSLKSMC

SEQ ID NO: 22334 - protein, 379 aa, Nicotiana tabacum
MAIDCMITNVNSPMLRILEDDKKPLIFDASQMKREYNIPTQFIWPDDEKPRAVARELPVPLIDLGGFLSGDPVAAQQASRLVGEACRNHGFFLVVNHGVNANLISNAHRYMDMFFDLPLSEKQKAQRKLEEHCGYASSFTGRFSSKLPWKETLSFRYSAEEDSSHIVEEYFQNTMGESFSHLGNVYQEYCNSMSTLSLGIMELLGMSLGVGREHFKEFFEENESIMRLNYYPPCQKPDLTLGTGPHCDPTSLTILHQDSVGGLQVFVDNEWRSVSPNFNAFVVNIGDTFMALSNGRYKSCLHRAVVNNKTPRKSLAFFLCPKKDKVVSPPNELVDTNNPRIYPDFTWPTLLEFTQKHYRADMNTLQTFSNWLKQKTAQV

SEQ ID NO: 22335 - protein, 361 aa, Mus musculus
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKPQSNNKNSLVSPAQEPCALADGHGTTNHRGT

SEQ ID NO: 22336 - protein, 408 aa, Mus musculus
MISPEPPQPQLQPPPPPAPPNHVVTTIENLPAEGSGGVSLSASSRASMRQRIRKVLNREMLISVALGQVLSLLVCGIGLTSKYLAEDFHANTPVFQSFLNYILLFLVYTTTLAVRQGEENLLAILRRRWWKYMILGLIDLEANYLVVKAYQYTTLTSVQLLDCFVIPVVILLSWFFLLIRYKAVHFIGIVVCILGMGCMVGADVLVGRHQGAGENKLVGDLLVLGGATLYGISNVWEESIIRTLSRVEFLGMIGLFGAFFSGIQLAIMEHKELLKVPWDWQIGLLYVGFSACMFGLYSFMPVVIKKTSATSVNLSLLTADLYSLFCGLFLFHYKFSGLYLLSFFTILIGLVLYSSTSTYIAQDPRVYKQFRNPSGPVVDLPSTAQVEPSVTYTSLGQETEEEPHVRVA

SEQ ID NO: 22337 - protein, 270 aa, Mus musculus
MAVPHHLQETSYLLPPDPEDWEKQGIPDFVYGQEDLVGKEVQWPRDSPSAVDTVPLSRFDSALRSAWRQRLELGLFRYRLKDLQTQILPGSVGFLAQLNIERGIQRRRPQNIRSVRQEFDPEQFNFNKIRPGEVLFRMQREPKGPATPKQEDDVLVVINVSPLEWGHVLLVPAPAQGLPQRLLPGSSAGGVRSCPTELAPRLQGRLQQPGRPGLCEPSSPALLLPGPPTACGGSPKHTPRPQRLYTSAAGPAGSWLSLLHQWARARIWKC

SEQ ID NO: 22338 - protein, 197 aa, Raphanus sativus
MGRKKLEIKRIEKKSSRQVTFSKRRSGLIEKARQLSVLCDASVALLVVSSSGKLYSFSSGDNLVRILHRYEKQHADDLKALLDLQSKSLSYGSHNELLELVESKLVESNVGVSVDALVQLEGHLETALSLTRARKTELMLKLVDSLKEKEKLLKEENKVLASQMEKNNLAGAEADNMEIARAQISDINLPVTLPLLN

SEQ ID NO: 22339 - protein, 197 aa, Brassica oleracea var. capitata
MGRKKLEIKRIENKSSRQVTFSKRRSGLVEKARQLSVLCDASIALLVVSSSGKLYSFSAGDNLVRILDRYGKQHADDLKALDLQSKALSYGSHNELLELVDSKLVESNVGGVSVDTLVQLEGVLENALSLTRARKTELMLKLVDSLKEKEKLLKEENQALASQKEKKNLAGAEADNMEMSPGQISDINLPVTLPLLN

SEQ ID NO: 22340 - protein, 377 aa, Mus musculus
MAEFVSWSCLNFRWSWIKGSRNSGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALSKNIHESVSAQIRKNFAKSKWRQAFNATAVVRHMRRLQLGSSLDSSNASVSSNLSLASQKDCLAPSTLCSFLSSSSGVAGVGAERRPRPTTVTTGHTGSK

SEQ ID NO: 22341 - protein, 197 aa, Brassica rapa
MGRKKLEIKRIENKSSRQVTFSKRRSGLIEKARQLSVLCDASVALLVVSSSGKLYSFSAGDNLVRILDRYGKQHAGDLKALNLQSKALSYGSHNELLELVDSKLVESNVGGVSVDTLVQLEGVLENALSLTRARKTELMLKLVDSLKEKEKLLKEENQALAGQKEKKNLAGAEADNMEMSPGQISDINLPVTLPLLN

SEQ ID NO: 22342 - protein, 197 aa, Brassica rapa
MGRKKLEIKRIENKSSRQVTFSKRRSGLIEKARQLSVLCDASVALLVVSSSGKLYSFSAGDNLVRTLDRYGKQHAGDLKALNLQSKALSYGSHNELLELVDSKLVESNVGGVSVDTLVQLEGVLENALSLTRARKTELMLKLVDSLKEKEKLLKEENQALAGQKEKKNLAGAEADNMEMSPGQISDINLPVTLPLLN

SEQ ID NO: 22343 - protein, 197 aa, Brassica rapa
MGRKKLEIKRMENKSSRQVTFSKRRSGLIEKARQLSVLCDASVALLVVSSSGKLYSFSAGDNLVRILDRYGKQHAGDLKALNLQSKALSYGSHNELLELVDSKLVESNVGGVSVDTLVQLEGVLENALSLTRARKTELMLKLVDSLKEKEKLLKEENQALAGQKEKKNLAGAEADNMEMSPGQISDINLPVPLPLLN

SEQ ID NO: 22344 - protein, 441 aa, Zea mays subsp. mays
MEHVISMEEILGPFWELLPPPAPEPEPEREQPPVTGIVVGSVIDVAAAGHGHGGGDMMDQQHATEWTFERLLEEEALTTSTPPPVVVVPNSCCSGALNVDRPPVMEEAVMMAPAAVSSAVVGDPMEYNAILRRKLEEDLEAFKMWRAASSVVTSDQRSQGSNNHTGGSSIRNNPVQNKLMNGEDPINNNHTQTAGLGVRLATSSSSRDPSPSDEDMDGEVEILGFKMPTEERVRKRKESNRESARRSRYRKAAHLKELEDQVAQLKAENSCLLRRIAALNQKYNDANVDNRVLRADMETLRAKVKMGEDSLKRVIEMSSSVPSSMPISAPTPSSDAPVPPPPIRDSIVGYFSATAADDDASVGNGFLRLQAHQEPASMVVGGTLSATEMNRVAAATHCAGAMELIQTAMGSMPPTSASGSTPPPQDYELLGPNGAIHMDMY

SEQ ID NO: 22345 - protein, 210 aa, Lycopersicon esculentum
MAMVNLNGISKEVHYRGVRKRPWGRYAAEIRDPGKKSRVWLGTFDTAEEAARAYDNAAREFRGAKAKTNFPKLEMEKEEDLKFAVKNEINRSPSQTSTVESSSPVMVDSSSPLDLSLCGSIGGFNHHTVKFPSSGGGFTGSVQAVNHMYYIEALARAGVIKLETNRKKTVDYLGGGDSDSSTVIDFMRVDVKSTTAGLNLDLNFPPPENM

SEQ ID NO: 22346 - protein, 247 aa, Vitis vinifera
MGRGRVQLKRIENKISRQVTFSKRRSGLLKKAHEISVLCDAEVALIVFSTKGKLFEYSTDSSMERILERYERYSLSERQLLSTDPDPQGNWSMDYPKLTARIEVLQRNLRHFVGEDLDPLSLRELQNLELQLDTALKRIRTRKNQLMHESISELQKKEKSLVEQNNALAKKVKEKEKVEQNNRAQWEQQNNIGQNSSAYVVPPPPLQLPSLTMGGSFVGRAVEEDGAEARPSPNTLMPPWMLRHVNE

SEQ ID NO: 22347 - protein, 207 aa, Eucalyptus grandis
MARGKTKMRRIENATSRQVTFSKRRKGLLKKAYELSVLCEAEVAVIIFSQNGKLYEFSSNSEIRKTIDRYRRSTNVDTYQLCGRYILHLKQETMDMERKIELLEVSQQKLSGQCLGSCSINEIQEIGDQLEQSLSSIRKRKAQLFNDQIQQLQAKERHLKEENAKLLAKFLANPWQSTAHPRAAAINSRSSRGTDVETGLFIGLPES

SEQ ID NO: 22348 - protein, 210 aa, Eucalyptus grandis
MVRGKIQLRRIENTTSRQVTFSKRRNGLLKKAYELSVLCDAEVAVIIFSQKGRLYEFSSNSEIQKTIDRYRRSTYDMDTYKTNLDQCILHLKQETTDMERKIELLEVSLRKLSGECLGSCSIDEIQMIGDQLERSLSSIRARKAQLFDDQIQHLQAKERSLKEENAKLLAKCLANPGQSTAHPRAAALHSRSSRSTDVETGLFIGLPELN

SEQ ID NO: 22349 - protein, 485 aa, Burkholderia cepacia
MLKKSTTSSTANMCRVSVGSRSSSPLNNAVIAKVHEAGRAEVDAAVAAAQAALKGAWGRMSLAQRVEVLYAVADGINRRFDDFLAAEVEDTGKPMSLARHVDIPRGAANFKIFADVVKNVPTEFFEMPTPDGVGAINYAVRRPVGVVGVICPWNLPLLLMTWKVGPALACGNTVVVKPSEETPQTAALLGEVMNTAGVPPGVYNVVHGFGPNSTGEFLTSHPDVNAITFTGETGTGEAIMKAAADGARPVSLELGGKNAAIVFADCDLDKAIEGTLRSCFANCGQVCLGTERVYVERPIFDRFVSRLKKGAEGMQLGRPEDLATGMGPLISQEHREKVLSYYKKAVEAGATVVTGGGVPEMPEALKGGAWVQPTIWTGLGDDSVVAREEIFGPCALVMPFDSEEEVIRRANDNDYGLARRIWTTNLSRAHRVAGAIEVGIAWVNSWFLRDLRTAFGGSKQSGIGREGGVHSLEFYTELKNVCIKL

SEQ ID NO: 22350 - protein, 340 aa, Boea crassifolia
MGRAPCCDKTGLLMKKGPWSQEEDQKLLDYIQKYGYGNWRTLPTNAGLQRCGKSCRLRWTNYLRPDIKRGRFSFEEEETIIRLHSILGNKWSLIAARLPGRTDNEIKNYWNTNIRKRLLRMGIDPVTHSPRLQLLDLSTILNSSLCNNSPTQMNFSRLQPRFNPELLRFAASLFSSNCQSQDFPMQNQITSNNQIPPPFMQTSVQDVAVLPDLCADTNLGTSFSVHDEVQEFQQNPAGYGMPSALTGEYVPVLNDGYYGSGDQPFVDPTPSSVTSNFQSYCSNSLGFQSIFSTPPSSPTPLNSNSTYVNSCSSTEDETESYYNSMWKFEIPDNLRINDFM

SEQ ID NO: 22351 - protein, 422 aa, Mus musculus
MSLHFLYYCSEPTLDVKIAFCQGFDKHVDVSSIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 22352 - protein, 422 aa, Mus musculus
MSLHFLYYCSEPTLDVKIAFCQGFDKHVDVSSIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVKGTVLFPGTDHIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 22353 - protein, 464 aa, Mus musculus
MSLHFLYYCSEPTLDVKIAFCQGFDKHVDVSSIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVKGTVLFPGTDHIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 22354 - protein, 253 aa, Arabidopsis thaliana
MGRGRVELKRIENKINRQVTFSKRRTGLLKKAQEISVLCDAEVSLIVFSHKGKLFEYSSESCMEKVLERYERYSYAERQLIAPDSHVNTNWSMEYSRLKAKIELLERNQRHYLGEELEPMSLKDLQNLEQQLETALKHIRSRKNQLMNESLNHLQRKEKEIQEENSMLTKQIKERENILRTKQTQCEQLNRSVDDVPQPQPFQHPHLYMIAHQTSPFLNMGGLYQGEDQTAMRRNNLDLTLEPIYNYLGCYAA

SEQ ID NO: 22355 - protein, 285 aa, Neurospora crassa
MDDFVSESESDYASYWRDWFISSRGNEYFCEIDEDYITDRFNLTGLNTEVQYYQYALDLITDVFDLDCDDDMRETIEKSARHLYGLVHARYIVTTRGLQKMFEKYKKADFGKCPRVMCSSHPLLPMGLSDVPNSKPVKLYCARCEDIYNPKSSRHAAIDGAYFGTSFHNIFFQVYPTLVPAKSVERYIPRCYGFKVHAAAALVRWQNSQRDEMRRRLRKLEVESGFKDAEDEAELDDDDEEEEEEEEEEEELAAMDEAEGAQQQHAAAAAGTATGGVAAGGEGVH

SEQ ID NO: 22356 - protein, 336 aa, Neurospora crassa
MARVYADVNQNMPRAYWDYDSVNISWGVLENYEVVRKIGRGKYSEVFEGINVVNYQKCVIKVLKPVKKKKIKREIKILQNLAGGPNIVALLDVVRDSQSKTPSLIFEYVNNTEFRTLYPRFNDFDVRYYIFELLKALDFCHSKGIMHRDVKPHNVMIDHENRKLRLIDWGLAEFYHPGTEYNVRVASRYFKGPELLVDFQEYDYSLDMWSLGAMFASMIFRKEPFFHGQSNSDQLVKIAKVLGTDELFDYLDKYEIELDAQYDDILGRFQRKPWHSFINAENQRFVSNEAIDFLDKLLRYDHNERLTAKEAMAHPYFAPVRDEATRARYLAGETIN

SEQ ID NO: 22357 - protein, 517 aa, synthetic construct
MEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARHL

SEQ ID NO: 22358 - protein, 299 aa, synthetic construct
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRLL

SEQ ID NO: 22359 - protein, 324 aa, synthetic construct
MDSKHQCVKLNDGHFMPVLGFGTYAPPEVPRSKALEVTKLAIEAGFRHIDSAHLYNNEEQVGLAIRSKIADGSVKREDIFYTSKLWSTFHRPELVRPALENSLKKAQLDYVDLYLIHSPMSLKPGEELSPTDENGKVIFDIVDLCTTWEAMEKCKDAGLAKSIGVSNFNRRQLEMILNKPGLKYKPVCNQVECHPYFNRSKLLDFCKSKDIVLVAYSALGSQRDKRWVDPNSPVLLEDPVLCALAKKHKRTPALIALRYQLQRGVVVLAKSYNEQRIRQNVQVFEFQLTAEDMKAIDGLDRNLHYFNSDSFASHPNYPYSDEYL

SEQ ID NO: 22360 - protein, 497 aa, synthetic construct
MDRMKKIKRQLSMTLRGGRGIDKTNGAPEQIGLDESGGGGGSDPGEAPTRAAPGELRSARGPLSSAPEIVHEDLKMGSDGESDQASATSSDEVQSPVRVRMRNHPPRKISTEDINKRLSLPADIRLPEGYLEKLTLNSPIFDKPLSRRLRRVSLSEIGFGKLETYIKLDKLGEGTYATVYKGKSKLTDNLVALKEIRLEHEEGAPCTAIREVSLLKDLKHANIVTLHDIIHTEKSLTLVFEYLDKDLKQYLDDCGNIINMHNVKLFLFQLLRGLAYCHRQKVLHRDLKPQNLLINERGELKLADFGLARAKSIPTKTYSNEVVTLWYRPPDILLGSTDYSTQIDMWGVGCIFYEMATGRPLFPGSTVEEQLHFIFRILGTPTEETWPGILSNEEFKTYNYPKYRAEALLSHAPRLDSDGADLLTKLLQFEGRNRISAEDAMKHPFFLSLGERIHKLPDTTSIFALKEIQLQKEASLRSSSMPDSGRPAFRVVDTEFL

SEQ ID NO: 22361 - protein, 157 aa, synthetic construct
MSGGLLKALRSDSYVELSQYRDQHFRGDNEEQEKLLKKSCTLYVGNLSFYTTEEQIYELFSKSGDIKKIIMGLDKMKKTACGFCFVEYYSRADAENAMRYINGTRLDDRIIRTDWDAGFKEGRQYGRGRSGGQVRDEYRQDYDAGRGGYGKLAQNQL

SEQ ID NO: 22362 - protein, 449 aa, synthetic construct
MKGFIDDANYSVGLLDEGTNLGNVIDNYVYEHTLTGKNAFFVGDLGKIVKKHSQWQNVVAQIKPFYTVKCNSAPAVLEILAALGTGFACSSKNEMALVQELGVPPENIIYISPCKQVSQIKYAAKVGVNILTCDNEIELKKIARNHPNAKVLLHIATEDNIGGEEGNMKFGTTLKNCRHLLECAKELDVQIIGVKFHVSSACKESQVYVHALSDARCVFDMAGEIGFTMNMLDIGGGFTGTEFQLEEVNHVISPLLDIYFPEGSGVKIISEPGSYYVSSAFTLAVNIIAKKVVENDKFPSGVEKTGSDEPAFMYYMNDGVYGSFASKLSEDLNTIPEVHKKYKEDEPLFTSSLWGPSCDELDQIVESCLLPELNVGDWLIFDNMGADSFHEPSAFNDFQRPAIYYMMSFSDWYEMQDAGITSDSMMKNFFFVPSCIQLSQEDSFSAEAL

SEQ ID NO: 22363 - protein, 756 aa, synthetic construct
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLSFRFARRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKLL

SEQ ID NO: 22364 - protein, 433 aa, synthetic construct
MSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAMEGYEVTTMDEACQEGNIFVTTTGCIDIILGRHFEQMKDDAIVCNIGHFDVEIDVKWLNENAVEKVNIKPQVDRYRLKNGRRIILLAEGRLVNLGCAMGHPSFVMSNSFTNQVMAQIELWTHPDKYPVGVHFLPKKLDEAVAEAHLGKLNVKLTKLTEKQAQYLGMSCDGPFKPDHYRYL

SEQ ID NO: 22365 - protein, 298 aa, synthetic construct
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKML

SEQ ID NO: 22366 - protein, 361 aa, synthetic construct
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMESL

SEQ ID NO: 22367 - protein, 386 aa, synthetic construct
MTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIML

SEQ ID NO: 22368 - protein, 177 aa, synthetic construct
MASSSGNDDDLTIPRAAINKMIKETLPNVRVANDARELVVNCCTEFIHLISSEANEICNKSEKKTISPEHVIQALESLGFGSYISEVKEVLQECKTVALKRRKASSRLENLGIPEEELLRQQQELFAKARQQQAELAQQEWLQMQQAAQQAQLAAASASASNQAGSSQDEEDDDDIL

SEQ ID NO: 22369 - protein, 326 aa, synthetic construct
MAASCVLLHTGQKMPLIGLGTWKSEPGQVKAAVKYALSVGYRHIDCAAIYGNEPEIGEALKEDVGPGKAVPREELFVTSKLWNTKHHPEDVEPALRKTLADLQLEYLDLYLMHWPYAFERGDNPFPKNADGTICYDSTHYKETWKALEALVAKGLVQALGLSNFNSRQIDDILSVASVRPAVLQVECHPYLAQNELIAHCQARGLEVTAYSPLGSSDRAWRDPDEPVLLEEPVVLALAEKYGRSPAQILLRWQVQRKVICIPKSITPSRILQNIKVFDFTFSPEEMKQLNALNKNWRYIVPMLTVDGKRVPRDAGHPLYPFNDPYL

SEQ ID NO: 22370 - protein, 317 aa, synthetic construct
MATFVELSTKAKMPIVGLGTWKSPLGKVKEAVKVAIDAGYRHIDCAYVYQNEHEVGEAIQEKIQEKAVKREDLFIVSKLWPTFFERPLVRKAFEKTLKDLKLSYLDVYLIHWPQGFKSGDDLFPKDDKGNAIGGKATFLDAWEAMEELVDEGLVKALGVSNFSHFQIEKLLNKPGLKYKPVTNQVECHPYLTQEKLIQYCHSKGITVTAYSPLGSPDRPWAKPEDPSLLEDPKIKEIAAKHKKTAAQVLIRFHIQRNVIVIPKSVTPARIVENIQVFDFKLSDEEMATILSFNRNWRACNVLQSSHLEDYPFDAEYL

SEQ ID NO: 22371 - protein, 368 aa, synthetic construct
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLSKRLL

SEQ ID NO: 22372 - protein, 114 aa, synthetic construct
MSASVVSVISRFLEEYLSSTPQRLKLLDAYLLYILLTGALQFGYCLLVGTFPFNSFLSGFISCVGSFILAVCLRIQINPQNKADFQGISPERAFADFLFASTILHLVVMNFVGL

SEQ ID NO: 22373 - protein, 245 aa, synthetic construct
MELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWACL

SEQ ID NO: 22374 - protein, 430 aa, synthetic construct
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVDVAGPGGWNDPDMLVIGNFGLSWNQQVTQMALWAIMAAPLFMSNDLRHISPQAKALLQDKDVIAINQDPLGKQGYQLRQGDNFEVWERPLSGLAWAVAMINRQEIGGPRSYTIAVASLGKGVACNPACFITQLLPVKRKLGFYEWTSRLRSHINPTGTVLLQLENTMQMSLKDLLL

SEQ ID NO: 22375 - protein, 181 aa, synthetic construct
MAAAEEEDGGPEGPNRERGGAGATFECNICLETAREAVVSVCGHLYCWPCLHQWLETRPERQECPVCKAGISREKVVPLYGRGSQKPQDPRLKTPPRPQGQRPAPESRGGFQPFGDTGGFHFSFGVGAFPFGFFTTVFNAHEPFRRGTGVDLGQGHPASSWQDSLFLFLAIFFFFWLLSIL

SEQ ID NO: 22376 - protein, 256 aa, synthetic construct
MDDREDLVYQAKLAEQAERYDEMVESMKKVAGMDVELTVEERNLLSVAYKNVIGARRASWRIISSIEQKEENKGGEDKLKMIREYRQMVETELKLICCDILDVLDKHLIPAANTGESKVFYYKMKGDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEEQNKEALQDVEDENQL

SEQ ID NO: 22377 - protein, 346 aa, synthetic construct
MTSVRENILFGMGNPLLDISAVVDKDFLDKYSLKPNDQILAEDKHKELFDELVKKFKVEYHAGGSTQNSIKVAQWMIQQPHKAATFFGCIGIDKFGEILKRKAAEAHVDAHYYEQNEQPTGTCAACITGDNRSLIANLAAANCYKKEKHLDLEKNWMLVEKARVCYIAGFFLTVSPESVLKVAHHASENNRIFTLNLSAPFFSQFYKESLMKVMPYVDILFGNETEAATFAREQGFETKDIKEIAKKTQALPKMNSKRQRIVIFTQGRDDTIMATESEVTAFAVLDQDQKEIIDTNGAGDAFVGGFLSQLVSDKPLTECIRAGHYAASIIIRRTGCTFPEKPDFHL

SEQ ID NO: 22378 - protein, 355 aa, synthetic construct
MKENKENSSPSVTSANLDHTKPCWYWDKKDLAHTPSQLEGLDPATEARYRREGARFIFDVGTRLGLHYDTLATGIIYFHRFYMFHSFKQFPRYVTGACCLFLAGKVEETPKKCKDIIKTARSLLNDVQFGQFGDDPKEEVMVLERILLQTIKFDLQVEHPYQFLLKYAKQLKGDKNKIQKLVQMAWTFVNDSLCTTLSLQWEPEIIAVAVMYLAGRLCKFEIQEWTSKPMYRRWWEQFVQDVPVDVLEDICHQILDLYSQGKQQMPHHTPHQLQQPPSLQPTPQVPQVQQSQPSQSSEPSQPQQKDPLILLQGWACRQPATHLLPSPLEDSLLCPRPFPHPACLQLGGWGGQPGL

SEQ ID NO: 22379 - protein, 293 aa, synthetic construct
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKSFLFQLLKGLGFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPSMTKLPDYKPYPMYPATTSLVNVVPKLNATGRDLLQNLLKCNPVQRISAEEALQHPYFSDFCPPL

SEQ ID NO: 22380 - protein, 304 aa, synthetic construct
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHKRISAFRALQHSYLHKDEGNPEL

SEQ ID NO: 22381 - protein, 324 aa, synthetic construct
MDSKYQCVKLNDGHFMPVLGFGTYAPAEVPKSKALEAVKLAIEAGFHHIDSAHVYNNEEQVGLAIRSKIADGSVKREDIFYTSKLWSNSHRPELVRPALERSLKNLQLDYVDLYLIHFPVSVKPGEEVIPKDENGKILFDTVDLCATWEAMEKCKDAGLAKSIGVSNFNHRLLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEYL

SEQ ID NO: 22382 - protein, 473 aa, synthetic construct
MNKMKNFKRRFSLSVPRTETIEESLAEFTEQFNQLHNRRNENLQLGPLGRDPPQECSTFSPTDSGEEPGQLSPGVQFQRRQNQRRFSMEDVSKRLSLPMDIRLPQEFLQKLQMESPDLPKPLSRMSRRASLSDIGFGKLETYVKLDKLGEGTYATVFKGRSKLMENLVALKEIRLEHEEGAPCTAIREVSLLKNLKHANIVTLHDLIHTDRSLTLVFEYLDSDLKQYLDHCGNLMSMHNVKIFMFQLLRGLAYCHHRKILHRDLKPQNLLINERGELKLADFGLARAKSVPTKTYSNEVVTLWYRPPDVLLGSTEYSTPIDMWGVGCIHYEMATGRPLFPGSTVKEELHLIFRLLGTPTEETWPGVTAFSEFRTYSFPCYLPQPLINHAPRLDTDGIHLLSSLLLYESKSRMSAEAALSHSYFRSLGERVHQLEDTASIFSLKEIQLQKDPGYRGLAFQQPGRGKNRRQSIFL

SEQ ID NO: 22383 - protein, 356 aa, synthetic construct
MGCTVSAEDKAAAERSKMIDKNLREDGEKAAREVKLLLLGAVESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYTGANKYDEAASYIQSKFEDLNKRKDTKEIYTHFTCATDTKNVQFVFDAVTDVIIKNNLKDCGLFL

SEQ ID NO: 22384 - protein, 678 aa, synthetic construct
MESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPVAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDPL

SEQ ID NO: 22385 - protein, 234 aa, synthetic construct
MGEPQQVSALPPPPMQYIKEYTDENIQEGLAPKPPPPIKDSYMMFGNQFQCDDLIIRPLESQGIERLHPMQFDHKKELRKLNMSILINFLDLLDILIRSPGSIKREEKLEDLKLLFVHVHHLINEYRPHQARETLRVMMEVQKRQRLETAERFQKHLERVIEMIQNCLASLPDDLPHSEAGMRVKTEPMDADDSNNCTGQNEHQRENSGHRRDQIIEKDAALCVLIDEMNERPL

SEQ ID NO: 22386 - protein, 262 aa, synthetic construct
MASQLQNRLRSALALVTGAGSGIGRAVSVRLAGEGATVAACDLDRAAAQETVRLLGGPGSKEGPPRGNHAAFQADVSEARAARCLLEQVQACFSRPPSVVVSCAGITQDEFLLHMSEDDWDKVIAVNLKGTFLVTQAAAQALVSNGCRGSIINISSIVGKVGNVGQTNYAASKAGVIGLTQTAARELGRHGIRCNSVLPGFIATPMTQKVPQKVVDKITEMIPMGHLGDPEDVADVVAFLASEDSGYITGTSVEVTGGLFML

SEQ ID NO: 22387 - protein, 395 aa, synthetic construct
MGCLGNSKTEDQRNEEKAQREANKKIEKQLQKDKQVYRATHRLLLLGAGESGKSTIVKQMRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQADYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELLL

SEQ ID NO: 22388 - protein, 366 aa, synthetic construct
MSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAAKSYIQSLPQTPRKDFTQLFPRASPQAADLLEKMLELDVDKRLTAAQALTHPFFEPFRDPEEETEAQQPFDDSLEHEKLTVDEWKQHIYKEIVNFSPIARKDSRRRSGMKLL

SEQ ID NO: 22389 - protein, 173 aa, synthetic construct
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYATHNEL

SEQ ID NO: 22390 - protein, 324 aa, synthetic construct
MDSKYQCVKLNDGHFMPVLGFGTYAPAEVPKSKALEATKLAIEAGFRHIDSAHLYNNEEQVGLAIRSKIADGSVKREDIFYTSKLWCNSHRPELVRPALERSLKNLQLDYVDLYLIHFPVSVKPGEEVIPKDENGKILFDTVDLCATWEAVEKCKDAGLAKSIGVSNFNRRQLEMILNKPGLKYKPVCNQVECHPYFNQRKLLDFCKSKDIVLVAYSALGSHREEPWVDPNSPVLLEDPVLCALAKKHKRTPALIALRYQLQRGVVVLAKSYNEQRIRQNVQVFEFQLTSEEMKAIDGLNRNVRYLTLDIFAGPPNYPFSDEYL

SEQ ID NO: 22391 - protein, 346 aa, Cricetulus griseus
MENFQKVEKIGEGTYGVVYKAKNKLTGEVVALKKIRLDTETEGVPSTAIREISLLKELNHPNIVKLLDVIHTENKLYLVFEFLHQDLKKFMDASAVTGIPLPLIKSYLFQLLQGLAFCHSHRVLHRDLKPQNLLINAEGSIKLADFGLARAFGVPVRTYTHEVVTLWYRAPEILLGCKYYSTAVDIWSLGCIFAEMHLVCTQHHAKCCGEHRRNGRHSLCPLCSYLEVAASQGGGMTAVSTPYPVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 22392 - protein, 520 aa, Helianthus tuberosus
MEIPYLLTVVLLLLTTLYLLLFTTLLLLFTTLYLLLRRRRSSTLPPTIFPYLPIIGHLYLLKPPLYRTLAKLSAKHGPILRLQLGFRRVLIVSSPSAAEECFTKNDIVFANRPKMLFGKIIGVNYTSLAWSPYGDNWRNLRRIASIEILSIHRLNEFHDIRVEETRLLIQKLLSACNSGSSQVTMKFSFYELTLNVMMRMISGKRYFGGDNPELEEEGKRFRDMLDETFVLAGASNVGDYLPVLSWLGVKGLEKKLIKLQEKRDVFFQGLIDQLRKSKGTEDVNKKKTMIELLLSLQETEPEYYTDAMIRSFVLVLLAAGSDTSAGTMEWVMSLLLNHPQVLKKAQNEIDSVIGKNCLVDESDIPNLPYLRCIINETLRLYPAGPLLVPHEASSDCVVGGYNVPRGTILIVNQWAIHHDPKVWDEPETFKPERFEGLEGTRDGFKLLPFGSGRRSCPGEGLAVRMLGMTLGSIIQCFDWERTSEELVDMTEGPGLTMPKAIPLVAKCKPRVEMTNLLSEL

SEQ ID NO: 22393 - protein, 251 aa, Streptomyces kasugaensis
LQRGLVDNLRADVMVCGSQAYRRWALDAGFTDDDIHVVEFGTDLDRFRDDGAARARWRNRHGVADDETVFLVPARPVPRKCIEDAVAALAHLAGRHPRARLVLTTPTARTLDSYAEKLRALADELGVADRVIWEQGLSWHDMPMLYAGADAVVLPSSHEGFGIALVEGMAGRRPVITSNVEGHDEVIDHERTGFLYPARDVEALAGCMARVITSDLENLVAAAHAEAVRPFSSTAVAAGHERAYEVACGQR

SEQ ID NO: 22394 - protein, 563 aa, Oryzias latipes
MDIGGLTTVVANSAYISARGSFDGTANPAANRDKKFHSRLKLPHITVCEGLRETLDLGFQTVCVEQPIGKRLFQEFLDSINEYKGPSRLWKDIEEYNMAEDEDRAKKASKILSRYMEPDAKHYCPFLPENGITKVKEKHKEAGDELFSETMDSVMDFLKEVPYTFFLESMYLKRFLQWKWLEMQPIGEDWFLDFRVLGKGGFGEVSACQMRATGKLYACKKLNKKRLKKRKGYEGAMVEKRILARVHSRFIVSLAYAFQSKTELCLVMTIMNGGDLRYHIYNVDENNPGFDEPRACYYAAQIIQGLEHLHQKRIIYRDLKPENVLLDNEGHVRISDLGLAVELADDQFKIKGYAGTPGFMAPELLNGEEYDYCVDYFTLGVTLYEFLAAKGPFRTRGEKVENKVVKKRILNDPVTYPEKFSENGKSICEGLLCKEADKRLGFKNGSCDELRTHPFFSQINWRKLNAGILPPPFVPDSKTVYAKDLDDVGAFSTVKGVQLEDVDTVFFDEFASGNIAIPWQEEMIETGIYGELTVWGPGGALPNDLRRESILEQPPKSSTCCAS

SEQ ID NO: 22395 - protein, 372 aa, Bacillus sp.
MAEKPLRPLAEGELSIDQVKEQLVELGKKRGVLTYAEITEKLAPYDQDSDQMDEFFEYLGEQGVEILNDNEEVPSLQQVEKEEEEFDLNDLSVPPGVKINDPVRMYLKEIGRVPLLTAEEEIELATRIEQGDEEAKRRLAEANLRLVVSIAKRYVGRGMLFLDLIQEGNMGLIKAVEKFDYNKGFKFSTYATWWIRQAITRAIADQARTIRIPVHMVETINKLIRVQRQLLQDVGREPSPEEVAEEMDLTPEKVREILKIAQEPVSLETPIGEEDDSHLGDFIEDQDALAPSDAAAYELLKEQLEDVLDTLTDREENVLRLRFGLDDGRTRTLEEVGKVFGVTRERIRQIEAKALRKLRHPSRSKRLKDFLE

SEQ ID NO: 22396 - protein, 955 aa, Flaveria brownii
MSSLFVEGMLLKSANESCLPASVKQRRIGDLRRLNHHRQPAFVRGICRRKLSGVSRIELRTGGLTLPRAVLNPVSPPVTTTKKRVFTFGKGNSEGNKDMKSLLGGKGANLAEMASIGLSVPPGLTISTEACEEYQQNGKKLPPGLWDEILEGLQYVQKEMSASLGDPSKALLLSVRSGAAISMPGMMDTVLNLGLNDEVVDGLAGKSGARFAYDSYRRFLDMFGNVVMGIPHSLFDEKLEQMKAEKGIHLDTDLTAADLKDLVEQYKNVYVEAKGEKFPTDPKKQLELAVNAVFDSWDSPRANKYRSINQITGLKGTAVNIQCMVFGNMGNTSGTGVLFTRNPSTGEKKLYGEFLVNAQGEDVVAGIRTPEDLVTMETCMPEAYRELVENCVILERHYKDMMDIEFTVQENRLWMLQCRTGKRTGKGAVRIAVDMVNEGLIDTRTAIKRVETQHLDQLLHPQFENPSAYKSHVVATGLPASPGAAVGQVVFSAEDAETWHAQGKSAILVRTETSPEDVGGMHAAAGILTARGGMTSHAAVVARGWGKCCVSGCADIRVNDDMKVFTIGDRVIKEGDWLSLNGSTGEVILGKQLLAPPAMSNDLETFMSWADQARRLKVMANADTPNDALTARNNGAQGIGLCRTEHMFFASDERIKAVRKMIMAVTPEQRKAALDLLLPYQRSSFEGIFRAMDGLPVTIRLLDPPLHEFLPEGDLEHIVNELTADTGMSKDEIYSRIEKLSEVNPMLGFRGCRLGISYPELTEMQVRAIFQAAVSMNNQGVTVIPEIMVPLVGTPQELRHQIGVIRGVAANVFAEMGLTLEYKVGTMIEIPRAALIADEIAKEAEFFSFGTNDLTQMTFGYSRDDVGKFLPIYLSQGILQHDPFEVLDQKGVGQLIKMATEKGRAANPNLKVGICGEHGGEPSSVAFFDGVGLDYVSCSPFRVPIARLAAAQVVV

SEQ ID NO: 22397 - protein, 246 aa, Mus musculus
MTMDKSELVHKAKLAEQAERYDDMAAAMKAVTEQGHELSNEERNLLSVAYKNVVGARRSSWRVISSIEQKTERDEKKQQMGKEYREKIEAELQDICNDVLELLDKYLILNATQAESKVFYLKMKGDYFRYLSEVASGENKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 22398 - protein, 247 aa, Mus musculus
MVDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESFEKAYSEAHEISKEHMQPTHPIRLGLALNYSVFYYEIQNAPEQACHLAKTAFDDAIAELDTLNEDSYKDSTLIMQLLRDNLTLWTSDQQDDDGGEGNN

SEQ ID NO: 22399 - protein, 1080 aa, Arabidopsis thaliana
MRRDFVYNNNAMFNPLTTHYSSDMNWALNNHQEEEEEPRRIEISDSESLENLKSSDFYQLGGGGALNSSEKPRKIDFWRSGLMGFAKMQQQQQLQHSVAVKMNNNNNNDLMGNKKGSTFIQEHRALLPKALILWIIIVGFISSGIYQWMDDANKIRREEVLVSMCDQRARMLQDQFSVSVNHVHALAILVSTFHYHKNPSAIDQETFAEYTARTAFERPLLSGVAYAEKVVNFEREMFERQHNWVIKTMDRGEPSPVRDEYAPVIFSQDSVSYLESLDMMSGEEDRENILRARETGKAVLTSPFRLLETHHLGVVLTFPVYKSSLPENPTVEERIAATAGYLGGAFDVESLVENLLGQLAGNQAIVVHVYDITNASDPLVMYGNQDEEADRSLSHESKLDFGDPFRKHKMICRYHQKAPIPLNVLTTVPLFFAIGFLVGYILYGAAMHIVKVEDDFHEMQELKVRAEAADVAKSQFLATVSHEIRTPMNGILGMLAMLLDTELSSTQRDYAQTAQVCGKALIALINEVLDRAKIEAGKLELESVPFDIRSILDDVLSLFSEESRNKSIELAVFVSDKVPEIVKGDSGRFRQIIINLVGNSVKFTEKGHIFVKVHLAEQSKDESEPKNALNGGVSEEMIVVSKQSSYNTLSGYEAADGRNSWDSFKHLVSEEQSLSEFDISSNVRLMVSIEDTGIGIPLVAQGRVFMPFMQADSSTSRNYGGTGIGLSISKCLVELMRGQINFISRPHIGSTFWFTAVLEKCDKCSAINHMKKPNVEHLPSTFKGMKAIVVDAKPVRAAVTRYHMKRLGINVDVVTSLKTAVVAAAAFERNGSPLPTKPQLDMILVEKDSWISTEDNDSEIRLLNSRTNGNVHHKSPKLALFATNITNSEFDRAKSAGFADTVIMKPLRASMIGACLQQVLELRKTRQQHPEGSSPATLKSLLTGKKILVVDDNIVNRRVAAGALKKFGAEVVCAESGQVALGLLQIPHTFDACFMDIQMPQMDGFEATRQIRMMEKETKEKTNLEWHLPILAMTADVIHATYEECLKSGMDGYVSKPFEEENLYKSVAKSFKPNPISPSS

SEQ ID NO: 22400 - protein, 257 aa, Arabidopsis thaliana
MGRGKVELKRIENKINRQVTFAKRRNGLLKKAYELSVLCDAEIALLIFSNRGKLYEFCSSPSGMARTVDKYRKHSYATMDPNQSAKDLQDKYQDYLKLKSRVEILQHSQRHLLGEELSEMDVNELEHLERQVDASLRQIRSTKARSMLDQLSDLKTKEEMLLETNRDLRRKLEDSDAALTQSFWGSSAAEQQQQHQQQQQGMSSYQSNPPIQEAGFFKPLQGNVALQMSHYNHNPANATNSATTSQNVNGFFPGWMV

SEQ ID NO: 22401 - protein, 367 aa, Arabidopsis thaliana; identical to SEQ ID NO: 827

SEQ ID NO: 22402 - protein, 343 aa, Arabidopsis thaliana
MGFIDGKWAPMIVLIVSNMIAGMVNALVKKVLDGGINHMVIATYRLGISTLFLLPVAYFWERKTRPKLTLSISCQLFVSALFGASLMQYFYLLGLSYTSATLGSAFWAIMPSLTFVMALIFGFEKLSLKTKIGYGVVLGTLISLVGGLLLTMYQGIPLTNSPEQAANSNNHTGHENWIKGCFFLLTGVVLFSSWMLIQAKINVKYPCPYSSTVILSVFGTLQCALLSLIKTRHLEDWILRDELTIITVVIAGVVAQGMCTVGMSWCIKQQGPVVSSSFSPVVLMSATVFDFLILHREIYLGRSKQIVECKIMKLPTNTVEEEKEEEGRTNVNNGQLLVIPMTP

SEQ ID NO: 22403 - protein, 280 aa, Arabidopsis thaliana
MADHARALVKANNLDHIVEVIEGSVEDISLPEKVDVIISEWMGYFLLRESMFDSVISARDRWLKPTGVMYPSHARMWLAPIKSNIADRKRNDFDGAMADWHNFSDEIKSYYGVDMGVLTKPFAEEQEKYYIQTAMWNDLNPQQIIGTPTIVKEMDCLTASVSEIEEVRSNVTSVINMEHTRLCGFGGWFDVQFSGRKEDPAQQEIELTTAPSEQHCTHWGQQVFIMSNPINVEEGDNLNLGLLMSRSKENHRLMEIELNCEIKEASGNPKESFKKTYFIE

SEQ ID NO: 22404 - protein, 425 aa, Arabidopsis thaliana
MGLGNKGNKFNFGDNDLADEASGADGDEGDGFGSVACSICLETVVKNGDRAWANLQCDHQFHLDCIGSAFNAKGVMQCPNCRKVEKGQWLYANGCRSYPEFNVEDWVHEEDIYDIGAYSEMSFGVHWCPFGSSARLPSFEDGEFSPSSYHDLLGQQGYYTEPAAPTAGHPCPYVTYFGPVHSPSSSSGGAAGVSDSSSFSSHWNTGSSVSGEVPTPYGFPVDPHYHGWDYHPPPPPPPQHFSASGAHVGSPTQPTPPPAAARTSRANGSDMIRPRPPHFTRPFHGHSSSGRAGSSVASVPRTPPFPGSNARTRDRMQALQAYYQQSSAQSHQPDSPIVSRGPVFPSGRRPARGIASGMGSTSSSSDQAGGSGFIRFNIWERDPYMQSQQAYSVNQMDREPNIWTSSFNEGSGSFHQRHGGGGGSS

SEQ ID NO: 22405 - protein, 177 aa, Arabidopsis thaliana
MKIQCDVCEKAPATVICCADEAALCPQCDIEIHAANKLASKHQRLHLNSLSTKFPRCDICQEKAAFIFCVEDRALLCRDCDESIHVANSRSANHQRFLATGIKVALTSTICSKEIEKNQPEPSNNQQKANQIPAKSTSQQQQQPSSATPLPWAVDDFFHFSDIESTDKVVMRIEIQC

SEQ ID NO: 22406 - protein, 544 aa, Arabidopsis thaliana
MGNSCRGSFKDKIYEGNHSRPEENSKSTTTTVSSVHSPTTDQDFSKQNTNPALVIPVKEPIMRRNVDNQSYYVLGHKTPNIRDLYTLSRKLGQGQFGTTYLCTDIATGVDYACKSISKRKLISKEDVEDVRREIQIMHHLAGHKNIVTIKGAYEDPLYVHIVMELCAGGELFDRIIHRGHYSERKAAELTKIIVGVVEACHSLGVMHRDLKPENFLLVNKDDDFSLKAIDFGLSVFFKPGQIFKDVVGSPYYVAPEVLLKHYGPEADVWTAGVILYILLSGVPPFWAETQQGIFDAVLKGYIDFDTDPWPVISDSAKDLIRKMLCSSPSERLTAHEVLRHPWICENGVAPDRALDPAVLSRLKQFSAMNKLKKMALKVIAESLSEEEIAGLRAMFEAMDTDNSGAITFDELKAGLRRYGSTLKDTEIRDLMEAADVDNSGTIDYSEFIAATIHLNKLEREEHLVSAFQYFDKDGSGYITIDELQQSCIEHGMTDVFLEDIIKEVDQDNDGRIDYEEFVAMMQKGNAGVGRRTMKNSLNISMRDV

SEQ ID NO: 22407 - protein, 534 aa, Arabidopsis thaliana
MEVSSVKKLEQLEYSLESVTDLSSSSVSSSSPAVATFSYVDGVTELRFLQSDSTHCFNFDLASAQLFKLGPVHFICVSDGSSSSEEKSFSKGVNIKFKNEKDSKDFCESFEEWRNDSVVQGSSLQNGTVSANKSKFDNKIEASSAKMYFHYYGQLLHQQNMLQDYVRTGTYYAAVMENHSDFAGRVVVDVGAGSGILSMFAAQAGAKHVYAVEASEMAEYARKLIAGNPLFADRITVIKGKVEDIELPEKADILISEPMGTLLVNERMLESYVIARDRFMTPKGKMFPTVGRIHMAPFSDEFLFIEMANKAMFWQQQNYYGVDLTPLYGSAHQGYFSQPVVDAFDPRLLVASPMFHMIDFTQMKEEDFYEIDIPLKFTASMCTRMHGLACWFDVLFDGSTVQRWLTTAPGAPTTHWYQIRCVLSQPIYVMAGQEITGRLHLIAHSAQSYTIDLTLSAKMWGPGASQGGILQSSTCKFDLKEPYYRMSQPQAYPVAQEPPLQPQPELSTQDIQTPNDELEEELLQQLPQNPSAQL

SEQ ID NO: 22408 - protein, 535 aa, Arabidopsis thaliana
MEVSSVKKLEQLEYSLESVTDLSSSSVSSSSPAVATFSYVDGVTELRFLQSDSTHCFNFDLASAQLFKLGPVHFICVSDGSSSSEEKSFSKGVNIKFKNEKDSKDFCESFEEWRNDSVVQGSSLQNGTVSANKSKFDNKIEASSAKMYFHYYGQLLHQQNMLQDYVRTGTYYAAVMENHSDFAGRVVVDVGAGSGILSMFAAQAGAKHVYAVEASEMAEYARKLIAGNPLFADRITVIKGKVEDIELPEKADILISEPMGTLLVNERMLESYVIARDRFMTPKGKMFPTVGRIHMAPFSDEFLFIEMANKAMFWQQQNYYGVDLTPLYGSAHQGYFSQPVVDAFDPRLLVASPMFHMIDFTQMKEEDFYEIDIPLKFTASMCTRMHGLACWFDVLFDGSTVQRWLTTAPGAPTTHWYQIRCVLSQPIYVMAGQEITGRLHLIAHSAQSYTIDLTLSAKMWGPGASQGGILQSSTCKFDLKEPYYRMSQPQAYPVAQEPPLQPQPELSTQQDIQTPNDELEEELLQQLPQNPSAQL

SEQ ID NO: 22409 - protein, 241 aa, Arabidopsis thaliana; identical to SEQ ID NO: 624

SEQ ID NO: 22410 - protein, 394 aa, Arabidopsis thaliana
MSLKSILRDLKEVRDGLGGISKRSWSKSSHIAPDQTTPPLDNIPQSPWASLPPELLHDIIWRVEESETAWPARAAVVSCASVCKSWRGITMEIVRIPEQCGKLTFPISLKQPGPRDSPIQCFIKRNRATATYILYYGLMPSETENDKLLLAARRIRRATCTDFIISLSAKNFSRSSSTYVGKLRSGFLGTKFTIYDNQTASSTAQAQPNRRLHPKQAAPKLPTNSSTVGNITYELNVLRTRGPRRMHCAMDSIPLSSVIAEPSVVQGIEEEVSSSPSPKGETITTDKEIPDNSPSLRDQPLVLKNKSPRWHEQLQCWCLNFKGRVTVASVKNFQLVAEIDASLDAPPEEHERVILQFGKIGKDIFTMDYRYPLSAFQAFAICISSFDTKPACEG

SEQ ID NO: 22411 - protein, 601 aa, Arabidopsis thaliana
MQNQMEWDSDSDLSGGDEVAEDGWFGGDNGAIPFPVGSLPGTAPCGFVVSDALEPDNPIIYVNTVFEIVTGYRAEEVIGPFTKRRHPMVDSTIVAKMRQCLENGIEFQGELLNFRKDGSPLMNKLRLVPIREEDEITHFIGVLLFTDAKIDLGPSPDLSAKEIPRISRSFTSALPIGERNVSRGLCGIFELSDEVIAIKILSQLTPGDIASVGCVCRRLNELTKNDDVWRMVCQNTWGTEATRVLESVPGAKRIGWVRLAREFTTHEATAWRKFSVGGTVEPSRCNFSACAVGNRIVIFGGEGVNMQPMNDTFVLDLGSSSPEWKSVLVSSPPPGRWGHTLSCVNGSRLVVFGGYGSHGLLNDVFLLDLDADPPSWREVSGLAPPIPRSWHSSCTLDGTKLIVSGGCADSGALLSDTFLLDLSMDIPAWREIPVPWTPPSRLGHTLTVYGDRKILMFGGLAKNGTLRFRSNDVYTMDLSEDEPSWRPVIGYGSSLPGGMAAPPPRLDHVAISLPGGRILIFGGSVAGLDSASQLYLLDPNEEKPAWRILNVQGGPPRFAWGHTTCVVGGTRLVVLGGQTGEEWMLNEAHELLLATSTTAST

SEQ ID NO: 22412 - protein, 611 aa, Arabidopsis thaliana
MQNQMEWDSDSDLSGGDEVAEDGWFGGDNGAIPFPVGSLPGTAPCGFVVSDALEPDNPIIYVNTVFEIVTGYRAEEVIGRNCRFLQCRGPFTKRRHPMVDSTIVAKMRQCLENGIEFQGELLNFRKDGSPLMNKLRLVPIREEDEITHFIGVLLFTDAKIDLGPSPDLSAKEIPRISRSFTSALPIGERNVSRGLCGIFELSDEVIAIKILSQLTPGDIASVGCVCRRLNELTKNDDVWRMVCQNTWGTEATRVLESVPGAKRIGWVRLAREFTTHEATAWRKFSVGGTVEPSRCNFSACAVGNRIVIFGGEGVNMQPMNDTFVLDLGSSSPEWKSVLVSSPPPGRWGHTLSCVNGSRLVVFGGYGSHGLLNDVFLLDLDADPPSWREVSGLAPPIPRSWHSSCTLDGTKLIVSGGCADSGALLSDTFLLDLSMDIPAWREIPVPWTPPSRLGHTLTVYGDRKILMFGGLAKNGTLRFRSNDVYTMDLSEDEPSWRPVIGYGSSLPGGMAAPPPRLDHVAISLPGGRILIFGGSVAGLDSASQLYLLDPNEEKPAWRILNVQGGPPRFAWGHTTCVVGGTRLVVLGGQTGEEWMLNEAHELLLATSTTAST

SEQ ID NO: 22413 - protein, 373 aa, Arabidopsis thaliana
MKGGKMDKLKPIIAIISLQFGYAGMYIITMVSFKHGMNHWILATYRHVVATIVIAPFALILERKIRPKMTWPLFLRILALGFLEPLLDQNLYYIGMKATSATYSSAFVNALPAITFIMAVIFRIETVNLKKTRSLAKVIGTAITVGGAMVMTLYKGPAIELFKTAHSSLHGGSSGTSSETTDQNWVTGTLAVMGSITTWAGFFILQSFTLKKYPAELSLVMWICAMGTVLNTIASLIMVRDVSAWKVGMDSGTLAAVYSGVVCSGMAYYIQSIVIRERGPVFTTSFSPMCMIITAFLGVLVLAEKIHLGSIIGAIFIVFGLYSVVWGKAKDEVISVEEKIGMQELPITNTSTKVEGGGITSEVNEGVTNNTQV

SEQ ID NO: 22414 - protein, 469 aa, Arabidopsis thaliana
MAARIRLDAVISTIVTVHPHELPALLHSSSCFFFILSAYFVVLPLRDEGAISLGLSKLPGLFVGSLFLTLIAAPLSTFIFSLPNLSKSKALVIIHRFFSLSLVLCFLLWMASPTESNSKDAVEAASGLTNDGANAATGWDNHGWFYISVRVGFFLWVALLNLVAISSTWARIIDVMDIQSGARLFGFVGAGATLGQLFGSVFAAATAWMGPYLLLFAALLMEFAAQSSKGITNDISQSSEELSPLRGTDNDHQRERKQEATSPKVGSPKVASPKSPISTTRPQFWAILDGMRLILASPYLLLVSLFLWLGAVISSFFYFQKVNIIATTIKSSIGRRRLFAQINSFVAVFILIGQLTLTGRILTVAGVTVAISASPFVALGNLVAIAIWPTWVTVAVSETLRKVTTYVVTRPGRELLFTVVSQDEKYKAKVCIDVIVQRLGDAAAAGLFEVLTIALGGQTSTASLYALPV

SEQ ID NO: 22415 - protein, 511 aa, Arabidopsis thaliana
MAARIRLDAVISTIVTVHPHELPALLHSSSCFFFILSAYFVVLPLRDEGAISLGLSKLPGLFVGSLFLTLIAAPLSTFIFSLPNLSKSKALVIIHRFFSLSLVLCFLLWMASPTESNSKDAVEAASGLTNDGANAATGWDNHGWFYISVRVGFFLWVALLNLVAISSTWARIIDVMDIQSGARLFGFVGAGATLGQLFGSVFAAATAWMGPYLLLFAALLMEFAAQSSKGITNDISQSSEELSPLRGTDNDHQRERKQEATSPKVGSPKVASPKSPISTTRPQFWAILDGMRLILASPYLLLVSLFLWLGAVISSFFYFQKVNIIATTIKSSIGRRRLFAQINSFVAVFILIGQLTLTGRILTVAGVTVAISASPFVALGNLVAIAIWPTWVTVAVSETLRKVTTYVVTRPGRELLFTVVSQDEKYKAKVCIDVIVQRLGDAAAAGLFEVLTIALGGQTSTASLYALPVCLIWIVTAFFLGRRQEQLAKLQELWENNLNPTDMKMKDHKAE

SEQ ID NO: 22416 - protein, 397 aa, Arabidopsis thaliana
MIPNDDDDANSMKNYPLNDDDANSMKNYPLNDDDANSMENYPLRSIPTELSHTCSLIPPSLPNPSEAAADMSFNSELNQIMARPCDMLPANGGAVGHNPFLEPGFNCPETTDWIPSPLPHIYFPSGSPNLIMEDGVIDEIHKQSDLPLWYDDLITTDEDPLMSSILGDLLLDTNFNSASKVQQPSMQSQIQQPQAVLQQPSSCVELRPLDRTVSSNSNNNSNSNNAAAAAKGRMRWTPELHEVFVDAVNQLGGSNEATPKGVLKHMKVEGLTIFHVKSHLQKYRTAKYIPVPSEGSPEARLTPLEQITSDDTKRGIDITETLRIQMEHQKKLHEQLESLRTMQLRIEEQGKALLMMIEKQNMGFGGPEQGEKTSAKTPENGSEESESPRPKRPRNEE

SEQ ID NO: 22417 - protein, 309 aa, Arabidopsis thaliana
MKMATNGRFFTIGLVASWYSSNIGVLLLNKYLLSNYGFKYPIFLTMCHMTACSLLSYVAIAWLKMVPMQTIRSRVQFFKIAALSLVFCVSVVFGNISLRFLPVSFNQAIGATTPFFTAVFAYLMTRKKEAWLTYFTLVPVVTGVVIASGGEPSFHLFGFLMCIAATAARALKSVLQGILLSSEGEKLNSMNLLLYMAPIAVVLLLPATLIMEKNVVGITIALARDDFRIVWYLLFNSALAYLVNLTNFLVTNHTSALTLQVLGNAKGAVAVVVSILIFKNPVSVTGMLGYSLTVCGVILYSEAKKRNKN

SEQ ID NO: 22418 - protein, 159 aa, Arabidopsis thaliana
MASGDVEYRCFVGGLAWATDDRALETAFAQYGDVIDSKIINDRETGRSRGFGFVTFKDEKAMKDAIEGMNGQDLDGRSITVNEAQSRGSGGGGGHRGGGSYGGGGGRREGGGGYSGGGGGYSSRGGGGGSYGGGRREGGGGYGGGEGGGYGGSGGGGGW

SEQ ID NO: 22419 - protein, 596 aa, Arabidopsis thaliana
MTVEQNLEALDQFPVGMRVLAVDDDQTCLKILESLLRHCQYHVTTTNQAQKALELLRENKNKFDLVISDVDMPDMDGFKLLELVGLEMDLPVIMLSAHSDPKYVMKGVTHGACDYLLKPVRIEELKNIWQHVVRSRFDKNRGSNNNGDKRDGSGNEGVGNSDPNNGKGNRKRKDQYNEDEDEDRDDNDDSCAQKKQRVVWTVELHKKFVAAVNQLGYEKAMPKKILDLMNVEKLTRENVASHLQKFRLYLKRISGVANQQAIMANSELHFMQMNGLDGFHHRPIPVGSGQYHGGAPAMRSFPPNGILGRLNSSSGIGVRSLSSPPAGMFLQNQTDIGKFHHVSSLPLNHSDGGNILQGLPMPLEFDQLQTNNNKSRNMNSNKSIAGTSMAFPSFSTQQNSLISAPNNNVVVLEGHPQATPPGFPGHQINKRLEHWSNAVSSSTHPPPPAHNSNSINHQFDVSPLPHSRPDPLEWNNVSSSYSIPFCDSANTLSSPALDTTNPRAFCRNTDFDSNTNVQPGVFYGPSTDAMALLSSSNPKEGFVVGQQKLQSGGFMVADAGSLDDIVNSTMKQEQSQGDLSGGDLGYGGFSSLRTCI

SEQ ID NO: 22420 - protein, 371 aa, Arabidopsis thaliana
MSNFTYTSAFNLSDNSPFNPAIGSSSSSSSALVVASDDDNNTDDACSICLEPFTLQDPSTVTSCKHEYHLQCIIEWSQRSKECPICWQLFVLRDPASQELLAAVEKERLLKTRNISSSSPISIHHSHDDFHSEEEESQFSSFDEQFLRHLTEAAHRRCLLRRRDGQISSSLVSSSDPTTIHPTDLVNLYRLSAISHVEHQNSNPCPSPGSMTPSPVSGHSSIPADSNNGSRISPGPSPSRSSQSPKSPEASSLPEAIKSKLAAASAKYKESISKSKQGLKEKLLARNNSVKELSKGVQREMNAGIAGVARMIERMDFSSKRFGGSAHVSTSTATASGFNFSFKGKRVEANSKSNNNGDKTEPQKLQGGETC

SEQ ID NO: 22421 - protein, 551 aa, Arabidopsis thaliana
METAKAWLSKLKSKDKVKSSKKKEATSNVKEGPKTAGGEEALSNITKEKAAAAKLYIENHYKMQMQSLQERKERRKMLEKKLAAAEVSEEEQNNLLKDLEMKETEYMRRQRHKMGADDFEPLTMIGKGAFGEVRICREKGTGNVYAMKKLKKSEMLRRGQVEHVKAERNLLAEVDSNCIVKLYCSFQDEEYLYLIMEYLPGGDMMTLLMRKDTLTEDEARFYIGETVLAIESIHKHNYIHRDIKPDNLLLDKDGHMKLSDFGLCKPLDCSNLQEKDFTVARNVSGALQSDGRPVATRRTQQEQLLNWQRNRRMLAYSTVGTPDYIAPEVLLKKGYGMECDWWSLGAIMYEMLVGFPPFYSDDPMTTCRKIVNWRNYLKFPDEVRLSPEAKDLICRLLCNVEQRLGTKGADEIKGHPWFRGTEWGKLYQMKAAFIPQVNDELDTQNFEKFEETDKQVPKSAKSGPWRKMLSSKDINFVGYTYKNVEIVNDDQIPGIAELKKKSNKPKRPSIKSLFEDETSGGTTTHQGSFLNLLPTQIEDPEKEGSKSSSSG

SEQ ID NO: 22422 - protein, 375 aa, Arabidopsis thaliana
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTVGSAYAKKTVESAEQAEKSSKRKRKNQYRGIRQRPWGKWAAEIRDPRKGSREWLGTFDTAEEAARAYDAAARRIRGTKAKVNFPEEKNPSVVSQKRPSAKTNNLQKSVAKPNKSVTLVQQPTHLSQQYCNNSFDNSFGDMSFMEEKPQMYNNQFGLTNSFDAGGNNGYQYFSSDQGSNSFDCSEFGWSDHGPKTPEISSMLVNNNEASFVEETNAAKKLKPNSDESDDLMAYLDNALWDTPLEVEAMLGADAGAVTQEEENPVELWSLDEINFMLEGDF

SEQ ID NO: 22423 - protein, 374 aa, Arabidopsis thaliana
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTGSAYAKKTVESAEQAEKSSKRKRKNQYRGIRQRPWGKWAAEIRDPRKGSREWLGTFDTAEEAARAYDAAARRIRGTKAKVNFPEEKNPSVVSQKRPSAKTNNLQKSVAKPNKSVTLVQQPTHLSQQYCNNSFDNSFGDMSFMEEKPQMYNNQFGLTNSFDAGGNNGYQYFSSDQGSNSFDCSEFGWSDHGPKTPEISSMLVNNNEASFVEETNAAKKLKPNSDESDDLMAYLDNALWDTPLEVEAMLGADAGAVTQEEENPVELWSLDEINFMLEGDF

SEQ ID NO: 22424 - protein, 298 aa, Arabidopsis thaliana
MAEFMEPNLVSNFDDEKSNSVDTRSIFQMGFPLESEEIVREMIEKERQHSPRDDYLKRLRNGDLDFNVRIQALGWIWKACEELQFGPLCICLAMNYLDRFLSVHDLPSGKAWTVQLLAVACLSLAAKIEETNVPELMQLQVGAPMFVFEAKSVQRMELLVLNVLRWRLRAVTPCSYVRYFLSKINGYDQEPHSRLVTRSLQVIASTTKGIDFLEFRASEIAAAVALSVSGEHFDKFSFSSSFSSLEKERVKKIGEMIERDGSSSSSQTPNNTVLQFKSRRYSHSLSTASVSSSLTSLS

SEQ ID NO: 22425 - protein, 898 aa, Arabidopsis thaliana
MMQRVFTFGKGRSEGNKGMKSLLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKERKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQVWHLSQCVNLISTRIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMIVCIQMFNVVFGLVFKFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 22426 - protein, 441 aa, Arabidopsis thaliana
MNRRQQVKRRVGKYEVGRTIGEGTFAKVKFARNSETGEPVALKILDKEKVLKHKMAEQIRREIATMKLIKHPNVVQLYEVMASKTKIFIILEYVTGGELFDKIVNDGRMKEDEARRYFQQLIHAVDYCHSRGVYHRDLKPENLLLDSYGNLKISDFGLSALSQQVRDDGLLHTSCGTPNYVAPEVLNDRGYDGATADMWSCGVVLYVLLAGYLPFDDSNLMNLYKKISSGEFNCPPWLSLGAMKLITRILDPNPMTRVTPQEVFEDEWFKKDYKPPVFEERDDSNMDDIDAVFKDSEEHLVTEKREEQPAAINAFEIISMSRGLNLENLFDPEQEFKRETRITLRGGANEIIEKIEEAAKPLGFDVQKKNYKMRLENVKAGRKGNLNVATEIFQVAPSLHMVQVSKSKGDTLEFHKFYKKLSNSLEQVVWTNNEVKKETAK

SEQ ID NO: 22427 - protein, 342 aa, Arabidopsis thaliana
MGEMKSMQMGVIGALFLSVASSVSIVICNKALMTNLGFPFATTLTSWHLMVTYCTLHVAYKLNFFENKPIDMRTVVLFGLLNGISIGLLNLSLGFNSIGFYQMTKLAIIPFTVLLETLFLNKKFSQKIKFSLFLLLVGVGIASITDLQLNFVGSVLSLLAIATTCVGQILTNTIQKRLNVTSTQLLYQSAPFQAAILFVSGPFVDKYLTSLNVFSFHYSPIVVGFITLSCLIAVSVNFSTFLVIGKTSPVTYQVLGHLKTCLVLAFGYTLLHDPFTPRNIAGILIAVLGMLLYSYFCSVASKSKQASSDSTFLGKDRDTTPLLGQENENHHEAKKLDKHSPV

SEQ ID NO: 22428 - protein, 262 aa, Arabidopsis thaliana
MDKRWSLKGMTALVTGGASGIGYAIVEELAGFGARIHVCDISEAKLNQSLSEWEKKGFQVSGSVCDVASRPEREELMQTVSSQFDGKLNILVSNVGVIRSKPTTEYTEDDFAFHISSNVEAAYHFSQLSHPLLKASGYGSIIFVSSIAGVISFDAGSIYGLTKGALIQLAKNLACEWAKDGIRANAVAPNVINTPLSQSYLEDVSFKKALLSRTPLGRVGEPNEVASLVAFLCLPAASYITGQTICVDGGLTVNGFSYQPEV

SEQ ID NO: 22429 - protein, 183 aa, Arabidopsis thaliana
METVSSLFQGKLSILVPNVGIGVLKPTTECTAEEFSFIIATNLESTFHFSQLAHPLLKASGSGNIVLMSSVAGVVNLGNTSIYGATKGAMNQLARNLACEWASDNIRANSVCPWFITTPSTKDFLGDKDVKEKVESVTPLRRVGEANEVSSLVAFLCLPAASYITGQTICVDGGFTINGFSLP

SEQ ID NO: 22430 - protein, 593 aa, Arabidopsis thaliana
MATEGKNPINMNSMSSSLARTGQWVFSQDIPTDVVVEVGEANFSLHKFMLVAKSNYIRKLIMESKDSDVTRINLSDIPGGPEIFEKAAKFCYGVNFEITVQNVAALHCAAEFLQMTDKYCDNNLAGRTQDFLSQVALSSLSGAIVVLKSCEILLPISRDLGIVRRCVDVVGAKACNEAMFPCRTPPNWWTEELCILDVDFFSDVVSSMKQRGVKPSSLASAIITYTEKSLRDLVRDHSGRGVKYSDPGDNESDERSQQRDLVQSIVSLLPSDKGLFPVNFLCSLLRCAVFLDTSLTCKNELEKRISVVLEHVSVDDLLIPSFTYDGERLLDLDSVRRIISAFVEKEKNVGVFNGGDFNRGVCSVSLQRVAKTVDSYLAEIATYGDLTISKFNAIANLVPKSARKSDDDLYRAIDIFLKAHPNLDEIEREKVCSSMDPLKLSYDARLHASQNKRLPVNIVLHALYYDQLKLRSGVAEQEERAVVVLPEALKTRSQLQADTTLAKENEALRSELMKMKMYVSDMQKNKNGAGASSSNSSSLVSSKKSKHTFFSSVSKKLGKLNPFKNGSKDTSHIDEDLGGVDITKPRRRRFSIS

SEQ ID NO: 22431 - protein, 1296 aa, Arabidopsis thaliana
MVFKNKLFFSSKKSGSSSPDSSNSPRSVGSNSPIRSDKKKSKSASKDEPPIPIPGFVGVGCKQTQIKDGLKKKDGSSKGKQLSSEVQAHSIGKSNLSPSSEVKKPPPPEVKEGPAFVSPIMASSLGLNRIKTRSGPLPQERVFNYRNDPATSNLSKMGADGGDLGSGSATSGSGSGNRKKEAGSSKLGLEENMDRTRPSDNKSDRDSLSPDTGPPRSLSPTLPPSGSRLQNVASSSGTGRSEMSSGRSGPLRNSDFCTPENSYEWENPKESESPRYQALLRMTSAPRKRFPGDIKSFSHELNSKGVRPFPLWKPRRSNNVEEVLNLIRAKFEKAKEEVNSDLAVFAADLVGVLEKNAESHPEWEETFEDLLILARSCAMTTPGDFWLQCEGIVQDLDDRRQELPPGVLKQLHTRMLFILTRCTRLLQFHKESWGEEEQVVQLRQSRVLHSIEKIPPSGAGRSYSAAKVPSTKKAYSQEQHGLDWKEDAVVRSVPPLAPPENYAIKESESPANIDRMSSWKKLPSPALKTVKEAPASEEQNDSKVEPPNIVGSRQGRDDAAVAILNFPPAKDSHEHSSKHRHNISWGYWGEQPLISEESSIMCRICEEEVPTTHVEDHSRVCTLADKYDQKGLSVDERLMAVAGTLDKIAETFRHKDSLAAAESPDGMKVSNSHLTEESDVLSPRLSDWSRKGSEDMLDCFPEADNSIFMDDLRGLPLMSCRTRFGPKSDQGMTTSSASSMTPRSPIPTPRPDPIEQILGGKGTFHDQDDIPQMSELADIAKCAADAIPGDDQSIPFLLSCLEDLRVVIDRRKFDALTVETFGTRIEKLIREKYVHMCELMDDEKVDLLSTVIDEDAPLEDDVVRSLRTSPVHPRDRTSIDDFEIIKPISRGAFGRVFLAKKRTTGDLFAIKVLKKADMIRKNAVESILAERDILINVRNPFVVRFFYSFTCRDNLYLVMEYLNGGDLYSLLRNLGCLEEDIVRVYIAEVVLALEYLHSEGVVHRDLKPDNLLIAHDGHIKLTDFGLSKVGLINSTDDLAGPAVSGTSLLDEEESRLAASEEQLERRKKRSAVGTPDYLAPEILLGTGHGATADWWSVGIILFELIVGIPPFNAEHPQQIFDNILNRKIPWPHVPEEMSAEAHDIIDRFLTEDPHQRLGARGAAEVKQHIFFKDINWDTLARQKAAFVPASESAIDTSYFRSRYSWNTSDEQFFPSGEVPDYSDADSMTNSSGCSSNHHEEGEAEECEGHAEFESGIPVDYSFSNFSFKNLSQLASINYDLLSKGWKDEPQQIPHHK

SEQ ID NO: 22432 - protein, 491 aa, Arabidopsis thaliana
MAASYEEERDIQKNYWIEHSADLTVEAMMLDSRASDLDKEERPEVLSLLPPYEGKSVLELGAGIGRFTGELAQKAGELIALDFIDNVIKKNESINGHYKNVKFMCADVTSPDLKITDGSLDLIFSNWLLMYLSDKEVELLAERMVGWIKVGGYIFFRESCFHQSGDSKRKSNPTHYREPRFYSKVFQECQTRDAAGNSFELSMIGCKCIGAYVKNKKNQNQICWIWQKVSSENDRGFQRFLDNVQYKSSGILRYERVFGQGFVSTGGLETTKEFVEKMNLKPGQKVLDVGCGIGGGDFYMAEKFDVHVVGIDLSVNMISFALERAIGLSCSVEFEVADCTTKHYPDNSFDVIYSRDTILHIQDKPALFRTFFKWLKPGGKVLISDYCRSPKTPSAEFSEYIKQRGYDLHDVQAYGQMLKDAGFTDVIAEDRTDQFMQVLKRELDRVEKEKEKFISDFSKEDYDDIVGGWKSKLERCASDEQKWGLFIANKN

SEQ ID NO: 22433 - protein, 397 aa, Arabidopsis thaliana
MEPSQRNTKPPSFSDSTIPVDSDGRATVFRPFSLSSPHSRAFHLAWLSLFSCFFSTFSIPPLVPVISSDLNLSASTVSAAGIASFAGSIFSRLAMGPLCDLIGPRTSSAILSFLTAPVILSASLVSSPTSFILVRFFVGFSLANFVANQYWMSSMFSGNVIGLANGVSAGWANVGAGISQLLMPLIYSTIAEFLPRAVAWRVSFVFPAIFQVTTAVLVLLYGQDTPHGNRKNSNQNKLTIPEEEEVLVVEEDERSSFVEILIGGLGNYRAWILALLYGYSYGVELTTDNVIAGYFYERFGVNLEAAGTIAASFGISNIASRPAGGMISDALGKRFGMRGRLWGLWIVQSVAGLLCVLLGRVNSLWGSILVMWVFSVFVQAASGLVFGVVPFVSTRLV

SEQ ID NO: 22434 - protein, 435 aa, Arabidopsis thaliana
MQSGGDFSNGFHGDHHRELELEDKQGPSLSSFGRAKKRSHAGARDPRGGLANVLRVSDQLGEHKSLETSESSPPPCTDFDVAYFHSYAHVGIHEEMIKDRARTETYREAIMQHQSLIEGKVVVDVGCGTGILSIFCAQAGAKRVYAVDASDIAVQAKEVVKANGLSDKVIVLHGRVEDVEIDEEVDVIISEWMGYMLLYESMLGSVITARDRWLKPGGLILPSHATLYMAPISHPDRYSHSIDFWRNVYGIDMSAMMQLAKQCAFEEPSVESISGENVLTWPEVVKHIDCKTIKIQELDSVTARYKFNSMMRAPMHGFAFWFDVEFSGPASSPAKNTSETSIASGSSSISPSGEVNQKKRTNPSDALVLSTSPESPPTHWQQTIVYFYDPIDVEQDQVIEGSVTLSQSKENKRFMNIHLEYSSAGRSFVKESVMR

SEQ ID NO: 22435 - protein, 565 aa, Arabidopsis thaliana
MNCAISGEVPVEPVVSTKSGLLFERRLIERHISDYGKCPVTGEPLTIDDIVPIKTGEIIKPKTLHTASIPGLLGTFQNEWDGLMLSNFALEQQLHTARQELSHALYQHDSACRVIARLKKERDEARQLLAEVERHIPAAPEAVTANAALSNGKRAAVDEELGPDAKKLCPGISAEIITELTDCNAALSQKRKKRQIPQTLASIDTLERFTQLSSHPLHKTNKPGICSMDILHSKDVIATGGVDATAVLFDRPSGQILSTLTGHSKKVTSVKFVGDSDLVLTASADKTVRIWRNPGDGNYACGYTLNDHSAEVRAVTVHPTNKYFVSASLDGTWCFYDLSSGSCLAQVSDDSKNVDYTAAAFHPDGLILGTGTSQSVVKIWDVKSQANVAKFDGHTGEVTAISFSENGYFLATAAEDGVRLWDLRKLRNFKSFLSADANSVEFDPSGSYLGIAASDIKVYQTASVKAEWNLIKTLPDLSGTGKATCVKFGSDAQYVAVGSMDRNYGYLVFLVMKKPTSMMTLRKTREQSVKNSDRTFQMSISSVISLKFLKFCCILQYLQQWGRIS

SEQ ID NO: 22436 - protein, 537 aa, Arabidopsis thaliana
MNCAISGEVPVEPVVSTKSGLLFERRLIERHISDYGKCPVTGEPLTIDDIVPIKTGEIIKPKTLHTASIPGLLGTFQNEWDGLMLSNFALEQQLHTARQELSHALYQHDSACRVIARLKKERDEARQLLAEVERHIPAAPEAVTANAALSNGKRAAVDEELGPDAKKLCPGISAEIITELTDCNAALSQKRKKRQIPQTLASIDTLERFTQLSSHPLHKTNKPGICSMDILHSKDVIATGGVDATAVLFDRPSGQILSTLTGHSKKVTSVKFVGDSDLVLTASADKTVRIWRNPGDGNYACGYTLNDHSAEVRAVTVHPTNKYFVSASLDGTWCFYDLSSGSCLAQVSDDSKNVDYTAAAFHPDGLILGTGTSQSVVKIWDVKSQANVAKFDGHTGEVTAISFSENGYFLATAAEDGVRLWDLRKLRNFKSFLSADANSVEFDPSGSYLGIAASDIKVYQTASVKAEWNLIKTLPDLSGTGKATCVKFGSDAQYVAVGSMDRNYGYLVFLVMKKPTSMMTLRKTREQSYLQQWGRIS

SEQ ID NO: 22437 - protein, 402 aa, Arabidopsis thaliana
MGTSTTESVVACEFCGERTAVLFCRADTAKLCLPCDQHVHSANLLSRKHVRSQICDNCSKEPVSVRCFTDNLVLCQECDWDVHGSCSSSATHERSAVEGFSGCPSVLELAAVWGIDLKGKKKEDDEDELTKNFGMGLDSWGSGSNIVQELIVPYDVSCKKQSFSFGRSKQVVFEQLELLKRGFVEGEGEIMVPEGINGGGSISQPSPTTSFTSLLMSQSLCGNGMQWNATNHSTGQNTQIWDFNLGQSRNPDEPSPVETKGSTFTFNNVTHLKNDTRTTNMNAFKESYQQEDSVHSTSTKGQETSKSNNIPAAIHSHKSSNDSCGLHCTEHIAITSNRATRLVAVTNADLEQMAQNRDNAMQRYKEKKKTRRYDKTIRYETRKARAETRLRVKGRFVKATDP

SEQ ID NO: 22438 - protein, 358 aa, Arabidopsis thaliana
MKMKTVLVIINCIFLAIGNCGGPLMMRLYFQNGGERIWFPSFLQTVGCPLIFFPLLLSFLRRRRCLEEQETTPFFLMKPPLFIAAIVVGLLVGFDNYLYSYGLAYIPVSTASLIISAQLGFTALFAFFMVKQKFTPFTINAIVLLTGGAVVLALNSDSDKLANETHKEYVVGFIMTLGAALLYGFILPLVELSYKKSGQRITYTLALEFQMVLCFAATCVCLVGMLAAGDFKVKHALFIFKNRVIAGEARDFKLGESLYYVVIVFTAIIWQAFFVGAIGLIFCASSLVSGIMVSALLPVTVILAVICFQEKFQAGKGVALALSLWGSVSYFYGQVKSEEKTKAQDTQLSQLPVTDYVA

SEQ ID NO: 22439 - protein, 375 aa, Arabidopsis thaliana
MDFDSISRESTFLSPLLNQNAMWQMNLGSDDTMGVDGSYPERHGEPDCAYYIRTGLCRFGSTCRFNHPHDRKLVIATARIKGEYPERIGQPECEFYLKTGTCKFGVTCKFHHPRNKAGIDGSVSVNVLSYPLRPNEDDCSYFLRIGQCKFGGTCKFNHPQTQSTNLMVSVRGSPVYSALQSLTGQPSYSWSRTSFVANPPRLQDPSGFASGSQGGLFSSGFHSGNSVPLGFYALPRENVFPERPGQPECQFYMKTGDCKFGTVCKFHHPRDRQTPPPDCVLSSVGLPLRPGEPLCVFYSRYGICKFGPSCKFDHPMRVFTYNNNTASPSPSSSLHQETAITTELRNLLVSSSVEAKPTSLPETTSAKDTIVDAQH

SEQ ID NO: 22440 - protein, 1290 aa, Arabidopsis thaliana
MADRRVGKRQMGQRGFSKVESGTCNVCSAPCSSCMHRNVGFTGSKLDESSDENCHGVVGSQCSVNEDDLLPSSMVNAHKSLNNTASEASNLVNSSHDALSENAESKETIRCSGISDDSGAAAMTSKPSLSGSRMKHKVSASANMLDQSSNCIEDQEDGILSADRAKQLKSGCSNNEIGNKDLADGSALNSDPIPGGSRKDEVKLESLQNPSSNHDDRVSSEKGNFKEKSRPGGNKERQEPSVEGSTRSGENRKDGKSSKSSSSNSSAVSESESDDSEMVEHDVKVCDICGDAGREDLLAICSGCSDGAEHTYCMREMLDEVPEGDWLCEECAEEAEKQKQEAKRKRETEVTFNTYSSGKRHADKIEAAPDAKRQVVEASTGSPKKSILPRVGALSRETSFKGLDRLRGKLNHQTSFSDDTESARSAGSQLQPPKGAFLKSSSFNCSSSKPKVQLMDDAIHPRQKTGKEDTALDLKVGGFRNVGKSMPSRTTDAGNSGGSDSQAKMLGSKVYHSQEGKSLKQVKDRNREANASASSIDQKLKSRGNSSVSHANNNRDLKGLQSDGKRGGDISTNEKCSASEQSSSQADCKDELPSTSCTGEGMPNHGTVALQDGLPRSRVPREVGKKSKEAFSKRQRSSLLAGAKGLPSSQKGGQTAESSDTSGVSDSDLSTTKNVKEDLNKGNRLRAAVDAALRKKPSFGKNRVLEQSDASLVANVDSSSEKTLRNQLPSKMHKNHVSHEGLQGGHPILWPTSDPYKQTIVTNEKQLIFPGADTIPSRLVEPEVSFPAVKPVMRDLPLVPSPVMLRSSAIPDHEFIWQGDLEVRKIINQSAMHSGIQAHLSTLASPRVAEVVNKFPETFSLNEVPRKSTWPTQFEKLGTKEAHIALFFFAKDTESYERNYKPLVDNMIKNDLALKGNLDNVDLLIFASNQLPSNCQRWNMLYFLWGVFQGRKETNPQKNTSLPTSNVLPRDRDPKELCQTSSPSKHLEKGSSLRESSSNGIETRNGTDARSHENPNNRESSIERSPSKKEDIALKVEEAGVNHIPPQVTGSNSGDSLVRKVQKVEEQELGGRKDLPLTVMGSGIQSHGQDNPLEKDLNSSQASHRKRPLWELSNPANENSSAINQKVELNNDGLCEGSPNKKLKTENGSSSLCRDTSGHDSGIMKKSPKVVFPLDLNDDSEMVDNLSPLGNDENNNNRRLISGTVPNLELALGAEETTEATMGLLPFLSRSSNSGEQSNNSMNKEKQKADEEEEDDAEVAASLSLSLSFPGTEERKNVNTPLFLFRDLPR

SEQ ID NO: 22441 - protein, 629 aa, Arabidopsis thaliana
MALSVFAFPSYINRNPSLKYLKPSSMSSTKYSKVRATTFSEKGEYYSNRPPTPLLDTINHPMHMKNLSIKELKVLSDELRSDVIFNVSKTGGHLGSNLGVVELTVALHYIFNTPHDKILWDVGHQSYPHKILTGRRGKMKTIRQTNGLSGYTKRRESEHDSFGTGHSSTTLSAGLGMAVGRDLKGMNNSVVSVIGDGAMTAGQAYEAMNNAGYLHSNMIVILNDNKQVSLPTANLDGPTQPVGALSCALSRLQSNCGMIRETSSTLFEELGFHYVGPVDGHNIDDLVSILETLKSTKTIGPVLIHVVTEKGRGYPYAERADDKYHGVLKFDPETGKQFKNISKTQSYTSCFVEALIAEAEADKDIVAIHAAMGGGTMLNLFESRFPTRCFDVGIAEQHAVTFAAGLACEGLKPFCTIYSSFMQRAYDQVVHDVDLQKLPVRFAIDRAGLMGADGPTHCGAFDVTFMACLPNMIVMAPSDEAELFNMVATAAAIDDRPSCFRYHRGNGIGVSLPPGNKGVPLQIGRGRILRDGERVALLGYGSAVQRCLEAASMLSERGLKITVADARFCKPLDVALIRSLAKSHEVLITVEEGSIGGFGSHVVQFLALDGLLDGKLKVYRTWITNGSTS

SEQ ID NO: 22442 - protein, 390 aa, Arabidopsis thaliana
MRYAVYSFFRFHFLFLFLCRSVIEVRDGLTFLDLIVIQIENLNNKYNCKVPLVLMNSFNTHDDTQKIVEKYTKSNVDIHTFNQSKYPRVVADEFVPWPSKGKTDKDGWYPPGHGDVFPSLMNSGKLDAFLSQGKEYVFIANSDNLGAIVDLKILKHLIQNKNEYCMEVTPKTLADVKGGTLISYEGKVQLLEIAQVPDEHVNEFKSIEKFKIFNTNNLWVNLKAIKKLVEADALKMEIIPNPKEVDGVKVLQLETAAGAAIRFFDNAIGVNVPRSRFLPVKATSDLLLVQSDLYTLVDGFVTRNKARTNPTNPAIELGPEFKKVASFLSRFKSIPSIVELDSLKVSGDVWFGSGVVLKGKVTVKANAGTKLEIPDNAVLENKDINGPEDL

SEQ ID NO: 22443 - protein, 116 aa, Arabidopsis thaliana
MVKSTSKDAQDLFHSLHSAYTATPTNLKIIDLYVCFAVFTALIQQVAYMALVGSFPFNSFLSGVLSCIGTAVLAVCLRIQVNKENKEFKDLAPERAFADFVLCNLVLHLVIINFLG

SEQ ID NO: 22444 - protein, 401 aa, Arabidopsis thaliana
MLLLVDCSSCRTPLHLPPGATRIRCAICHAFTLIAPEPRLQSHASASPFPFPNSSPAPSTFIYPPPTPSPYTHAPHAPSPFNHAPPDSYPFTHAPPASSPFNHAPPGPPPPVHGQKRAVIVGVSYKNTKDELKGCINDANCMKFMLMKRFQFPESCILMLTEEEADPMRWPTKNNITMAMHWLVLSCKPGDSLVFHFSGHGNNQMDDNGDEVDGFDETLLPVDHRTSGVIVDDEINATIVRPLPYGVKLHAIVDACHSGTVMDLPYLCRMDRLGNYEWEDHRPKTGMWKGTSGGEVFSFTGCDDDQTSADTPAIERGHGMTYGSLLNAMRSTVHEIFDKNKGRELVEVGGADFLSTLLGLLILGASPPDEEEEVNQAPQKTQEPQLSANEAFAVYEKPFSL

SEQ ID NO: 22445 - protein, 559 aa, Arabidopsis thaliana
MEAALAACALPSLRILNTKPRFRCSFSNPSLPISPNSLITRKSSRFTTAVSSPPSSSAATSTNSPPEPEALFEPGSDKFDWYANWYPVMPICDLDKKVPHGKKVMGIDLVVWWDRNEKQWKVMDDTCPHRLAPLSDGRIDQWGRLQCVYHGWCFNGSGDCKLIPQAPPDGPPVHTFKQACVAVYPSTVQHEIIWFWPNSDPKYKNIIETNKPPYIPELEDPSFTKLMGNRDIPYGYDVLVENLMDPAHVPYAHYGLMRFPKPKGKYIICISNSCFNPFTNLQILLAEKIDREGGKPLEINVKKLDNKGFFSKQEWGYSNFIAPCVYRSSTDPLPEQEHEYPAPAASDKAALSKRRLSLIFICIPVSPGRSRLIWTFPRNFGVFIDKIVPRWVFHIGQNTILDSDLHLLHVEERKILERGPENWQKACFIPTKSDANVVTFRRWFNKYSEARVDWRGKFDPFLLPPTPPREQLFDRYWSHVENCSSCKKAHKYLNALEVILQIASVAMIGVMAVLKQTTMSNVARIAVLVAAVLSFAASKWLSHFIYKTFHYHDYNHAVV

SEQ ID NO: 22446 - protein, 315 aa, Arabidopsis thaliana
MANAITFFKLNTGAKFPSVGLGTWQASPGLVGDAVAAAVKIGYRHIDCAQIYGNEKEIGAVLKKLFEDRVVKREDLFITSKLWCTDHDPQDVPEALNRTLKDLQLEYVDLYLIHWPARIKKGSVGIKPENLLPVDIPSTWKAMEALYDSGKARAIGVSNFSTKKLADLLELARVPPAVNQVECHPSWRQTKLQEFCKSKGVHLSAYSPLGSPGTTWLKSDVLKNPILNMVAEKLGKSPAQVALRWGLQMGHSVLPKSTNEGRIKENFNVFDWSIPDYMFAKFAEIEQARLVTGSFLVHETLSPYKSIEELWDGEI

SEQ ID NO: 22447 - protein, 314 aa, Arabidopsis thaliana
MAEEIRFFELNTGAKIPSVGLGTWQADPGLVGNAVDAAVKIGYRHIDCAQIYGNEKEIGLVLKKLFDGGVVKREEMFITSKLWCTYHDPQEVPEALNRTLQDLQLDYVDLYLIHWPVSLKKGSTGFKPENILPTDIPSTWKAMESLFDSGKARAIGVSNFSSKKLADLLVVARVPPAVNQVECHPSWQQNVLRDFCKSKGVHLSGYSPLGSPGTTWLTSDVLKNPILGGVAEKLGKTPAQVALRWGLQMGQSVLPKSTHEDRIKQNFDVFNWSIPEDMLSKFSEIGQGRLVRGMSFVHETSPYKSLEELWDGEI

SEQ ID NO: 22448 - protein, 335 aa, Arabidopsis thaliana
MKFGETFTEYLHGEEEWFLEKCRFVEYKKLKKVLKKCKTCNSTKSDDGQIIPSATSSSLSDSCECKACPWCDQMFFEELMKEATDIAGFFRSRVRHLLHLHVATGMQRYMIRLRRCFTDEKQALVQEGQILIQYITMNAIAIRKILKKYDKVHSSENGKNFKLKMRAERIELLHSPWLIELGAFYLNSGLDNVGNFKNSFGRVACENLNEDQPVLKLMLPNSIELEYDLTCAICLETVFNPYALKCGHIFCNSCACSAASVLIFQGIKAAPRHSKCPICREAGVYAEAVHMIELHLLLKTRSKEYWKERMMNERSEMVKQSKMFWNEQTKHMIGY

SEQ ID NO: 22449 - protein, 254 aa, Arabidopsis thaliana
MENEREKQVYLAKLSEQTERYDEMVEAMKKVAQLDVELTVEERNLVSVGYKNVIGARRASWRILSSIEQKEESKGNDENVKRLKNYRKRVEDELAKVCNDILSVIDKHLIPSSNAVESTVFFYKMKGDYYRYLAEFSSGAERKEAADQSLEAYKAAVAAAENGLAPTHPVRLGLALNFSVFYYEILNSPESACQLAKQAFDDAIAELDSLNEESYKDSTLIMQLLRDNLTLWTSDLNEEGDERTKGADEPQDEV

SEQ ID NO: 22450 - protein, 466 aa, Arabidopsis thaliana
MESKWLFGRKQEAEVGPFSAWNITGTYRGLPHALLHFFYVFYTSGLSTMLWLNVLDYLSNVKRVFSGTWKFLNSLNSSSKFQDFQKENGNSVVELVAVPTKITGVHYVQLGIFSSQVFQESPRDRLLKRKLSPVNEMEKHCNIEIAAQVSRVASSENNGDKNYYHMEGLMESPGVGDDGDCFSPLLLNATSVNVEVYYNKAVNYTLMVLLLIRQMEHVLNLKLTTSHAESLFNAFATAAFFKFVVFSIFEMRYLLAIWKATRPSNSGEGWETMRRELSFLYSRFYGILLGGILIMYQFHNYMQPILLLMYSFWIPQIVANVVRDSRKPLHPYYILGMTATRLAIPLYVFGCPHNFMRVEPNKVWCICLCTFMGLQAVILLLQHYFGSRCFVPRQMLPEKYNYHRRFNRDVSRTTDCVICMTAIDLRQHTSDCMVTPCEHFFHSGCLQRWMDIKMECPTCRRSLPPA

SEQ ID NO: 22451 - protein, 174 aa, Arabidopsis thaliana
MAVTAFNTLKLVSSSLDPIPSVSCSSYSFSLIYVGSPYKRCLKQSCSVRAMTSSSSAASSSSSSFGSRMEESIRKTVTENTVVIYSKTWCSYCTEVKTLFKRLGVQPLVVELDQLGPQGPQLQKVLERLTGQHTVPNVFVCGKHIGGCTDTVKLNRKGDLELMLAEANGKNGQS

SEQ ID NO: 22452 - protein, 452 aa, Arabidopsis thaliana
MNRPKVQRRVGKYEVGKTLGQGTFAKVRCAVNTETGERVALKILDKEKVLKHKMAEQIRREICTMKLINHPNVVRLYEVLASKTKIYIVLEFGTGGELFDKIVHDGRLKEENARKYFQQLINAVDYCHSRGVYHRDLKPENLLLDAQGNLKVSDFGLSALSRQVRGDGLLHTACGTPNYAAPEVLNDQGYDGATADLWSCGVILFVLLAGYLPFEDSNLMTLYKKIIAGEYHCPPWLSPGAKNLIVRILDPNPMTRITIPEVLGDAWFKKNYKPAVFEEKEEANLDDVDAVFKDSEEHHVTEKKEEQPTSMNAFELISMSRALDLGNLFEEEESIPFNLQGFKRETRFAAKGAANDLVQKIEEASKPLGFDIQKKNYKRYLCTQMRLENVTAGRKGNLRVATEIFQVSPSLHMIEVRKTKGDTLEFHKFYKKLSTSLNDVVWKSGESSGLSK

SEQ ID NO: 22453 - protein, 375 aa, Arabidopsis thaliana
MEVRVSTTTSEGHLTSAAAFVEGGIQDACDDACSICLESFCESDPSTLTSCKHEYHLQCILEWCQRSSQCPMCWQSISLKDPTSQELLEAVEQERNFRFNPTRNATIFRHPTLGDFELQHLPVGVDNAEIEERIIQHLAAAAAMGRARHGVRREGHRSRSSSQGHQQFMVFSSQPNASSPPPHPPMPSSPSQRDESDTVSNLPHNALGEGSHQSNTQPPTSSHPRQVSPSASDSNSRPLNQSSPSEQDRAGPSELQSFSESLKSRLNAVSTRYKESISKNTRNWKDRLFSRNTSMADLGSEVKREVSAGIATVSRMMERLETRENSRPSTASVSDVSENHTPETNNEHNRAAAGDEHSVNERGVKETCATGSGSS

SEQ ID NO: 22454 - protein, 394 aa, Arabidopsis thaliana
MGLRMSESAKPYFAMVCLQFGYAGMNLVTKTVLDRGMSHYVLVAYRNAFATAAIAPFALLSERKVRSKMTFPIFMRIFLLALLGPVIDQNLYYIGLKLTSPTFSSAVSNIVPAITIILATLFRMEKVEMRKVRCLVKVMGTLVTVVGSILMIFYKGPFINFFRSHLTAASSPPTADYLKAAVFLLLASLSWASFFVLQAATLKKYSAHLSMSTMVCFMGTLQSLALAFVMEHNPSALNIGFDMNLLASAYAGIMSSSIAYYVQGLMMQRKGPVFVTAFNPLIVVIVSIMSFFVLGQGIYLGGVIGVVVLMVGVYAVLWGKHVDDDGEETRHEDNVVAVKCCSGNNGLTIMPKIDEADEEDVETGKATSEKESSVPEVVVVVFCSENVHSVSRPN

SEQ ID NO: 22455 - protein, 250 aa, Arabidopsis thaliana
MGRGRVELKRIENKINRQVTFAKRRNGLLKKAYELSVLCDAEVALIIFSNRGKLYEFCSSSSMLRTLERYQKCNYGAPEPNVPSREALAELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 22456 - protein, 430 aa, Arabidopsis thaliana
METEPLCVSPAIGMMYSDRLNIDRYTQGFLENHKGLTEDYWPLYAVAGGIGVFISWVWSLLLGSYANEMMKVSVHILTTYLAVVSVLCFWCRLFFWGGAFAVGSLLQFLYVISVIDRLPFTMLVLRKALKLVWGLPKVIMVAHAFTVVMLLWMSLWSFGAAGVVASSMGDEGRWWLLVVLSVSLFWTGAVLCNTVHVIVSGMVFHVLFHCGQEESSSLPPSSLVDSLRYAVTTSFGSICYGSLFTAAIRTLRWEIRGFRSKICGNECLLCCVDFLFHLVETLVRFFNKYAYVQIAVYGKGFNKSARDAWELFQSTGVEALVAYDCSGAVLLMGTIFGGLITGSCIGIWAWIKYSDRVIMVASTAMLMGMVLVGLGMVVVESAVTSIYICFAEDPLLIQRWDADFYTEMSEVLHRRLQHRSSRAREVLTTA

SEQ ID NO: 22457 - protein, 321 aa, Arabidopsis thaliana
MRAAINRANSLGGLFSFRFIRNIKSMSSSTSQDFVSRPVIKKVFAKLQKEGDGAVVRRGISRSEQKLLDPFLMLDEFSVSPPAGFPDHPHRGFETVTYVLEGGITHQDFKGHKGTIYAGDVQWMTAGRGIIHSEMPEEEVNKGLQLWINLSSNEKMIEPNYQELSHSDIPKAEQNGVEVKVIAGESMGIQSPVYTRTPTMFLDFTLQPGAQIHQNVPESWNAFAYILESGEGGGVFSSSNSSPIPAHSVVVFGPGNDGVSVWNKSSSKQLRFVLIAGEPIGEPVVQYGPFVMNTQAEIDMTIEDYHYGKNGFEMAKYWRSQ

SEQ ID NO: 22458 - protein, 282 aa, Arabidopsis thaliana
MYKDRSGGGIMGGGGSSRSEILGGAIDRKRINDALDKHLKKSSPSTSRVFTSKDKDSVPSTSTAKSQLHSRSPDVESDTDSEGSDVSGSEGDDTSWISWFCNLRGNEFFCEVDEDYIQDDFNLCGLSGQVPYYDYALDLILDVESSNGDMFTEEQHEMVESAAEMLYGLIHVRYILTTKGMAAMMEKYKNYDFGRCPRVFCCGQSCLPVGQSDIPRSSTVKIYCPKCEDIYYPRSKYQDIDGAYFGTTFPHLFLMAYGNMKPQKPAQNYVPKIFGFKVHNKQ

SEQ ID NO: 22459 - protein, 364 aa, Arabidopsis thaliana
MVKFDTKLWKAVLMMSMINIGLSVVNVMFKKMIDEGLNRMVATTYRLAVGTLFLIPFAIFLERHNRPKLTGRILCSLFFSALLGTSLVQYFFLIGLEYTSSTFSLAFSNMVPSVTFALALVFRQETLNIKSNVGRAKLLGTMICICGALVLTLYKGTALSREHSTHMETHTRTDSTGAMTQKWAMGSIMLVISIIIWSSWFIVQAKISRVYPCQYTSTTILSFFGVIQSALLSLISERSTSMWVVKDKFQVLALLYSGIVGSGLCYVGMSWCLRQRGAVFTSSFIPLIQVFAAIFSFSFLHEQIYCGSVIGSMVIIVGLYILLWGKSKDKSASVTKQEPLDLDIEGCGTAPKELNSTAHQVSAK

SEQ ID NO: 22460 - protein, 372 aa, Arabidopsis thaliana
MSGESSSGSTEHCIKVVPTHGGRYVQYNVYGQLFEVSRKYVPPIRPIGRGACGIVCAAVNSVTGEKVAIKKIGNAFDNIIDAKRTLREIKLLRHMDHENVITIKDIVRPPQRDIFNDVYIVYELMDTDLQRILRSNQTLTSDQCRFLVYQLLRGLKYVHSANILHRDLRPSNVLLNSKNELKIGDFGLARTTSDTDFMTEYVVTRWYRAPELLLNCSEYTAAIDIWSVGCILGEIMTGQPLFPGKDYVHQLRLITELVGSPDNSSLGFLRSDNARRYVRQLPRYPKQQFAARFPKMPTTAIDLLERMLVFDPNRRISVDEALGHAYLSPHHDVAKEPVCSTPFSFDFEHPSCTEEHIKELIYKESVKFNPDH

SEQ ID NO: 22461 - protein, 359 aa, Arabidopsis thaliana
MGNSSEEPKPPTKSDKPSSPPVDQTNVHVYPDWAAMQAYYGPRVAMPPYYNSAMAASGHPPPPYMWNPQHMMSPYGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKLHQLLDTKPRAKAVAAG

SEQ ID NO: 22462 - protein, 299 aa, Arabidopsis thaliana
MSSYMHPLLGQELHLQRPEDSRTPPDQNNMELNRSEADEAKAETTPTGGATSSATASGSSSGRRPRGRPAGSKNKPKPPTIITRDSPNVLRSHVLEVTSGSDISEAVSTYATRRGCGVCIISGTGAVTNVTIRQPAAPAGGGVITLHGRFDILSLTGTALPPPAPPGAGGLTVYLAGGQGQVVGGNVAGSLIASGPVVLMAASFANAVYDRLPIEEEETPPPRTTGVQQQQPEASQSSEVTGSGAQACESNLQGGNGGGGVAFYNLGMNMNNFQFSGGDIYGMSGGSGGGGGGATRPAF

SEQ ID NO: 22463 - protein, 329 aa, Arabidopsis thaliana
MACINGENRDFSSSSSLSSLPMIVSRNFSARDDGETGDEFPFERIFPVYARGTLNPVADPVLLDFTNSSYDPIWDSIREEAKLEAEEEPVLSSFLYASILSHDCLEQALSFVLANRLQNPTLLATQLMDIFCNVMVHDRGIQSSIRLDVQAFKDRDPACLSYSSAILHLKGYLALQAYRVAHKLWKQGRKLLALALQSRVSEVRTAVIGDRVSILHGVTLGGTGKETGDRHPNIGDGALLGACVTILGNIKIGAGAMVAAGSLVLKDVPSHSMVAGNPAKLIGFVDEQDPSMTMEHDATREFFQNVAVAYRETIPNGSSVSGSCRERRH

SEQ ID NO: 22464 - protein, 608 aa, Arabidopsis thaliana; identical to SEQ ID NO: 619

SEQ ID NO: 22465 - protein, 526 aa, Arabidopsis thaliana
MGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 22466 - protein, 358 aa, Arabidopsis thaliana
MAGAKDSGCDDDLRIAGGCDPGKRGNPEDSSSPVEVSCSICLESVLDDGTRSKAKLQCGHQFHLDCIGSAFNMKGAMQCPNCRNVEKGQWLYANGSTRPFPEFSMEDWIPEEDLYGLSYPEMQYRVHWCPFGELSQAAASFEELEPATTTYHTEFHGHHAAAVNHSYLAYVGPGPAATPRTSDNNSTDDHPWNSHSNDHFHQLPVAPQYHHHSPSFSLPAAHVVDGEVDSSAARGLPYAHPFLFSHRSNQRSSPAINSYQGSSTQMREQHHAYNHQRQQHHANGPTLASPLISMTRRGLPPPPPPPPMPDQNVGFFIYPGGHHEPETDQIHAWERDWFPHFPVPSNHRTIPSLWHRHF

SEQ ID NO: 22467 - protein, 406 aa, Arabidopsis thaliana
MSFKSLIQDMRGELGSISRKGFDVRFGYGRSRSQRVVQDTSVPVDAFKQSCWASMPPELLRDVLMRIEQSEDTWPSRKNVVSCAGVCRNWREIVKEIVRVPELSSKLTFPISLKQPGPRGSLVQCYIMRNRSNQTYYLYLGLNQAASNDDGKFLLAAKRFRRPTCTDYIISLNCDDVSRGSNTYIGKLRSNFLGTKFTVYDAQPTNPGTQVTRTRSSRLLSLKQVSPRIPSGNYPVAHISYELNVLGSRGPRRMQCVMDAIPASAVEPGGTAPTQTELVHSNLDSFPSFSFFRSKSIRAESLPSGPSSAAQKEGLLVLKNKAPRWHEQLQCWCLNFNGRVTVASVKNFQLVAAPENGPAGPEHENVILQFGKVGKDVFTMDYQYPISAFQAFTICLSSFDTKIACE

SEQ ID NO: 22468 - protein, 266 aa, Gibberella zeae
MVQQIPKANHILDLLSLKGKVVVVTGASGPRGMGIEAARGAAEMGADVAITYASRKEGADKNVEELVKEYGVKAKAYKLNAADYNDVERFVGEVVKDFGKIDGFVANAGATANAGVIDGSAADWDHVIQIDLNGTAYCAKAVGALFRKQGHGSFVITSSMSGHIANYPQEQTSYNVAKAGCIHMARSLANEWRDFARVNSISPGYIDTGLSDFIDAETQELWRSMIPMGRNGDAKELKAAYVYFLSDASTYTTGSDLVIDGGYTCR

SEQ ID NO: 22469 - protein, 370 aa, Arabidopsis thaliana
MNNPVPCQSVSGGNSGGYLFPSSSGYCNVSAVLPHGRNLQNQPPVSTVPRDRLAMQDCPLIAQSSLINHHPQEFIDPLHEFFDFSDHVPVQNLQAESSGVRVDSSVELHKKSEWQDWADQLISVDDGSEPNWSELLGDSSSHNPNSEIPTPFLDVPRLDITANQQQQMVSSEDQLSGRNSSSSVATSKQRMRWTPELHEAFVEAVNQLGGSERATPKAVLKLLNNPGLTIYHVKSHLQKYRTARYKPETSEVTGEPQEKKMTSIEDIKSLDMKTSVEITQALRLQMEVQKRLHEQLEIQRSLQLQIEKQGRYLQMMFEKQQKIQDNKSSSSEASPKQCNGSFAEVEVGLETLTGDQNESASASRKRVRED

SEQ ID NO: 22470 - protein, 413 aa, Arabidopsis thaliana
MTLANDFGYSTAMSSSYSALHTSVEDRYHKLPNSFWVSSGQELMNNPVPCQSVSGGNSGGYLFPSSSGYCNVSAVLPHGRNLQNQPPVSTVPRDRLAMQDCPLIAQSSLINHHPQEFIDPLHEFFDFSDHVPVQNLQAESSGVRVDSSVELHKKSEWQDWADQLISVDDGSEPNWSELLGDSSSHNPNSEIPTPFLDVPRLDITANQQQQMVSSEDQLSGRNSSSSVATSKQRMRWTPELHEAFVEAVNQLGGSERATPKAVLKLLNNPGLTIYHVKSHLQKYRTARYKPETSEVTGEPQEKKMTSIEDIKSLDMKTSVEITQALRLQMEVQKRLHEQLEIQRSLQLQIEKQGRYLQMMFEKQQKIQDNKSSSSEASPKQCNGSFAEVEVGLETLTGDQNESASASRKRVRED

SEQ ID NO: 22471 - protein, 243 aa, Oryza sativa (japonica cultivar-group); identical to SEQ ID NO: 3929

SEQ ID NO: 22472 - protein, 588 aa, Arabidopsis thaliana
MEAKIVKVLDSSRCEDGFGKKRKRAASYAAYVTGVSCAKLQNVPPPNGQCQIPDKRRRLEGENKLSAYENRSGKALVRYYTYFKKTGIAKRVMMYENGEWNDLPEHVICAIQNELEEKSAAIEFKLCGHSFILDFLHMQRLDMETGAKTPLAWIDNAGKCFFPEIYESDERTNYCHHKCVEDPKQNAPHDIKLRLEIDVNGGETPRLNLEECSDESGDNMMDDVPLAQRSSNEHYDEATEDSCSRKLEAAVSKWDETDAIVVSGAKLTGSEVLDKDAVKKMFAVGTASLGHVPVLDVGRFSSEIAEARLALFQKQVEITKKHRGDANVRYAWLPAKREVLSAVMMQGLGVGGAFIRKSIYGVGIHLTAADCPYFSARYCDVDENGVRYMVLCRVIMGNMELLRGDKAQFFSGGEEYDNGVDDIESPKNYIVWNINMNTHIFPEFVVRFKLSNLPNAEGNLIAKRDNSGVTLEGPKDLPPQLESNGARGSGSANSVGSSTTRPKSPWMPFPTLFAAISHKVAENDMLLINADYQQLRDKKMTRAEFVRKLRVIVGDDLLRSTITTLQNQPKSKEIPGSIRDHEEGAGGL

SEQ ID NO: 22473 - protein, 159 aa, Arabidopsis thaliana
MPVPLAPYPTPPAPALAPSYNTPPANGSTSGQSQLVCSGCRNLLMYPVGATSVCCAVCNAVTAVPPPGTEMAQLVCGGCHTLLMYIRGATSVQCSCCHTVNLALEANQVAHVNCGNCMMLLMYQYGARSVKCAVCNFVTSVGVSSLSLSKKIGFKSVAN

SEQ ID NO: 22474 - protein, 403 aa, Arabidopsis thaliana
MHLIFFFSYFLRRYLLLLCAILILRAPLAHSLIPPLTCVNTGTVESDVTGIRFDRCLDTDSLAKISLSTVMSKARVYTDVNVIRPKDYWDYESLNVQWGEQDDYEVVRKVGRGKYSEVFEGINMNNNEKCIIKILKPVKKKKIRREIKILQNLCGGPNIVKLLDVVRDQHSKTPSLIFEYVNSTDFKVLYPTLTDYDIRYYIYELLKALDFCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLNKYQLELDTQLEALVGRHSRKPWSKFINADNRHLVSPEAIDYLDKLLRYDHQDRLTAKEAMAHPYFAQVRAAESSRMRTQ

SEQ ID NO: 22475 - protein, 425 aa, Arabidopsis thaliana
MDRLEGPPRLILVADLDCTLVDHDDPENNDLLRFNALWEAHYRHDSLLVYCTGRSFSSYSSLRKKRPLLTPDIAVTSVGSEIVYGGGESTVSDVVWTARLDYKWNRDIVVEETLKFPKLEPQPDKSQEEHKVSFFVGREDAVEIMKVLPGILEERGVDVKLVYSNGYAFDVLPRGAGKQGALTYLLDKLDIEGKQPSNTLVCGDSGNDAELFNISDVYGVMVSNSHEELLQWYEENAKDNPKIFHASERCGAGMIEAIQRFNLGPNVSPRDVMDTENFHGESLNPAHEVVQFYLFYERWRCGEVEKSDKYLQNLKSLSSPLGIFVHPSGVEKPIHEWIDEMENLYGDGKEKKFRIWLDNVTSSHISSDTWLAKFVKHELSEGKVRSCSTKVLLSYKEEKQRLTWMHIHQSWLDESSSDDQEKWIF

SEQ ID NO: 22476 - protein, 413 aa, Arabidopsis thaliana
MDLSLLLPKRSWEISGGADKISRVAMSLKNIVKNKYKAIGRRGRSHIAPEGSSVSSSLSTNEGLNQSIWVDLPPELLLDIIQRIESEQSLWPGRRDVVACASVCKSWREMTKEVVKVPELSGLITFPISLRQPGPRDAPIQCFIKRERATGIYRLYLGLSPALSGDKSKLLLSAKRVRRATGAEFVVSLSGNDFSRSSSNYIGKLRSNFLGTKFTVYENQPPPFNRKLPPSMQVSPWVSSSSSSYNIASILYELNVLRTRGPRRMQCIMHSIPISAIQEGGKIQSPTEFTNQGKKKKKPLMDFCSGNLGGESVIKEPLILKNKSPRWHEQLQCWCLNFKGRVTVASVKNFQLVAAAAEAGKNMNIPEEEQDRVILQFGKIGKDIFTMDYRYPISAFQAFAICLSSFDTKPVCE

SEQ ID NO: 22477 - protein, 122 aa, Arabidopsis thaliana
MEAIDQLVGQWQKDGLSPSQVAEKFSKCVLYVTCEPCIMCASALSFLGIKEVYYGCPNDKFGGCGSILSLHLGSEEAQRGKGYKCRGGIMAEEAVSLFKCFYEQGNPNAPKPHRPVVQRERT

SEQ ID NO: 22478 - protein, 295 aa, Arabidopsis thaliana
MCEEISMVVDFQGRYDPVEKARDSRADLAYDSKKWREESGEYAEAGKGKAHKTKEEAKDKAYDMKERTKDYAEQTKNKVNEGASRAADKAYETKEKAKDKAYDVKEKTKDYAEEAKDKVNEGASRAADKAYETKEKAKDKAYDVKEKTKDFAEETKEKVNEGASRAADKAYDVKEKTKNYAEQTKDKVNEGASRAADKAEETKDKAKDYAEDSKEKAEDMAHGFKEKAQDIGEKTMDTVKDVWETAKSTAQKVTEAVVGSGEEADKARDDVDKGLEDLSKKAKENRNKDDDFKRF

SEQ ID NO: 22479 - protein, 597 aa, Arabidopsis thaliana
MRLSVFIIPLVESRQASGIINKQSTSLLIRFSLYLEASISTKSFFSKSQRISQTQSPICLSANYYQPDNLDMEATQKHMIQEGSSMFYHQPSSVKQMDLSVQTFDSYCTLESSSGTKSHPCLNNKNNSSSTTSFSSNESPISQANNNNLSRFNNHSPEENNNSPLSGSSATNTNETELSLMLKDLETAMMEPDVDNSYNNQGGFGQQHGVVSSAMYRSMEMISRGDLKGVLYECAKAVENYDLEMTDWLISQLQQMVSVSGEPVQRLGAYMLEGLVARLASSGSSIYKALRCKDPTGPELLTYMHILYEACPYFKFGYESANGAIAEAVKNESFVHIIDFQISQGGQWVSLIRALGARPGGPPNVRITGIDDPRSSFARQGGLELVGQRLGKLAEMCGVPFEFHGAALCCTEVEIEKLGVRNGEALAVNFPLVLHHMPDESVTVENHRDRLLRLVKHLSPNVVTLVEQEANTNTAPFLPRFVETMNHYLAVFESIDVKLARDHKERINVEQHCLAREVVNLIACEGVEREERHEPLGKWRSRFHMAGFKPYPLSSYVNATIKGLLESYSEKYTLEERDGALYLGWKNQPLITSCAWR

SEQ ID NO: 22480 - protein, 494 aa, Arabidopsis thaliana
MVAIPNIKIKFGPQGSVRTFQTLSDSSKKIEHVVTEDLSQSSEKSKKRGGPKELDEVQPKKKQRLDCDWSSQCLALLRFLMEHRGGWLFKEPVDPVKMEIPDYFNVIQKPMDLGTVKSKLLKNVYSNADEFAADVRLTFANAMHYNPLWNEVHTIAKEINEIFEVRWESLMKKKVLRLSWNEVREGYKRQPVERDCSRRSSTGTSASSGVGLTKPAKENSEKGSLSSKPVKVQSKKNTPAVTPKALATCKCGRIICICLKSCSSFGSDVCSLTDCQLKNISGAQASELDPQSNGSDTSKKERNGSLKSQLDKPSNSDLLGNELKTAFPALPPVPPEKALRAAILKAQYAGTIIKAKHRIVLGQNNKADLIRIQIEKEQMERAQREEKARIEAEMRAAKVAERMRAQDELKQKRESQRLEIAKMKKGFDFERNNHSKLKKKFVKVCGCFSLTKARLLLEELGLVLKNDYCPELEVIGSEKFDAMRMDDLEEGEIL

SEQ ID NO: 22481 - protein, 290 aa, Arabidopsis thaliana
MGANISGGSPEFDRNDDVYSRKLRLVDLPENCVALIMTRLDPPEICRLARLNRMFRRASSADFIWESKLPANYRVIAHKVFDEITLTKLIKKDLYAKLSQPNLFDDGTKELWIDKNTGRLCLSISSKALRITGIDDRRYWSHIPTDESRFQSAAYVQQIWWFEVGGEFEIQFPSGTYSLFFRIQLGKTSKRLGRRICNSEHIHGWDIKPVRFQLATSDNQQAVSLCYLNNNPGSWSHYHVGDFKVTNPDVSTGIKFSMTQIDCTHTKGGLCIDSVLILPKECAKEVIGSQ

SEQ ID NO: 22482 - protein, 565 aa, Arabidopsis thaliana
MSHSFFNLFLISLFLYNNCIAHHYTFTVREVPYTKLCSTKAILTVNSQFPGPIIKVHKGDTIYVNVQNRASENITMHWHGVEQPRNPWSDGPEYITQCPIRPGSDFLYKVIFSIEDTTVWWHAHSSWTRATVHGLIFVYPRPPQILPFPKADHEVPIILGEWWKRDVREVVEEFVRTGGAPNVSDALTINGHPGFLYPCSKSDTFHLTVEKGKTYRIRMVNAAMNLPLFFAIANHSLTVVSADGHYIKPIKATYITISPGETLDMLLHADQDPERTYYMAARAYQSGNIDFNNSTTIGILSYTSSCKAKTSSFSGYYPTLPFYNDTSAAFGFFTKIKCLFSGQVPVQISRRIITTVSINLRMCPQNSCEGPNGSRLAASMNNISFVTPSHVDILKAYYYHIKGVYGTRFPEFPPLIFNFTAENQPLFLETPRLATEVKVIEFGQVVELVIQGTSLVGGGLDHPMHLHGFSFYVVGVGFGNYNISEEDPSSRYNLYDPPYKNTMTVPRNGWIAIRFVADNPGVWFMHCHLDRHQTWGMNVVFIVKNGREPNQQILPPPDDLPPCYE

SEQ ID NO: 22483 - protein, 528 aa, Arabidopsis thaliana
MEIPSLNKQQEFTLASVTDLTSPSSSLSSSPVVATFSCVNEVKELRFQESKSSDGFSFDLSSTQLFKLGPLQFTCVSDGSISSAKEKSSFSRGVVIKFRDEKDSKEFCDSFEECKKDDAVKQGSALPNGTVVSANKSKFDDKIEAASAKMYFHYYGQLLHQQNMLQDYVRTGTYHAAVMENRSDFSGRVVVDVGAGSGILSMFAALAGAKHVYAVEASEMAEYARKLIAGNPLLAERITVIKGKIEDIELPEKADVLISEPMGTLLVNERMLETYVIARDRFLSPNGKMFPTVGRIHMAPFADEFLFVEMANKALFWQQQNYYGVDLTPLYVSAHQGYFSQPVVDAFDPRLLVAPSMFHVIDFTMMTEEQFYEIDIPLKFTASVCTRIHGLACWFDVLFDGSTVQRWFTTAPGAPTTHWYQIRCVLSQPIHVMAGQEITGRLHLIAHSAQSYTINLTLSAKMWGPGANQGGILQTSSCKLDLKEPYYRMSQPQVYPTQEPPAQSQDIHIHSDDLEELELLQQNANAQL

SEQ ID NO: 22484 - protein, 287 aa, Arabidopsis thaliana
MGGSASLQSDSMEAAAAADSSIPRDKDFGKFQFGCEHYKRRCKIRAPCCNLIFSCRHCHNDSANSLPDPKERHDLVRQNVKQVVCSICQTEQEVAKVCSNCGVNMGEYFCDICKFFDDDISKEQFHCDDCGICRVGGRDKFFHCQNCGACYGMGLRDKHSCIENSTKNSCPVCYEYLFDSVKAAHVMKCGHTMHMDCFEQMINENQYRCPICAKSMVDMSPSWHLLDFEISATEMPVEYKFEVSILCNDCNKGSKAMFHILGHKCSDCGSYNTRRISTPQDPVSETE

SEQ ID NO: 22485 - protein, 590 aa, Arabidopsis thaliana
MVNSNEEDERRILDVEESLLTQEEVNNHLTGLSSTAEDGSIDIYGNPPSKKKTGNWKACPFILGNECCERLAYYGIAKNLITYYTSELHESNVSAASDVMIWQGTCYITPLIGAVIADSYWGRYWTIASFSAIYFIGMALLTLSASLPVLKPAACAGVAAALCSPATTVQYAVFFTGLYLIALGTGGIKPCVSSFGADQFDDTDPRERVRKASFFNWFYFSINIGSFISSTLLVWVQENVGWGLGFLIPTVFMGVSIASFFIGTPLYRFQKPGGSPITRVCQVLVAAYRKLKLNLPEDISFLYETREKNSMIAGSRKIQHTDGYKFLDKAAVISEYESKSGAFSNPWKLCTVTQVEEVKTLIRMFPIWASGIVYSVLYSQISTLFVQQGRSMNRIIRSFEIPPASFGVFDTLIVLISIPIYDRFLVPFVRRFTGIPKGLTDLQRMGIGLFLSVLSIAAAAIVETVRLQLAQDFVAMSIFWQIPQYILMGIAEVFFFIGRVEFFYDESPDAMRSVCSALALLNTAVGSYLSSLILTLVAYFTALGGKDGWVPDDLNKGHLDYFFWLLVSLGLVNIPVYALICVKHTKKKAL

SEQ ID NO: 22486 - protein, 484 aa, Arabidopsis thaliana
MRFLSLVGNSFGCSASGERLVSAARDGDLQEAKALLDYNPRLARYSTFGVRNSPLHYSAAQGHHEIVSLLVESGVDINLRNYRGQIHRSDYLNGGTALHLAALNGHPRCIRILLSEYIPSVPNCWSLLKNKKTSVAGFDSSVLHEVINRAADGGITPLHVAALNGHIETVQLLLDLGASVTQVTVEDGTTIDLIGAGSTALHYASCGGNTQCCQLLISKGACLAAVNSNGWTPMMVARSWHRNWLEEILNPTTEQPQLHLPNVPSPFLCLPLMSIVNIAQECGWRENDCLTPCRDPCAVCLERKCTVAADGCAHEFCTNCALYLSTTSITSSKTSNVTPGSVPCPLCRNGIVSFTKLPHTTATTRTSTSSRTSISLSFCTCSSDVLDTALLTNPHYSCKPVVSRTGSRTPQSARSSAFRSLSCRRFPPSLCLGGSDVDEPRSRLIGGSYSRSGVGFRRSTSQVEGKRSWFSALNHCVTTGGSAC

SEQ ID NO: 22487 - protein, 471 aa, Arabidopsis thaliana
MTILVVDRYYMLMNLLFALTCLLLNLTHCFSPKKFNISAATTSDSDWSIAGSTWYGNPTGYGSDGGACGYGNAVAQPPFSKMVSAGGPSLFKSGKGCGACYQVKCTSKSACSKNPVTVVITDECPGCVKESVHFDLSGTAFGAMAISGQDSQLRNVGELQILYKKVECNYIGKTVTFQVDKGSNANSFAVLVAYVNGDGEIGRIELKQALDSDKWLSMSQSWGAVWKLDVSSPLRAPLSLRVTSLESGKTVVASNVIPANWQPGGACGFAVANPPLYGMVSAGGPSVFNNGIGCGTCFQILCNGHPACSRRPITVTITDECPGGPCASEPAHFDLSGKAMGALARPGQGDRLRSAGVLRVYYRRVECLYRRTNIAFRMDPGANPYYISFVVEYENGDGDLAYIEIQPADGEFIPMQEMRSAVWKISSGSPLTGPFNIRLTSAESHKVVLAYNVIPANWKPNETYRSVVNFK

SEQ ID NO: 22488 - protein, 415 aa, Arabidopsis thaliana
MGLSLRVRRRGGSVSKKEIIPVTSCSEEVEITIPSQFQCPISYELMKDPWFESGYQTCPVTNTVLTSLEQIPNHTIRRMIQGWCGSSLGGGIERIPTPRVPVTSHQVSEICERLSAATRRGDYAACMEMVTKMTRLGKESERNRKCVKENGAGLVLCVCFDAFSENANASLLLEETVSVLTWMLPIGLEGQSKLTTTSSFNRLVELLRNGDQNAAFLIKELLELNVTHVHALTKINGVQEAFMKSINRDSTCVNSLISIHHMILTNQETVSRFLELDLVNITVEMLVDSENSVCEKALTVLNVICETKEGREKVRRNKLVIPILVKKILKISEKKDLVSVMWKVCKSGDGSEVEEALRLGAFKKLVVMLQVGCGEGTKEKVTELLKMMNKVMKMNGFVDRSYSSSIEFKHVKKPF

SEQ ID NO: 22489 - protein, 738 aa, Arabidopsis thaliana
MEVCNCIEPQWPADELLMKYQYISDFFIAIAYFSIPLELIYFVKKSAVFPYRWVLVQFGAFIVLCGATHLINLWTFTTHSRTVALVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCMPGVENYQIALRIHEKFTKQRHQRPLLVALSGNTDKSTKEKCMSFGLDGVLLKPVSLDNIRDVLSDLLEPRVLYEGM

SEQ ID NO: 22490 - protein, 453 aa, Arabidopsis thaliana
MLEVLQAIVLFILFWVWLSWMGGSSSKESPRGGGSGRRYERSVSGSSSYSSAWDQSSYYQTPNHPSASPVSSYNSGRQTPKNLERKYSRIADNYRSIDEVTAALSHAGLESSNLIVGIDVTKSNEWTGARSFGRKSLHFIGTTPNPYQQAISIIGKTLSVFDEDNLIPCYGFGDATTHDQDVFSFNPNDTYCNGFEEVLMCYREIVPQLRLSGPTSFAPIIERAMTIVEESGGQYHVLLIIADGQVTRSVDTDNGGFSPQEQQTIDAIVRASEYPLSIVLVGVGDGPWDTMRQFDDNIPARAFDNFQFVNFTDIMSKNIDPARKEAEFALSALMEIPSQYKATLELGLLGQRTGHCPDRIALPPPTYATQSMRNSPRTSRSTSFQNKPYDNGVSSTPPSTTHNESQQQFCPVCLVSAKNMAFNCGHQTCAGCGEDLHVCPICRSSISVRIKLY

SEQ ID NO: 22491 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 22492 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKVWVIGSYGGRARQDLPKVVKLAESGIFNLTNAVSSKYKFEDAGKAFQDLNEGKIVSRGVVEIL

SEQ ID NO: 22493 - protein, 305 aa, Arabidopsis thaliana
MASRREVRCRCGRRMWVQPDARTVQCSTCHTVTQLYSLVDIARGANRIIHGFQQLLRQHQPQHHEQQQQQMMAQPPPRLLEPLPSPFGKKRAVLCGVNYKGKSYSLKGCISDAKSMRSLLVQQMGFPIDSILMLTEDEASPQRIPTKRNIRKAMRWLVEGNRARDSLVFHFSGHGSQQNDYNGDEIDGQDEALCPLDHETEGKIIDDEINRILVRPLVHGAKLHAVIDACNSGTVLDLPFICRMERNGSYEWEDHRSVRAYKGTDGGAAFCFSACDDDESSGYTPVCFHYIIHHHATKHTYLSVC

SEQ ID NO: 22494 - protein, 559 aa, Arabidopsis thaliana
MNNRGNNDDLDHHYGVFNGNFFLNDLRTSQENQNKIIRFDFESCFFVIDFERRMTSRKKSVLDNTSPMIWKTVSERKSSPGIEGLNLSSFDRPMAPTTEIRELRVFLATWNVGGRTPNNDLNLEDFLLVEGTADLYICGFQEIVPLSAGNVLVVEDNEPAAKWLALISQALNKPKQESVYSNAAYSASRTTTCSSSSCGSEESRAPSSLSFFQRPNLKVLSRNYRVDSSLLKTCNCPVIDTSVGWEARRSKRFSDPSTDSSNNVEPENFRVHENFLFDDVPATTKMPGQMSYRLIASKQMVGLFLSVWARRELIPHISHLRLDSVGRGIMGRLGNKGCIAISMSLHQTSFCFVCSHLASGEKEGDELRRNADVAEILKHTQFPKLTKNPNCHAPERIIDHDRVLWLGDLNYRVALTYEETRVLLEDNDWDTLLERDQLNMERGAGRVFSGFQEGQIFFAPTYKYSQNSDAYAGEMTKSKKKRRTPAWCDRILWKGEGIEQLSYIRGESRFSDHRPVCAIFAVEVDVKSLNKGRFRKGYSCAAVRLVEDVAIPQRHSFYD

SEQ ID NO: 22495 - protein, 248 aa, Arabidopsis thaliana
MATTLSRDQYVYMAKLAEQAERYEEMVQFMEQLVSGATPAGELTVEERNLLSVAYKNVIGSLRAAWRIVSSIEQKEESRKNEEHVSLVKDYRSKVETELSSICSGILRLLDSHLIPSATASESKVFYLKMKGDYHRYLAEFKSGDERKTAAEDTMIAYKAAQDVAVADLAPTHPIRLGLALNFSVFYYEILNSSEKACSMAKQAFEEAIAELDTLGEESYKDSTLIMQLLRDNLTLWTSDMQEQMDEA

SEQ ID NO: 22496 - protein, 246 aa, Arabidopsis thaliana
MATTLSRDQYVYMAKLAEQAERYEEMVQFMEQLVSGATPAGELTVEERNLLSVAYKNVIGSLRAAWRIVSSIEQKEESRKNEEHVSLVKDYRSKVETELSSICSGILRLLDSHLIPSATASESKVFYLKMKGDYHRYLAEFKSGDERKTAAEDTMIAYKAAQDVAVADLAPTHPIRLGLALNFSVFYYEILNSSEKACSMAKQAFEEAIAELDTLGEESYKDSTLIMQLLRDNLTLWTSDMQMDEA

SEQ ID NO: 22497 - protein, 338 aa, Arabidopsis thaliana
MSPEEELQSNVSVASSSPTSNCISRNTLGGLKEHNYLGLSDCSSVGSSTLSPLAEDDKATISLKATELTLGLPGSQSPARDTELNLLSPAKLDEKPFFPLLPSKDEICSSSQKNNASGNKRGFSDTMDQFAEAKSSVYTEKNWMFPEAAATQSVTKKDVPQNIPKGQSSTTNNSSSPPAAKAQIVGWPPVRSYRKNTLATTCKNSDEVDGRPGSGALFVKVSMDGAPYLRKVDLRSYTNYGELSSALEKMFTTFTLGQCGSNGAAGKDMLSETKLKDLLNGKDYVLTYEDKDGDWMLVGDVPWEMFIDVCKKLKIMKGCDAIGLAAAPRAMEKSKMRA

SEQ ID NO: 22498 - protein, 336 aa, Arabidopsis thaliana
MSPEEELQSNVSVASSSPTSNCISRNTLGGLKEHNYLGLSDCSSVGSSTLSPLAEDDKATISLKATELTLGLPGSQSPARDTELNLLSPAKLDEKPFFPLLPSKDEICSSSQKNNASGNKRGFSDTMDQFAEAKSSVYTEKNWMFPEAAATQSVTKKDVPQNIPKGQSSTTNNSSSPPAAKAQIVGWPPVRSYRKNTLATTCKNSDEVDGRPGSGALFVKVSMDGAPYLRKVDLRSYTNYGELSSALEKMFTTFTLGQCGSNGAAGKDMLSETKLKDLLNGKDYVLTYEDKDGDWMLVGDVPWEMFIDVCKKLKIMKGCDAIGLAPRAMEKSKMRA

SEQ ID NO: 22499 - protein, 409 aa, Arabidopsis thaliana
MIDTLFFLFFLFFDSPLRRLLLLCAVLALRAPTAHSPILRSSIVTPTARAVSEVSGCTTIDPDFLVEISDSNQTRAMSKARVYTEVNVIRPKDYWDYESLIVQWGEQDDYEVVRKVGRGKYSEVFEGINVNSKEKCIIKILKPVKKKKIRREIKILQNLCGGPNIVKLLDVVRDQHSKTPSLIFEYVNSTDFKVLYPTLTDYDIRYYIYELLKALDFCHSQGIMHRDVKPHNVMIDHELRKLRLIDWGLAEFYHPGKEYNVRVASRYFKGPELLVDLQDYDYSLDMWSLGCMFAGMIFRKEPFFYGHDNQDQLVKIAKVLGTDELNAYLNKYQLELDPQLEALVGRHSRKPWSKFINADNQHLVSPEAIDFLDKLLRYDHQDRLTAKEAMAHAYFAQVRAAETSRMRSQ

SEQ ID NO: 22500 - protein, 572 aa, Oryza sativa (japonica cultivar-group)
MNSGGRSLLSSPLFASSSPAFRGGAAAASCSSSSSPSSSSRATVVPMVHDTGGGRASSTACHYSPSLVAAEPEEHVHGRSKDDDDDAAVSLMGEKALLELLLDMALEQHAPGKKLPAEEREESEFDIYLRDDKSHVLYHPEFSSTSVSSSPLSVKSSERSDLGTASAVLTKDVALLAEETDILATQLKASQLYSVDSSKSNEELQSKGQVFVRSTRLLERRSKRRYAPRASIADVSCSADNSKKKEKSKKYGRVLEPDEPFKLFLRDRETTEFLTAKEERHLFSKIQILMKIEEAHRKLEVQCGREPTLAEWAEAVGMSSKELQSSIRTGRRCREKMARSNFRLVIHVARKYEGYGLDIQDLVQDGCSGLMKTFEKFNPSKGCRFPTYAYWWIRQSIKKSIFKNSRLIRLPESVYALLRKVGKARMECIMEGEQPTNANVARRAGITIEKLAKLRAKTRKPRSMQDHVWSDEGVTFQEITEDPNVEPPDLSVDRMMMRQQVRDFLGILSPREKEIIEHRFGIHDGEPKTLHVIGDMFGLSKERIRQLQNRALEKLKRSASLQGFDVYFDLLT

SEQ ID NO: 22501 - protein, 523 aa, Phragmites australis
MEVGAPGSSLHGVTGREPAFAFSTSAVPDDDAASKFDLPVDSEHKAKSIRLFSFANPHMRTFHLSWISFFTCFVSTFAAAPLVPIIRDNLNLTKADIGNAGVASVSGSIFSRLAMGAICDLLGPRYGCAFLIMLTAPTVFCMSLIDDAAGYIVVRFLIGFSLATFVSCQYWMSTMFNSKIIGTVNGLAAGWGNMGGGATQLPMPLVYDVIRKCGATPFTAWRIAYFVPGLMHVVMGILVLTLGQDLPDGNLRSLQKKGDANKDKFSKVLWYAVTNYRTWIFVLLYGYCMGVELTTDNVIAEYYYDHFDLDLRVAGIIAACFGMANIVARPLGGILSDIGARYWGMRARLWNIWILQTAGGAFCLWLGRASTLPASITAMVLFSFCAQAACGAIFGVTPFVTRRSLGIMSGMTGAGGNFGAGLTQLLFFTSSKYSTGMGLEYMGIMIMACTLPVVFVHFPQWGSMLLPPSAGAVEEHYYSSEWSEEEKSKGLHSSSLKFSENCRSERGNRNVILAAPNSTPEHV

SEQ ID NO: 22502 - protein, 503 aa, Oryza sativa (japonica cultivar-group)
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWYKSPSKL

SEQ ID NO: 22503 - protein, 355 aa, Mus musculus
AAAAAAVAAAADMLLLKKQTEDISSVYEIREKLGSGAFSEVMLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALQHLWISGDAAFDRDILGSVSEQIQKNFARTHWKRAFNATSFLRHIRKLGQSPEGEEASRQCMTRHSHPGLGTSQSPKW

SEQ ID NO: 22504 - protein, 244 aa, Triticum aestivum
MGRGKVQLKRIENKINRQVTFSKRRSGLLKKAHEISVLCDAEVGLIIFSTKGKLYEFSTESCMDKILERYERYSYAEKVLVSSESEIQGNWCHEYRKLKAKVETIQKCQKHLMGEDLESLNLKELQQLEQQLESSLKHIRSRKNQLMHESISELQKKERSLQEENKVLQKELVEKQKAQAAQQDQTQPQTSSSSSSFMMRDAPPAATTSIHPAASGERAEDAAVQPQAPPRTGLPLWMVSHING

SEQ ID NO: 22505 - protein, 528 aa, Aedes aegypti
MSSSDTTQPPAVPVTQPARVIQPSAALIVKEGWLYKRGEHIKNWRSRYFILRDDGTLVGYKNRPDASFQAEPSNNFTVRGCQIMSVDRPRPFTFIIRGLQWTTVIERMFHVEEERERQEWVEAIRSVANRLTEAEAYQGSQSNGDGDVEMASIAEDELLTEKFSVQGTSTGKISGRKKVTLENFEFLKVLGKGTFGKVILCREKTTAKLYAIKILKKEVIVQKDEVAHTMAENRVLKKTNHPFLISLKYSFQTVDRLCFVMQYVNGGELFFHLSRERVFSEDRTRFYGAEIISALGYLHSHEIVYRDLKLENLLLDKDGHIKIADFGLCKEQITYGRTTKTFCGTPEYLAPEVLEDNDYGLAVDWWGTGVVMYEMMCGRLPFYNRDHDILFTLILMEEVKFPRSISANARDLLAGLLMKQPRDRLGGGPNDVKEIMVHPFFSSINWTDLVQKRIAPPFKPQVTSDTDTRYFDSEFTGESVELTPPDNNGPLGAVQEEPHFSQFSYQDMASTLNTPSFINNPNSYVSMQ

SEQ ID NO: 22506 - protein, 219 aa, Mus musculus
MGYGLLHESMLSSVLHARTKWLKEGGLLLPASAELFVAPISDQMLEWRLGFWSQVKQHYGVDMSCMESFATRCLMGHSEIVVQDLSGEDVLARPQRFAQLELARAGLEQELEAGVGGRFRCSCYGSAPLHGFAVWFQVTFPGGDSEKPLVLSTSPFHPATHWKQALLYLNEPVPVEQDTDISGEITLLPSPDNPRRLRILLRYKVGDHEEKTKDFAMED

SEQ ID NO: 22507 - protein, 622 aa, Mus musculus
MVPVENTEGPNLLNQKGREAETEGSCGASGGGHPACAGGPSMFTFLTSVTAAISGLLVGYELGLISGALLQIRTLLALTCHEQEMVVSSLLIGAFLASLTGGVLIDRYGRRLAIILSSCLLGLGSLVLIMSLSYTLLIMGRVAIGVSISLSSIATCVYIAEIAPQHRRGLLVSLNELMIVTGILFAYISNYAFANISNGWKYMFGLVIPLGVLQAIAMYFLPPSPRFLVMKGQEESAGKVLRKLRVISDTTEELTLIKSSLKDEYQYSFWDLFRSKDNMRTRILIGLTLIFFVQTTGQPNILFYASTVLKSVGFQSNEAASLASTGVGVVKVVSTIPATLLVDHIGSKTFLCIGSSVMSASLLTMGIVNLNINMNFTNICRSHSLLNQSLEEFVFYATGNLSISNSSLREHFKRITPYSKGSFMPMGNGMEPKGEMTFTSSLPNAGLSRTEHQGVTDTAVVPAAYKWLSLASLLVYVAAFSIGLGPMPWLVLSEIFPGGIRGRAMALTSSMNWGVNLLISLTFLTVTDLIGLSWVCFIYTIMSLASLAFVVLFIPETKGCSLEQISVELAKANYVKNNICFMSHHQEELVPTQLQKRKPQEQLPECNHLCGRGQSQRPSPDT

SEQ ID NO: 22508 - protein, 376 aa, Tritrichomonas foetus
AKYYNEPCHTFNEYLLIPGLSTVDCIPSNVNLSTPLVKFQKGQQSEINLKIPLVSAIMQSVSGEKMAIALAREGGISFIFGSQSIESQAAMVHAVKNFKDSQKRYLVGAGINTRDFRERVPALVEAGADVLCIDSSDGFSEWQKITIGWIRDKYGDKVKVGAGNIVDGEGFRYLADAGADFIKIGIGGGSICITREQKGIGRGQATAVIDVVAERNKYFEETGIYIPVCSDGGIVYDYHMTLALAMGADFIMLGRYFARFEESPTRKVTINGSVMKEYWGEGSSRARNWQRYDLGGKQKLSFEEGVDSYVPYAGKLKDNVEASLNKVKSTMCNCGALTIPQLQSKAKITLVSSVSIVEGGAHDVIVKDRINDYHPK

SEQ ID NO: 22509 - protein, 251 aa, Lactobacillus brevis
SNRLDGKVAIITGGTLGIGLAIATKFVEEGAKVMITGRHSDVGEKAAKSVGTPDQIQFFQHDSSDEDGWTKLFDATEKAFGPVSTLVNNAGIAVNKSVEETTTAEWRKLLAVNLDGVFFGTRLGIQRMKNKGLGASIINMSSIEGFVGDPSLGAYNASKGAVRIMSKSAALDCALKDYDVRVNTVHPGYIKTPLVDDLPGAEEAMSQRTKTPMGHIGEPNDIAYICVYLASNESKFATGSEFVVDGGYTAQ

SEQ ID NO: 22510 - protein, 432 aa, Trypanosoma brucei brucei
GSHMTIQKVHGREVLDSRGNPTVEVEVTTEKGVFRSAVPSGASTGVYEACELRDGDKKRYVGKGCLQAVKNVNEVIGPALIGRDELKQEELDTLMLRLDGTPNKGKLGANAILGCSMAISKAAAAAKGVPLYRYLASLAGTKELRLPVPCFNVINGGKHAGNALPFQEFMIAPVKATSFSEALRMGSEVYHSLKGIIKKKYGQDAVNVGDEGGFAPPIKDINEPLPILMEAIEEAGHRGKFAICMDCAASETYDEKKQQYNLTFKSPEPTWVTAEQLRETYCKWAHDYPIVSIEDPYDQDDFAGFAGITEALKGKTQIVGDDLTVTNTERIKMAIEKKACNSLLLKINQIGTISEAIASSKLCMENGWSVMVSHRSGETEDTYIADLVVALGSGQIKTGAPCRGERTAKLNQLLRIEEELGAHAKFGFPGWS

SEQ ID NO: 22511 - protein, 373 aa, Rana perezi
MCTAGKDITCKAAVAWEPHKPLSLETITVAPPKAHEVRIKILASGICGSDSSVLKEIIPSKFPVILGHEAVGVVESIGAGVTCVKPGDKVIPLFVPQCGSCRACKSSNSNFCEKNDMGAKTGLMADMTSRFTCRGKPIYNLMGTSTFTEYTVVADIAVAKIDPKAPLESCLIGCGFATGYGAAVNTAKVTPGSTCAVFGLGGVGFSAIVGCKAAGASRIIGVGTHKDKFPKAIELGATECLNPKDYDKPIYEVICEKTNGGVDYAVECAGRIETMMNALQSTYCGSGVTVVLGLASPNERLPLDPLLLLTGRSLKGSVFGGFKGEEVSRLVDDYMKKKINVNFLVSTKLTLDQINKAFELLSSGQGVRSIMIY

SEQ ID NO: 22512 - protein, 394 aa, Arabidopsis thaliana
MSLKSILRDLKEVRDGLGGISKRSWSKSSHIAPDQTTPPLDNIPQSPWASLPPELLHDIIWRVEESETAWPARAAVVSCASVCKSWRGITMEIVRIPEQCGKLTFPISLKQPGPRDSPIQCFIKRNRATATYILYYGLMPSETENDKLLLAARRIRRATCTDFIISLSAKNFSRSSSTYVGKLRSGFLGTKFTIYDNQTASSTAQAQPNRRLHPKQAAPKLPTNSSTVGNITYELNVLRTRGPRRMHCAMDSIPLSSVIAEPSVVQGIEEEVSSSPSPKGETITTDKEIPDNSPSLRDQPLVLKNKSPRWHEQLQCWCLNFKGRVTVASVKNFQLVAEIDASLDAPPEEHERVILQFVKIGKDIFTMDYRYPLSAFQAFAICISSFDTKPACEG

SEQ ID NO: 22513 - protein, 929 aa, Mus musculus
MEPRDPSPEGRSSDSESASASSSGSERDAGPEPDKAPRRLTKRRFPGLRLFGHRKAITKSGLQHLAPPPPTPGAPCGESEEQIQSTVDWSESAVYGEHIWFETNVSGDFCYVGEQHCVAKMLPKSAPRKKCAACKIVVHTQCIKQLEKINFRCKPSFRESGSRNVREPTFVRHHWVHRRRQDGKCRHCGKGFQQKFTFHSKEIVAISCSWCKQAYHSKVSCFMMQQIEEPCSLGVHAAVVIPPTWILRARRPQNTLKASKKKKRASFKRRSSKKGPEEGRWRPFIIRPTPSPLMKPLLVFVNPKSGGNQGAKIIQSFLWYLNPRQVFDLSQGGPREALEMYRKVHNLRILACGGDGTVGWILSTLDQLRLKPPPPVAILPLGTGNDLARTLNWGGGYTDEPVSKILSHVEEGNVVQLDRWDLRAEPNPEAGPEERDDGATDRLPLDVFNNYFSLGFDAHVTLEFHESREANPEKFNSRFRNKMFYAGTAFSDFLMGSSKDLAKHIRVVCDGMDLTPKIQDLKPQCIVFLNIPRYCAGTMPWGHPGEHHDFEPQRHDDGYLEVIGFTMTSLAALQVGGHGERLTQCREVLLTTAKAIPVQVDGEPCKLSASRIRIALRNQATMVQKAKRRSTAPLHSDQQPVPEQLRIQVSRVSMHDYEALHYDKEQLKEASVPLGTVVVPGDSDLELCRAHIERLQREPDGAGAKSPMCHQLSSKWCFLDATTASRFYRIDRAQEHLNYVTEIAQDEIYILDPELLGASARPDLPTPTSPLPASPCSPTPGSMQGDTALPQGEELIEAAKRNDCCKLQELHRAGGDLMHRDQKSRTLLHHAVSTGSKEVVRYLLDHAPPEILDAVEENGETCLHQAAALGQRTICHYIVEAGASLMKTDLQGDTPRQRAEKAQDTELSAYLENRQHYQMIQREDQETAV

SEQ ID NO: 22514 - protein, 394 aa, Bos taurus
MGCLGNSKTEDQRNEEKAQREANKKIEKQLQKDKQVYRATHRLLLLGAGESGKSTIVKQMRILHVNGFNGEGGEEDPQAARSNSDGEKATKVQDIKNNLKEAIETIVAAMSNLVPPVELANPENQFRVDYILSVMNVPDFDFPPEFYEHAKALWEDEGVRACYERSNEYQLIDCAQYFLDKIDVIKQDDYVPSDQDLLRCRVLTSGIFETKFQVDKVNFHMFDVGGQRDERRKWIQCFNDVTAIIFVVASSSYNMVIREDNQTNRLQEALNLFKSIWNNRWLRTISVILFLNKQDLLAEKVLAGKSKIEDYFPEFARYTTPEDATPEPGEDPRVTRAKYFIRDEFLRISTASGDGRHYCYPHFTCAVDTENIRRVFNDCRDIIQRMHLRQYELL

SEQ ID NO: 22515 - protein, 350 aa, Bos taurus
MGAGASAEEKHSRELEKKLKEDAEKDARTVKLLLLGAGESGKSTIVKQMKIIHQDGYSLEECLEFIAIIYGNTLQSILAIVRAMTTLNIQYGDSARQDDARKLMHMADTIEEGTMPKEMSDIIQRLWKDSGIQACFDRASEYQLNDSAGYYLSDLERLVTPGYVPTEQDVLRSRVKTTGIIETQFSFKDLNFRMFDVGGQRSERKKWIHCFEGVTCIIFIAALSAYDMVLVEDDEVNRMHESLHLFNSICNHRYFATTSIVLFLNKKDVFSEKIKKAHLSICFPDYNGPNTYEDAGNYIKVQFLELNMRRDVKEIYSHMTCATDTQNVKFVFDAVTDIIIKENLKDCGLF

SEQ ID NO: 22516 - protein, 323 aa, Bos taurus
MDPKGQRVKLNDGHFIPVLGFGTFAPREVPKSEALEVTKFAIEAGFRHIDSAHLYQNEEQVGQAIRSKIADGTVKREDIFYTSKLWSTSLRPELVRPALEKSLNNLQLDYVDLYIIHFPVALKPGETLFPTDENGKPIFDSVDLCRTWEALEKCKDAGLTKSIGVSNFNHKQLEKILNKPGLKYKPVCNQVECHPYFNQSKLLDFCKSHDIVLVAYGALGSQRLKEWVNPNLPFLLEDPVLSAIAKKHRQTPALVALRYQIQRGVVVLAKSYNKKRIKENIQVFDFELTPEDMKAIDGLNSNMRYNELLLGVGHPEYPFVEEY

SEQ ID NO: 22517 - protein, 536 aa, Caenorhabditis elegans
MEMDVYDELLAAALFIVFSSIVLWVFRKLWAVRKRKNINDTSSKSGHYWSSINYSEQHNYCSGCKEHIVSGYECDNCLLKVDNINCLRAVSTKIQCKVNPIHCRKETFDHHWICGNIGADLFCEVCEELCGGVGLQDFRCSWCWRVVHTKCKPKFTKHCDFGGLKRTIIPPYCVTTRRPGNRNQRMAVIDKIEIPVDIEKWRPIMVIVNPKSGSGAGKQLLRNFRAHLHPAQVVDVLKSNIAASLRWIDEHPNVDVRILIAGGDGTICSALDQIDTLSRRIPVAVLPLGTGNDLSRLLKWGKKCDGDIDVIKLMEDIQEAEVTLVDRWTIDAESQKKLGVRLQSNKTLSMTNYVSVGVDACVTLGMQNTRESIPRAMSSRLLNKFLFFTFGTKDVFERVCKGLNERIDLYLDDVHVNLPDIEGLIFLNIPYWGAGVKPWATYNDSHRQECDDEMIEVFAVTSSFHIAQMQIGLASPLCIGQAKHAKLVFKGNHSFPMQSDGEAWVNSAGTVLISHKCKTAMLRKAEKQTTGCGMFF

SEQ ID NO: 22518 - protein, 144 aa, Caenorhabditis elegans
MAVIDKIEIPVDIEKWRPIMVIVNPKSGSGAGKQLLRNFRAHLHPAQVVDVLKSNIAASLRWIDEHPNVDVRILIAGGDGTICSALDQIDTLSRRIPVAVLPLGTGNDLSRLLKWGKKCDGDIDVIKVCAFPESDNYERPDFYS

SEQ ID NO: 22519 - protein, 351 aa, Caenorhabditis elegans
MAVIDKIEIPVDIEKWRPIMVIVNPKSGSGAGKQLLRNFRAHLHPAQVVDVLKSNIAASLRWIDEHPNVDVRILIAGGDGTICSALDQIDTLSRRIPVAVLPLGTGNDLSRLLKWGKKCDGDIDVIKLMEDIQEAEVTLVDRWTIDAESQKKLGVRLQSNKTLSMTNYVSVGVDACVTLGMQNTRESIPRAMSSRLLNKFLFFTFGTKDVFERVCKGLNERIDLYLDDVHVNLPDIEGLIFLNIPYWGAGVKPWATYNDSHRQECDDEMIEVFAVTSSFHIAQMQIGLASPLCIGQAKHAKLVFKGNHSFPMQSDGEAWVNSAGTVLISHKCKTAMLRKAEKQTTGCGMFF

SEQ ID NO: 22520 - protein, 210 aa, Caenorhabditis elegans
MLLPISILFSIIPIASSTFGGCCSMGPPPCPPPPPPMCAPPPLPCPPPPICPPQFCPPPPMCPPPPPPPPPPMCPPPPPPMPSYSPCQSYAPAPVFNQYAMQPANDCCCRCGSPCRFMARHRTHGSKLFTTEDPEEDPTCNSKKLRRVMERNMNGDPSISKRAIQKAVEEKMFGKFNVICARGDFSYVAYTETYCQVANDDVTCYAFRPM

SEQ ID NO: 22521 - protein, 476 aa, Streptomyces rochei
MPAEFTDFKVADLSLAEFGRKEITLAEHEMPGLMAIRKEYAGEPPLAGARITGSLHMTVQTAVLIETLVALGAEVRWASCNIFSTQDHAAAAIAVGPDGTPDNPRGVPVFAWKGETLEEYWWCTEQALTWPDSPTGGPNMILDDGGDATLLVHKGVEYRKTGELPPADNEELAAVAALLKASNLDWTGIASEIRGVTEETTTGVHRLYEMQRDGVLLFPAINVNDAVTKSKFDNKYGCRHSLVDGINRATDVLIGGKTAVVCGYGDVGKGCAESLRGQGARVIVTEIDPICALQAAMDGYQVTTLDEVVETADIFVTTTGNKDIIMASDMARMKHQAIVGNIGHFDNEIDMAGLARVPGIVKDEVKPQVHTWTFPDGKVIIVLSEGRLLNLGNATGHPSFVMSNSFADQTLAQIELFTKPDQYPTGVYTLPKHLDEKVARLHLDALGVKLTTLRPEQAAYIGVEVEGPYKPDHYRY

SEQ ID NO: 22522 - protein, 1135 aa, Streptomyces rochei
MVVADGAMGTMLQAQDPTLDDFQQLEGCNEILNVTRPDIVRSVHEAYFAVGVDCVETNTFGANHAALGEYDISDRVHELSAAGARVAREVADEFTARDGRARWVLGSMGPGTKLPTLGHAPYRTLRDAYQANAEGLVEGGADALLVETTQDLLQTKAAVLGARRALAAAGADLPVIVSVTVETTGTMLLGSEIGAALTALEPLGIDMIGLNCATGPAEMSEHLRYLARNARVPLSCMPNAGLPVLGKDGAHYPLSPGELAEAQGTFVRENGVSLVGGCCGTTPEHLRQVVERVRGLAPSARDPRPEAGAASLYQSVPFRQDTSYLAIGERTNANGSKKFREAMLEARWDDCVEIAREQIREGAHMLDLCVDYVGRDGVADMAELAGRLATASTLPIVLDSTEVDVIEAGLERLGGRAVINSVNYEDGDGPESRFARVTALAREHGAALIALTIDEEGQARTAGHKVAIAERLIADLTGNWGIRESDILIDTLTFTICTGQEESRGDGVATIEAIRELKRRHPRVQTTLGLSNISFGLNPAARILLNSVFLDECVKAGLDSAIVHASKILPIARFSEEEVQTALDLIYDRRAEGYDPLQKLMQLFEGATAKSLKAGKAEELAALPLEERLKRRIIDGERNGLEADLDTALRERPALDIVNETLLDGMKVVGELFGSGQMQLPFVLQSAEVMKAAVAHLEPHMEKSDADGKGTIVLATVRGDVHDIGKNLVDIILSNNGYNVVNLGIKQPVSAILEAAEEHRADVIGMSGLLVKSTVIMKENLEELNQRDLAGTYPVILGGAALTRAYVEQDLHEIYQGEVRYARDAFEGLRLMDALIGVKRGVPGAKLPELKQRRVAARRAVPEEPAEAGRSDVATDNPVPAPPFWGTRVVKGIQLREYASWLDEGALFKGQWGLKGETIEGEGRPRLRMWLDRLLTGNLLEAAVVHGYFPCVSKDDDLIVLDEHGNERTRFTFPRQRRGRRLCLADFFRPQESGETDVVGFQVVTVGSRIGAETAKLFEADAYRDYLELHGLSVQLAEALAEYWHARVRGELGIGGSDPAAMEGMFRTEYQGCRYSFGYPACPDLEDRAKIAELLRPERIGVHLSEEFQLHPEQSTDALVVHHPEAGYFNAGGRA

SEQ ID NO: 22523 - protein, 260 aa, Streptomyces rochei
MPDHHPVALVTGATSGIGLETARQLGRAGHRVFLCARTAKDVQDTVEALRAEGLDAAGQAADVRARESVTALVAAAVETFGPVGVLVNNAGRSGGGVTADLTDDLWYDVIDTNLNSVFLVTREVLRNGGLAGAASGRIINIASTAGKQGVLLGAPYSASKHAVVGFTKALGRELAPSGVTVNAVCPGYVETPMAQRVRQGYAAAWDTGEEDVRSRFEAKIPLGRYSTPAEVASLVVYLASESAASITAQALNVCGGLGNY

SEQ ID NO: 22524 - protein, 344 aa, Streptomyces rochei
MRSLTYSQAISEATVQCMEADPAIVLAGQSVDDYKGVYGTTGEAFARFGSARVIDIPNGENAFAGIAIGAATMGLRPLLVHTRDDFMFLAMDALINLAAKWRYMYGGKRGVPVVSRGVVGRGWGQGATHSQSLQSLFGHFPGLHVATPASPADAKGLLVTALQGDTPVVLLENRGLYDLRGEVPSEPVAVPFGKGRVVRAGDDVTIVAASLMVHEAERAAGVLAARGISAEVVDVRSIRPLDDALICASVAKTGHLVVADTSWARYGFTAEVVAVVAENVPGALKAPVRRVTPPDCPAPVSWPLENAFNPGAETVVRACLEVLGVAGGAVPRIRNVMAGFAGPY

SEQ ID NO: 22525 - protein, 512 aa, Rattus norvegicus
MLFEGLELVSALATLAACLVSVTLLLAVSQQLWQLRWAATRDKSCKLPIPKGSMGFPLIGETGHWLLQGSGFQSSRREKYGNVFKTHLLGRPLIRVTGAENVRKILLGEHQLVSTEWPRSARVLLGPNTVANSIGDIHRNKRKVFSKIFSHEALESYLPKIQLVIQDTLRAWSSQPEAINVYQEAQRLTFRMAVRVLLGFSIPEEDLGNLFEVYQQFVENVFSLPVDLPFSGYRRGIQARQILQKGLEKAVREKLQCTQGKDYSDALDILIESSKEHGKEMTMQELKDGTLELIFAAYATTASASTSLIMQLLKHPAVLEKLREELRAQGLLHGGGCPCEGTLRLDMLSGLRYLDCVIKEVMRLFTPVSGGYRTVLQTFELDGFQIPKGWSVMYSIRDTHDTAPVFKDVNVFDPDRFSQARSEDKDGRFHYLPFGGGVRTCLGKHLAKLFLKVLAVELASTSRFELATRTFPRITLVPVLHPVDGLSVKFFGLDSNQNEILPETEAMLSATV

SEQ ID NO: 22526 - protein, 727 aa, Mus musculus
GNCKGFKMAEKFESLMNIHGFDLGSRYMDLKPLGCGGNGLVFSAVDNDCDKRVAIKKIVLTDPQSVKHALREIKIIRRLDHDNIVKVFEILGPSGSQLTDDVGSLTELNSVYIVQEYMETDLANVLEQGPLLEEHARLFMYQLLRGLKYIHSANVLHRDLKPANLFINTEDLVLKIGDFGLARIMDPHYSHKGHLSEGLVTKWYRSPRLLLSPNNYTKAIDMWAAGCIFAEMLTGKTLFAGAHELEQMQLILDSIPVVHEEDRQELLSVIPVYIRNDMTEPHRPLTQLLPGISREALDFLEQILTFSPMDRLTAEEALSHPYMSIYSFPTDEPISSHPFHIEDEVDDILLMDETHSHIYNWERYHDCQFSEHDWPIHNNFDIDEVQLDPRALSDVTDEEEVQVDPRKYLDGDREKYLEDPAFDTSYSAEPCWQYPDHHENKYCDLECSHTCNYKTRSSPYLDNLVWRESEVNHYYEPKLIIDLSNWKEQSKEKSDKRGKSKCERNGLVKAQIALEEASQQLAERERGQGFDFDSFIAGTIQLSAQHQSADVVDKLNDLNSSVSQLELKSLISKSVSREKQEKGRANLAQLGALYQSSWDSQFVSGGEECFLISQFCCEVRKDEHAEKENTYTSYLDKFFSRKEDSEMLETEPVEEGKRGERGREAGLLSGGGEFLLSKQLESIGTPQFHSPVGSPLKSIQATLTPSAMKSSPQIPHKTYSSILKHLN

SEQ ID NO: 22527 - protein, 426 aa, Mus musculus
SRGERKRGSSTMAENLYRARSRVYSPSVLFLHPDMGIGGAERLVLDAALALQEYGCDVKIWTAHYDPNHCFIETRELSVQCAGDWLPRSLGWGGRGAAICSYVRMVFLALYVLFLSGEEFDVVVCDQVSACIPVFKLARRRKRVLFYCHFPDLLLTQRNSALKKFYRAPIDWIEEYTTGMADRILVNSQYTASVFKETFKTLSHRNPDVLYPSLNIGSFDLAIPEKIDDLVPKGKQFLFLSINRYERKKNLPLALRSLVQLRNRLPSQEWDKVHLFMAGGYDDRIPENVEHYKELKKMVQESDLERHVTFLRSFSDRQKISLLHGCLCVLYTPSNEHFGIVPLEAMYMQCPVIAVNNGGPLESIVHKVTGFLCEPDPVHFSEAMEKFIHKPSLKATMGLAGKARVAEKFSADAFADQLYQYVTKLV

SEQ ID NO: 22528 - protein, 228 aa, Gossypium sturtianum
FTSLCHTDVYFWEAKGQTPLFPRIFGHEAGGIVESVGEGVAHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTNGGVDRSVE

SEQ ID NO: 22529 - protein, 228 aa, Gossypium robinsonii
FTSLCHTDVYFWEAKGQTPLFPRIFGHEAGGIVESVGEGVAHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQKVLAEMTNGGVDRSVE

SEQ ID NO: 22530 - protein, 228 aa, Gossypium bickii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTNGGVDRSVE

SEQ ID NO: 22531 - protein, 228 aa, Gossypium bickii
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARXXGASRIIGVDLNPNRFEEAKKFGCTEFVNPKDHNKPVQEVLAEMTNGGVDRSVE

SEQ ID NO: 22532 - protein, 227 aa, Gossypium bickii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTNGGVDRSV

SEQ ID NO: 22533 - protein, 228 aa, Gossypium nelsonii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAEINPAAPLDKVCILSCGISTGLGAALNVAKPTKGSTVAIFGLGAVGLAAAEGARIAGASRIIGVDLNPNRFEEAKKFGCTEFVNPNDHNKPVQEVLAEMTNGGVDRSVE

SEQ ID NO: 22534 - protein, 228 aa, Gossypium australe
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAASLDKVCILSCGISTGLGAALNVAKPTKGSTVAIFGLGAVGLAAAEGARIAGAXXXXXXXXXXXXXXXXKKFGCTEFVNPNDHNKPVQEVLAEMTNGGVDRSVE

SEQ ID NO: 22535 - protein, 228 aa, Gossypium australe
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGAALNVAKPTKGSTVAIFGLGAVGLAAAEGARIAGASRIIGVDLNPNRFEEAKKFGCTEFVNPNDHNKPVQEVLAEMTNGGVDRSVE

SEQ ID NO: 22536 - protein, 228 aa, Gossypium australe
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAASLDKVCILSCGISTGLGAALNVAKPTKGSTVAIFGLGAVGLAAAEGTRIAGASRIIGVDLNPNRFEEAKKFGCTEFVNPNDHNKPVQEVLAEMTNGGVDRSVE

SEQ ID NO: 22537 - protein, 228 aa, Gossypium anapoides
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 22538 - protein, 228 aa, Gossypium anapoides
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCIXSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 22539 - protein, 228 aa, Gossypium costulatum
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHAGSVAKINPAAPLDKVCILSCGISTGLGATLNVAKPAKGSTVAIFGLGAVGLAAAEGARIAGAFRIIGVDLNPNRFEEAKKFGCTEFVNPKDHNKPVQEVLAEMTNGGVDRSVE

SEQ ID NO: 22540 - protein, 228 aa, Gossypium costulatum
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDXVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 22541 - protein, 228 aa, Gossypium costulatum
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPVAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 22542 - protein, 228 aa, Gossypium cunninghamii
FTSLCHTDVYFWEAKGQTPLFPRIFGHEAGGIVESVGEGVTHLKPGDHALPVFTGECGNCRHCKSKESNMCGLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 22543 - protein, 197 aa, Gossypium marchantii
IVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 22544 - protein, 228 aa, Gossypium nobile
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSXNGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 22545 - protein, 228 aa, Gossypium pilosum
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTXFVNPKDHNKPVQEVLAEMTNGGVDRSVE

SEQ ID NO: 22546 - protein, 228 aa, Gossypium pilosum
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAXGSTVAIFGLGAVGLAAAEGARIAGASRIIGVDLNPNRFEEAKKFGCTEFVNPKDHNKPVQEVLAEMTNGGVDRSVE

SEQ ID NO: 22547 - protein, 228 aa, Gossypium pilosum
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINXKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 22548 - protein, 228 aa, Gossypium populifolium
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHXGSVAKINPAAPLDKVCILSCGISTGLGATLNVAKPAKGSTVAIFGLGAVGLAAAEGARIAGAXRIIGVDLNPNRFEEAKKFGCTEFVNPKDHNKPVQEVLAEMTNGGVDRSVE

SEQ ID NO: 22549 - protein, 228 aa, Gossypium populifolium
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKXFGCTEFVNPKDHNKPVQEVLAEMTNGGVDRSVE

SEQ ID NO: 22550 - protein, 197 aa, Gossypium populifolium
  unsure (1)..(197): unsure at all Xaa locations
IVESVGEGVTHLKPGDHVLPVFTGECGNCRHCKSKESNMCDXLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 22551 - protein, 228 aa, Gossypium populifolium
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHXGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 22552 - protein, 228 aa, Gossypium pulchellum
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGAXRIIGVDLNPNRFEEAKKFGCTEFVNPKDHNKPVQEVLAEMTNGGVDRSVE

SEQ ID NO: 22553 - protein, 228 aa, Gossypium rotundifolium
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPPKGSTVAIFGLGAVGLAAAEGARIAGASRIIGVDLNPNRFEEAKKFGCTEFVNPKDHNKPVQEVLAEMTNGGVDRSVE

SEQ ID NO: 22554 - protein, 228 aa, Gossypium rotundifolium
  unsure (1)..(228): unsure at all Xaa locations
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIXGVDLNPNRFEEAKKFGCTEFVNPKDHNKPVQEVLAEMTNGGVDRSVE

SEQ ID NO: 22555 - protein, 228 aa, Gossypium herbaceum
FTSLCHTDVYFWEAKGQTSLFPRIFGHEAGGIVESVGEGVTHLKPGDHVLPVFTGGCGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTNGGVDRSVE

SEQ ID NO: 22556 - protein, 729 aa, Homo sapiens [sequence omitted]

SEQ ID NO: 22557 - protein, 101 aa, Poncirus trifoliata
KDFNGKCYISSGLNPSFDTFDCQLHEFHTESNKLIGNLSWRIRTPDGGFFTRSAMQRFVQDSIHPGILYNHDNEYLHYKDDWYILSSKIQNEPDDYVFVYY

SEQ ID NO: 22558 - protein, 160 aa, Raphanus sativus
MESEGKIVFTEEQEALVVKSWSVMKKNSADLGLKLFIKIFEIAPTAKKLFSFLRDSPIPAEQNPKLKPHAMSVFVMCCESAAQLRKTGKVTVKETTLKRLGANHSKYGVVDEHFEVTKYALLETIKEAVPEMWSPEMKSAWGQAYDHLVAAIKAEMKPSH

SEQ ID NO: 22559 - protein, 157 aa, Casuarina glauca
ELLYSAVENEEHLCVLKDRNKPIIFTMARLDRVKNITGLVEWYGKNDRLRQLVNLVVVAGDRRKESKDLEEKAEMKKMHSLIETYKLNGQFRWISSQMNRVRNGELYRYIADTRGAFVQPAVYEAFGLTVVESMTCGLPTFATCNGGPAEIIVHGKS

SEQ ID NO: 22560 - protein, 137 aa, Drosophila melanogaster
MKGAVDGGLNIPHSVKRFPGYSAETKSFNADVHRAHIFGQHVADYMRSLEEEDEESFKRQFSRYIKLGIRADDLEDIYKKAHQAIRNDPTHKVTAKKSSAVTKKRWNAKKLTNEQRKTKIAAHKAAYVAKLQSETEA

SEQ ID NO: 22561 - protein, 178 aa, Drosophila melanogaster
MGFVKVVKNKQYFKRYQVKFRRRREGKTDYYARKRLTFQDKNKYNTPKYRLIVRLSNKDITVQIAYARIEGDRVVCAAYSHELPKYGIQVGLTNYAAAYCTGLLVARRVLNKLGLDSLYAGCTEVTGEEFNVEPVDDGPGAFRCFLDVGLARTTTGARVFGAMKGAVDGGLNIPHSAV

SEQ ID NO: 22562 - protein, 2543 aa, Drosophila melanogaster
MLNVFKAFIYKEFASVSPQKSCKLAVIALGWISIIQKQAQRESNIFKTEKKKLIEYQTLLYQITVISPNQRVTDARTKILYDLWNNTEIFNETMDTLFQMESTSNVTIFCMAMFQFKYKNCNALKLNQYTEKLSEYFVKSMISCKHKPDKSFIIACSPLLKSLTDAEFDSYIYPSLQRSILRSPENTLQSIGLIFNMLNFDCSRYAQKVGIVLIKNLYSKGDIARQESLESLKLLSTKCSNWIIVKELLERIFSVLNGSDGKINVIEYRINILQGAGNLSFNNIDQDHMPNILNEAVTLFSKALECETQEKVICCTLEMFGLWTQKFIHNLPDVVINIFTSGMRLKTTNQIIRQSYLEWLLLSIQNAEVNNHISIIQDLISFYTKALQNSSQSCYLSEAACIACILLILEKPSENYNFFWTTVFDMKKLIFYNEKFTTTAPIPTLCNISLMARILINSYPEKIKGKLEPLARTLVSNLCCNSVKVRVYTAKQVKQIINSSSGIEFVKLALCEFGKRINLVNIETDGEPLIDQFGTSNQVYVDALLTLTSIKHITYEDSVDVAIDLLLISHHPAIVSNEPYLWETTIQKHLNLDAKNVILAKTNEIVNEYIDNYIASAQYENTISALIRICPNLIVPTVVNNLKNYLSNFSNYNVSNEEYLIFLTPDGELFDKSVIPHIDSQYETVRLKRENKVYSYKEQLEEIQLRREIDDKREKEGKLKTIRYTQKQEEQIKNQMEKELHIKLRITLLYEKLISKISLLKASCSGNGEQMAQHFYSLLDGILNASKSPLCAEVLTDLYIFLHNLCFTFQPKLGRAIALATIKLQSPSCVLKKEFEAFNVNQAINDIIIDLDNHVKSNYLDSPSFSYAFEFLKRALLLLNTDSDFDLISKGIQILALHTSAGVCCKPQFMPRFGMFKMLLDLLKNNNKLWAQTSAAILQVAKCSNGDNCSSPDNHIISIFLQALQHCSDAVRKVALQSLKIMVNGIVNHIKVDNSLEKVIINRFWVAKHDPEEENRELALFLWNTAKFPLPGYVDIINDITHSETCIQKSASESLIPLLAGDEVLKKCVIKKLFSIYKAKLSLLPPVLDQFDREIEPAIDQWKPRRGIAIAFSTIAFLLSIEDINDIMNFMVSQGLGDREDVVHKEMLATALKIVDLHGNKAIENLLPVFEDFLDKAPKSQSYDNIRQAVVILMGSLARHLEKDDKRIDPIVKRLITSLSTPSQQVQEAVSNCLPHLMPSVKDEAPSMIKKLLHSLAKSEKYGERRGAAYGIAGIVKGLGILSLKQLDIMSKLTAFIQDKKNYRSREGALFAFEVLCSTLGRLFEPYIVHVLPHLLQCFGDPSQYVRQAADDTAKVVMRKLSAHGVKLVLPSLLEALDEDSWRTKTASVELLGAMAFCAPKQLSSCLPSIVPKLIQVLGDSHTKVQESGGEALKVIGSVIKNPEIQAIVPVLLDALEDPSNNTSTCLQSLLKTKFIHFIDAPSLALIMPVVQRAFMDRSTETRKMAAQIIGNMYSLTDQKDLAPYLPSIIPGLKSSLLDPVPEVRAVSARALGAMVKGMGESSFENLLPWLMETLTSESSSVDRSGAAQGLSEVVGGLGVEKMHKLMPEIISTAERVDIAAHVKDGYIMMFIYMPGAFQEEFTPYIGQIINPILKALADESEFVRDTALKAGQRIVNLYAETAVALLLPELEKGLFDDNWRIRYSSVQLLGDLLYRISGVSGKMTTETASEDDNFGTEHSHTAIIHFLGDERRNRVLSGLYMGRSDVSLMVRQAALHVWKVVVTNTPRTLREILPTLFGLLLGCLASTSYDKRQVAARTLGDLVRKLGERVLPEIIPILENGLNSDHPDQRQGVCIGLSEIMGSTSKEMVLTFIDSLVPTVRKALCDPLPEVREAAAKTFESLHSTVGSRALDEILPFMLQGLSDADPFVAENTLDGLRQVMSIKSKVVLPYLVPQLTSPPVNTKALSILVSVAGEALIKYLPKILSSLLEALSDAYGYPNEPQENEYCQTVILSVTDETGIRTIMDTLLISANSSDLCTRKSAASLLSAFCIHSPGNYYEYIPQLLRCLLKLLVESDKDILQKSWEALNAVIKGMNAAQQICHVSDVRQAVRFAASELEGTELPGFCLPKGITPLLPVFREAILNGLPEEKENAAQGLGEVIFLTNAKSLQPSVVHITGPLIRILGDRFNAAVKAAVLETLSILLHKVGVMLKQFLPQLQTTFLKALHDQNRNVRMKAGKALSELVAIHSRAEPLFNEIHNGIKNSDDSSVRETMLHALRSIVSRSGDKMSEPIKKQIYVTLLSMIGHHEDATRSAVGGCLGAILKYIASGHVYDLFNNIILTNNTDDLIVKHGHTIVLFVALKECPTEVLVLDLPEKITSYVLINILSEKVPIASNAVRAATYLLDYYLVNQNEPPIKIVMALSRAMNHSSNDVKQLVAQSCTYLSKNLAANQSSIDVLKYLVPMLVNGTKEKNGYVKSNSELALISILRLRSDDTSFLKISGLLESGARDSLNDVVLKVLKRTSSQSIIKEEELDDTLQS

SEQ ID NO: 22563 - protein, 283 aa, Drosophila melanogaster
MEEFNSSGSVVNGTGSTEVPQSNAEVIRGQIFEVGPRYIKLAYIGEGAYGMVVSADDTLTNQRVAIKKISPFEHQTYCQRTLREITILTRFKHENIIDIRDILRVDSIDQMRDVYIVQCLMETDLYKLLKTQRLSNDHICYFLYQILRGLKYIHSANVLHRDLKPSNLLLNKTCDLKICDFGLARIADPEHDHTGFLTEYVATRWYRAPEIMLNSKGYTKSIDIWSVGCILAEMLSNRPIFPGKHYLDQLNHILGVLGSPSRDDLECIINEKASTELFGIFTI

SEQ ID NO: 22564 - protein, 85 aa, Rattus sp.
DLDRVADPSYLPTQQDVLRVRVPTTGIIEYPFDLQSVIFRMVDVGGQRSERRKWIHCFENVTSIMFLVALSEYDQVLVESDNENR

SEQ ID NO: 22565 - protein, 770 aa, Dictyostelium discoideum
MSMMTSTPTKRSVKLDDIWPELEEGIYKIITDLNKGFPKQKWIALYTHVYDYCAASQSKSSAKVGMPKQQASGANYVGEDLYNRLNLFLKKHMSQLLKLTETKMDEPLLNYYYTEWDRYTSAMKYINNIFQYMNRYWIKREIDDGKKEVYEIFILSLVIWRDCLFTPLKQRLTNSLLDIIESERNGYQINTHLIKGVINGYVSLGLNREKPKETILQVYKSGFEELFLTATENYYTNESAKFISENSVADYMKKVETRLNEEVKRVQQYLHQNTESELIAKCEKVLIEKHVEVIWNEFQTLLEKDKIPDLTRMYSLLSRIPRGLEPLRTTLEKHVQNVGLQAVSSIATNGVIEPKVYIETLLKVFKKYNELVTGAFRSDTGFVASLDKACRRFINENAVTIAAKSSSKSPELLARFTDFLLKKSPNNPEESEMEQLLNDVMIVFKYIEDKDVFQDFYSKMLAKRLIHGTSTSEDLEGTMIGKLKSTCGYEYTSKLQRMFTDMSLSRELLDRFNNHIEQVERSSLNIDFSVLVLATGSWPLQPPSTNFSIPKELQACEQLFQKFYQNQHSGRKLNWLHHLSKGELKTKYLQTSKSGYTLQCSTYQIGVLLQFNQYETLTSEEIQESTQLIDSVLKGTLTSLAKSKILLADPPLDDEEIAKTTKFSLNKQFKNKKTKIFINVPVLTQVKEEIDSIHKTVEEDRKLQIQAAIVRIMKMRKQLAHSGLMTEVISQLQTRFNPKVNIIKKCIDILIEKEYLMRVEGKKDHYSYVA

SEQ ID NO: 22566 - protein, 142 aa, Epinephelus akaara
VWNLTNCKLKTNHIGHTGFLNTVTVSPDGSLCASGGRDGQAMLWDLNEGKHLYTLDSGDTINALCFSPNRYWLCAATGPSIKIWDLEGKVIVDELRQEVISTNSKAEPPQCTSLAWSADGQTLFAGYTDNLIRVRQVTIGTR

SEQ ID NO: 22567 - protein, 387 aa, Nicotiana tabacum
MCGGAIISDYIAPSRTSRRLTAELLWGRSDLSNKQKNPNNYHSKPLRSQVVDLDDDFEADFQDFKDFSDDEDVQVDVKPFAFSASKNSNVEGSKSVKTDDSDKDADRSSKRKRKNQYRGIRQRPWGKWAAEIRDPRKGVRVWLGTFNTAEEAARAYDVEARRIRGNKAKVNFPDEAPVPASRRTVKVNPQKVLPKEILDSVQPDSTIINNMEDCCYDSLGFLEEKPMTKQFGCEDGSSASGDTGFGSFAPSAGTDIYFNSDVGSNSFDCSDFGWGEPCARTPEISSVLSAVIESNESQLVEDDTSPMKKLKSSPINPVADDGNTANKLSEELSAFETQMKFLQIPYLEGNWDASVDTFLNSSATQDGDNAMDLWSFDDVPSLLGGVF

SEQ ID NO: 22568 - protein, 396 aa, Lycopersicon esculentum
MDGSVPQTDTMMSDVAAPPAQQPPPPSQPLAGMDNIPATLSHGGRFIQYNIFGNIFEVTAKYKPPIMPIGKGAYGIVCSALNSETNESVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRGPELLLNSSDYTAAIDVWSVGCIFMELMDRKPLFPGRDHVHQLRLIMELIGTPSEAEMEFLNENAKRYIRQLPLYRRQSFTEKFPHVNPAAIDLVEKMLTFDPRRRITVEDALAHPYLTSLHDISDEPICMTPFSFDFEQHALTEEQMKELIYRESIAFNPEYQRM

SEQ ID NO: 22569 - protein, 236 aa, Oryza sativa (indica cultivar-group)
MAGADVDVGTELRLGLPGGGGGAAEAAAKAAKRGFEETIDLKLKLPTAGMEEAAAGKAEAPAAEKAKRPAEAAAADAEKPPAPKAQAVGWPPVRSFRRNIMTVQSVKSKKEEEADKQQQQPAANASGSNSSAFVKVSMDGAPYLRKVDLKMYNSYKDLSLALQKMFGTFTATGNNMNEVNGSDAVTTYEDKDGDWMLVGDVPWQMFVESCKRLRIMKGSEAIGLAPRAKDKYKNKS

SEQ ID NO: 22570 - protein, 707 aa, Mus musculus
MGRKQNENEAHGNSAKYDPSFRGPIKNRGCTDIICCVLFLIFILGYIIVGLVAWVYGDPRQVLYPRNSTGAYCGVGDNKDKPYVLYFDILSCAAAINIISIAENGLQCPTPQVCVSSCPLAPWAVEVFQFSKTVGEVYGERRNFCLPAVSPDMIVEESLQKGLCPRFLLPSTPALGRCFPLPNINFTLPEDLRINNTTVSNGISGLLDSINARDVSVKIFEDFAQSWYWILVALGVALALSLLFILLLRLVAAPLVLLLIVGVLAVLAYGIYHCWQQYQVFRDKGASITQLGFTTNFSAYQSVKETWLAALIVLAVLEGILLLMLIFLRQRIRIAIALLKEASRAVGQMMSTMFYPLVTFVLLVICIGYWAVTALYLATSGQPQYIYWASNTSTPGCENVPVNMTCDPMAPLNSSCPNLKCVFKGYSTTGLAQRSLFNLQIYGVLGLFWTVNWVLALGQCALAGAFASFYWAFHKPRDIPTFPLSSAFIRTLRYHTGSLAFGALILSLVQIARVILEYIDHKLRGSQNPVARCIICCFKCCLWCLEKFIKFLNRNAYIMIAIYGKNFCVSAKNAFMLLMRNVLRVVVLDKVTDLLLFFGKLLVVGGVGVLSFFFFSGRIKGLGKDFENPNLNYYWLPIMTSIMGAYVIASGFFSVFGMCVDTLFLCFLEDLERNDGSQERPYYMPKALLKILGKKNEAPTGGKTRKK

SEQ ID NO: 22571 - protein, 441 aa, Eubacterium acidaminophilum
MVSLNNEAPQVKKPDNQVYYISMLIVLGIVGWGMIFKDNFATFASNLLSFLSETFGWAYLMSMFVFVVFAAGLAFSKFGNVKLGPDDSTPDFSTKSWFAMLFGAGMGIGLVFWGVAEPIFHYLAPLGIEPGSKEAVDFAFKTSFKHWGFHPWANYSVIGLALAYMQFRKGKPGLISSIFIPIFGEERVQGPIGKTIDILAVFATVAGVATSLGMGTLQIGSGISYIFGIEQTNMMNILIIAVVTVLFIWTAVSGIDKGIKILGDINLVLAGTLLVGTFLIGPKVATMNAFSNGLGLYLNDFLKDSLSINAFGDNSWLKSWTVFYWAWWIAWAPFGGSFIARISRGRTIREFVGGVIFAPAVASFVWFAVFGALGVGLSDKLGLDGLKAAVGAPETALFAVMQHYNLGTLLSFVTLLLLCTFFITSANSATFVLGMFTSEEI

SEQ ID NO: 22572 - protein, 337 aa, Brassica napus
MLKQEGNWAQTCDTCRSAACTVYCRADSAYLCTSCDAQIHAANRLASRHERVRVCQSCERAPAAFFCKADAASLYTACDSQIHSANPLARRHQRVPILPISGSMVTNRSSETTEAEDIVVVGQEEEDEAEAASWLLPTSVKNCGDNNNNNNNSQDNRFSVGEEYLDLVDYSKYQQDYNVPQRRSYVADGVVPLQVEVSKSLSHMHHEQHNFQFGFTNVSSEASPIHMVSLVPESTLSETTVSNPRSPKAATEELPEAPVQMLSPMERKARVMRYREKKKTRKFEKTIRYASRKEYAEKRPRIKGRFAKRNEVDAEEADKAFSSMVMFDTGYGIVPSF

SEQ ID NO: 22573 - protein, 370 aa, Haemophilus influenzae Rd
MATYFSDNLTADQQNQVQQIIQQFQHPTLQKDLIVLNTLKKVEKGGDTLRIELQLPFAWNSGAEQLKQAVSDALLKATDCKLIKWAVAYQIATLKRANNQPAVKGVKNIIAVSSGKGGVGKSSVSVNLALALQAQGARVGILDADIYGPSIPHMLGAADQRPTSPDNQHITPIKAHGLSANSIGFLMNEDSATIWRGPMASSALSQLLNETLWDSLDYLVIDMPPGTGDIQLTLSQQIPVTGAVVVTTPQDIALLDAVKGISMFERVSVPVLGIVENMSMHICSECGHHEAIFGTGGAEKMAEKYNVKVLAQLPLHIRIREDLDAGNPTVVRVPENEISQAFLQLAEKVSTELYWQGSVIPSEILFKEVK

SEQ ID NO: 22574 - protein, 647 aa, Haemophilus influenzae Rd
MAMIFIAPEQTQALLNQAKSGIFANFSWFYVLTFSVFLGFLLILSVSSLGNIKLGQDEEEPEFSFLSWLAMLFAAGMGVGLMFFGVAEPLTHYLSDITAGSAEHKQQEALLHTLFHWGIHAWAVYGTIALALAYFGFRYKLPLALRSCFYPLLKDRINGKIGDAIDVMALLATLFGIITTLGFGSSQLGAGLEQIGWISQNSFALQVGVIVVVMCLAVFSAISGVGKGVKILSEINLTLAFCLLLFVLISGPTLYLLSAFSDNIGNYFSNLVQLSFKTYAYEQEHTSWFSGWTVLYWAWWCSWAPFVGLFIARISKGRTIREFIFGVLVIPSLFGILWFTVFGNTAVWLNDGIAAGGLGEFISSPEILLFKFLNYLPLPTITGFVSLLVILLFFITSADSGIYVLNNIASRDKSLASPAWQAIMWGTLMSVVAIVLMQSGGLANLQTMTLIVALPFALLMLVMCFSLWKGLIADKKYFSTKVNPTSIFWSGDKWKSHLEQMMNQTQEKDILRFLKNTALPAMRELRQELTGKYNLSVEINTLFEQEEPALELVIHKESMRDFMYGIKSVGREVSEQLINDENLPHIQHSATYEPYTYFFDGRVGYDVQYMDQDELIADMLKQYERYLSLLDDVGQELMAHEQTELAE

SEQ ID NO: 22575 - protein, 813 aa, Amphiuma tridactylum
MFQMWKRMACDCLGYPFRGIISPLGSICFFGAFLLFILPIGVAAFKSEAMLATEPSRSRILDDSPGITPAPTLTAHPTTNTSGNNSAGGHGKGHKVFPVLGFDYLRVRIPFEISLWILLASLMKLGFHVIPTVSNVVPESCLLIVVGLLVGGLIKGVGETPPVLHSDTFFLFLLPPIILDAGYFLPLRQFTENLGTILIFAVLGTLWNTFCIGSLLFAVCQISGTSLNGVGLLANLLFGAIISAVDPVAVLAVFEEIHINELLHILVFGESLLNDAVTVVLYHLFEEFGTFDQVTFKDIFLGFLSFFVVALGGVFVGVVYGIVAAFTSRFTSHIRVIEPLFVFLYSYMAYLSAELFHLSGIMALIASGVVMRPYVEANISHKSHTTIKYFLKMWSSVSETLIFIFLGVSTVAGPHEWNWTFVMSTLLLCLIARVLGVLGLTSVINRFRIVKLTPKDQFIIAYGGLRGAIAFSLGYLLDHHHFPKRNMFLTAIITVIFFTVFVQGMTIRPLVELLAVKKKQETKRSINEEIHTQFLDHLLTGIEDICGHYGHHHWKDKLNRFNKKYVKKCLIAGERSTEPQLIAFYHKMELKQAIELVESGGLGRIPSAVSTVSMQNIQPKAKPTDRFIPALSKVKEEEIRKILRTNLQKTRQRLRSYNRHTLVADPYEEAWNQMLLRRQKAHQLEQRMNNYLTVPAHKMDSPTMTRARVGSDPMAYEPKANIRDLPTITIDPASPESVDIVNEEKKSLPTEEEEEEEEGIVMTAKEPPSPGTDDVFTPGAGDSPNNQRLMRCLSDPGPQPEPEEQDPFIKKEK

SEQ ID NO: 22576 - protein, 391 aa, Mus musculus
MDQCVTVERELEKVLHKFSGYGQLCERGLEELIDYTGGLKHEILQSHGQDAELSGTLSLVLTQCCKRIKDTVQKLASDHKDIHSSVSRVGKAIDKNFDSDISSVGIDGCWQADSQRLLNEVMVEHFFRQGMLDVAEELCQESGLSVDPSQKEPFVELNRILEALKVRVLRPALEWAVSNREMLIAQNSSLEFKLHRLYFISLLMGGTTNQREALQYAKNFQPFALNHQKDIQVLMGSLVYLRQGIENSPYVHLLDANQWADICDIFTRDACALLGLSVESPLSVSFSAGCVALPALINIKAVIEQRQCTGVWNQKDELPIEVDLGKKCWYHSIFACPILRQQTTDNNPPMKLVCGHIISRDALNKMFNGSKLKCPYCSMEQSPGDAKQIFF

SEQ ID NO: 22577 - protein, 577 aa, Streptococcus mutans
MTEMLKGIAASDGVAVAKAYLLVQPDLTFETVSVTDTQAEEARLDAALEASQNELSLIRQKAVDTLGEEAAAVFDAHLMVLADPEMIGQIKETIRTKEVNAESALKEVTDMFVTLFENMEDNPYMQERAADIRDVAKRVLAHLLGVELPNPATISEESIVIAHDLTPSDTAQLDANYVKAFVTNIGGRTSHSAIMARTLEIAAVLGTNDITERVKNGDIVAVNGITGQVIINPTEDQIAEFKAAGETYAKQKAEWALLKDAETVTADGKHFELAANIGTPKDVEGVNNNGAEAVGLYRTEFLYMDSQDFPTEDEQYEAYKAVLEGMNGKPVVVRTMDIGGDKELPYFDLPKEMNPFLGFRALRISISETGNQMFRTQLRALLRASVHGQLRIMFPMVALLNEFRKAKGILEEEKANLKAEGVAVSDDIQVGIMIEIPAAAMLADQFAKEVDFFSIGTNDLIQYTMAADRMNEQVSYLYQPYNPSILRLVDHVVKAAHAEGKWAGMCGEMAGDQTAVPLLVGIGLDEFSMSATSVLRTRSLMKKLDTAKMQELAQRALTECATMEEVLELEKEYIDFD

SEQ ID NO: 22578 - protein, 166 aa, Trypanosoma cruzi
MSQQMQYYAPRQQLQQAPAQMNPEPDLLRNLMVNYIPTTVDEVQLRQLFERYGPIESVKIVADRETRQSRGYGFVKFQSGSSAQQAIAGLNGFNILNKRLKVALAASGHQRNRNGVSTGFGAYGGYGGYGGYGAYPSVANPYAQQQMMTMQHPYMMTQSVPSVPRQ

SEQ ID NO: 22579 - protein, 470 aa, Xanthomonas campestris pv. vesicatoria
MTSRRDFFKFAGIAGGAVAASSVSRVAMAALPEPVIQTSASTMAPLVPNSGRPYNPVVTLNGWTLPWRMNQGVKEFHLVAEPVVREMAPGMKAHLWGYNGQSPGPTIEVVEGDRVRIFVTNKLPEHTSIHWHGQRLPNGMDGVTGLTQPAIESGKTFVYEFVARRPGTFMYHPHADEMVQMAMGMMGFWVTHPKDKHPLIDVVQRDFCFLLSAYDIEPGAATPKVAEMTDFNLWTWNSRVFPGIDSLNVRLNDKVRVRIGNLTMTNHPMHLHGHEFVVTGTDGGPTPKSTRWHEVTADVAVGQMRQIEFVADEEGDWAFHCHKSHHTMNAMGHDVPTLIGVDHTGLARKVNKLIPDYMVMGERGMADMAEMEMPIPDNTVPMMTGQGPFGSVEMGGMFSVLKVRRDQQPGDYKDPGWFKHPAGTVAHEYTGPLAEPARFSAEGGQSMPRERKPATPTEVKVRKPTSHGAH

SEQ ID NO: 22580 - protein, 132 aa, Brassica juncea
ILDRYGKQHAGDLKALNLQSKALSYGSHNELLELMDSKLVESNVGGVSVDTLVQLEGVLENALSLTRARKTELMLKLVDSLKEKEKLLKEENQALAGQKEKKNLAGAEADNMEMSPGQISDINLPVTLPLLN

SEQ ID NO: 22581 - protein, 583 aa, Alnus glutinosa
MEESKKSCFISDRVDYKGDPADRNTTGGWVPAALIVGIEVSERLSTMGIIVNLVTYLKGTMHQSSTTSSNSTSNVAGTSFLLCLLGGILADSFLGRYWTIAIFSVIHALGTCMLAISAALPELRPSECNLHHDFPLKCEEPSSFQMGILYTALYSMALGVGGIKSSVSGFGTEQFDQNDEKEMSEMAHFFNRFYLIISFGTLLAVTVLVYVQDQVGRSWGYGICSASMFLSIVAFLVGTKRYRYRECTGSPIIQILQVIVAAIRKRKAELPTDLSFLYDKASDKESTISHTDKYSCLDKGAIITGMDRGADGLTISNPWGLCTVTEVEEVKMLIRILPIMASTIIFWTIRAQLLSFSVQQAATMERTIENFPIPPASFNGFFVGSTIITLIMYDRLLPFLRQSSNGVQGFTNLQKIGIAIFLSILGMAAASFAEMKRLEVVRANRGSTSTSSTLPITAFYLLPQFVLVGIGDGFMYTGQLDFFITESPKGMKAISTGLFLTTNALGFFGSSILVTIITKVTGEEVGHGWLLSRINDSRLDFFYALLAVLGFINLVFYLVLASWYKPSPVEDAHQKINGKEEKV

SEQ ID NO: 22582 - protein, 228 aa, Cricetulus griseus
LIGLGTWKSNPGQVKAAIKYALSVGYRHIDCAAVYGNEIEIGEALKENVGPGKAVPREELFVTSKLWNTKHHPEDVEAALRKTLADLQLEYLDLYLMHWPYAFERGDNPFPKNDDGTIRYDSTHYKETWKALEALVAKGLVKALGLSNFNSRQIDDILSVASVRPAVLQVECHPYLAQNELIAHCQARGLEVTAYSPLGSSDRAWRHPDEPVLLEEPVVLALAEKHGR

SEQ ID NO: 22583 - protein, 378 aa, Fagopyrum urophyllum
PSLPPAYRLLETQAPPPQQQPLSYPYGMMTSAHHHHHHQIHRAPPPAQPPQPPPAPQMMMSGHQQLGGLEELFQAYGIRYYTASKIAELGFTVNTLLDMREEELDDMINSLTHIFRWDLLVGERYGIKAAVRAERRRLQDLEYSSRHAAGNGLSLMSADTTSHPLDAFSQEGISEERVQGEKEVVRSGGGTNWEMVAMQQQQVQHHHHERKKQKQQQQQRRSKKMAVMNDDEEDGEDNEDEDEDEGVGGGCVSERQREHPFIVTEPGEVARGKKNGLDYLFHLYELCHDFLIQVQNNAKDCGDKCPTKVTNQVFRFAKKAGATYINKPKMRHYVHCYALHCLDEETSNAIRRAFKERGENVGAWRQACYKPLVAIAAR

SEQ ID NO: 22584 - protein, 379 aa, Fagopyrum gracilipes
PSLPPAYRLLETQAPPPQQQPLSYPYGMMTSAHHHHHHQLHRAPPPAQPPQAPPAAPMMMSGHQQLGGLEELFQAYGIRYYTASKIAELGFTVNTLLDMREEELDDMINSLTHIFRWDLLVGERYGIKAAVRAERRRLQELEYSSRHGAGNGLSLMSADTTTHPLDAFSQEGISEERVQGEKEVVRSGGGTNWEMVAMQQQQVQHHHHERKKQKQQQQQQRRSKKMAVMNDDEEDGEDNEDEDEDEGVGGGCVSERQREHPFIVTEPGEVARGKKNGLDYLFHLYELCHDFLIQVQNNAKDCGDKCPTKVTNQVFRFAKKAGATYINKPKMRHYVHCYALHCLDEETSNALRRAFKERGENVGAWRQACYKPLVAIAAR

SEQ ID NO: 22585 - protein, 380 aa, Fagopyrum tataricum
TSLPPAYRLLETPAPLPQQPPPSYPYGMMTSAHHHHHHQLHRAPPAQLQPPAAPMMSHPQLGGLEELFQAYGIRYYTASKIAELGFTVNTLLDMREEELDDMINSLTHIFRWDLLVGERYGIKAAVRAERRRLQELEYSARHGGGGLSLMSADTTTHPLDAFSQEGISEERVQGDKEVVRSGGATSWEMVAMQQQQQVQHHHHERKKQKHQQQQQQQQQQRRTKKMSVMNGDNEEDGEDNDDEDEDDGAGGGCVSERQREHPFIVTEPGEVARGKKNGLDYLFHLYELCHDFLIQVQNIAKDSGDKCPTKVTNQVFRFAKKAGATYINKPKMRHYVHCYALHCLDEETSNVLRRAFKERGENVGAWRQACYKPLVAIAAR

SEQ ID NO: 22586 - protein, 377 aa, Fagopyrum urophyllum
PSLPPAYRLLETPAPPPQQQPLSYPYGMMTSAHHHHHHQLHRAPPPAQPQPPPAPPMMMSGHQQLGGLEELFQAYGIRYYTASKIAELGFTVNTLLDMREEELDDMINSLTHIFRWDLLVGERYGIKAAVRAERRRLQELEYSSRHGGGNGLSLMSADTTTHPLDAFSQEGISEERVQGEKEVVRSGGGMNWEMVAMQQQQVQHHHHERKKQKQQQQQRRSKKMAVMNDDEEDGEDNEDEDEDEGVGGGCVSERQREHPFIVTEPGEVARGKKNGLDYLFHLYELCHDFLIQVQNNAKDCGDKCPTKVTNQVFRFAKKAGATYINKPKMRHYVHCYALHCLDEETSNALRRAFKERGENVGAWRQACYKPLVAIAAR

SEQ ID NO: 22587 - protein, 377 aa, Fagopyrum esculentum subsp. ancestralis
TSLPPAYRLLETPAPLPQQPPASYPYGMMTSAHHHHHQQLHRAPPAQLQPAAAPMMSHPQVGGLEELFQAYGIRYYTASKIAELGFTVNTLLDMREEELDDMINSLTHIFRWDLLVGERYGIKAAVRAERRRLQELDYSARHGGGGGGLSLMSADTTTHPLDAFSQEGISEERVQGEKEVVRSGGATNWEMVAMQQQHQVQHHHHERKKQKQQQHQQRRSKKMPATNGDNEEDGEDDDDEDEDDGAGGGCVSERQREHPFIVTEPGEVARGKKNGLDYLFHLYELCHDFLIQVQNIAKDSGDKCPTKVTNQVFRFAKKAGATYINKPKMRHYVHCYALHCLDEETSNVLRRAFKERGENVGAWRQACYKPLVAIAAR

SEQ ID NO: 22588 - protein, 377 aa, Fagopyrum homotropicum
TSLPPAYRLLETPAPLPQQPPASYPYGMMTSAHHHHHHQLHRAPPAQLQPAAAPMMSHPQVGGLEELFQAYGIRYYTASKIAELGFTVNTLLDMREEELDDMINSLTHIFRWDPLVGERYGIKAAVRAERRRLQELDYSARHGGGGGGLSLMSADTTTHPLDAFSQEGISEERVQGEKEVVRSGGATNWEMVAMQQQQQVQHHHHERKKQKQQQHQQRRSKKTAAMNGDNEEDGEDNDDEDEDDGAGGGCVSERQREHPFIVTEPGEVARGKKNGLDYLFHLYELCHDFLIQVQNIAKDSGDKCPTKVTNQVFRFAKKAGATYINKPKMRHYVHCYALHCLDEETSNVLRRAFKERGENVGAWRQACYKPLVAIAAR

SEQ ID NO: 22589 - protein, 380 aa, Fagopyrum capillatum
PSLPPAYRLLETQAPPPPQQQPLSYPYGMMTSAHHHHHHQLHRAPPPAQPPQQPPAAPMMMSGHQQLGGLEELFQAYGIRYYTASKIAELGFTVNTLLDMREEELDDMINSLTHIFRWDLLVGERYGIKAAVRAERRRLQELEYSSRHGAGNGLSLMSADTTTHPLDAFSQEGISEERVQGEKEVVRSGGGTNWEMVAMQQQQVQHHHHERKKQKQQQQQQRRSKKMAVMNDDEEDGEDNEDEDEDEGVGGGCVSERQREHPFIVTEPGEVARGKKNGLDYLFHLYELCHDCLIQVQNNAKDCGDKCPTKVTNQVFRFAKKAGATYINKPKMRHYVHCYALHCLDEETSNALRRAFKERGENVGAWRQACYKPLVTIAAR

SEQ ID NO: 22590 - protein, 379 aa, Fagopyrum callianthum
PSLPPAYRLLETPAPPPQQQPLSYPYGMMTSAHHHHHHQLHRAPPPAAQPQPPPAPPMMMSGHQQLGGLEELFQAYGIRYYTASKIAELGFTVNTLLDMREEELDDMINSLTHIFRWDLLVGERYGIKAAVRAERRRLQELEYSSRHGAGNGLSLMSADTTTHPLDAFSQEGISEERVQGEKEVVRSGGGTNWEMVAMQQQQVQHHHHERKKQKQQQQQQRRSKKMAVVNDDEEDGEDNEDEDEDEGVGGGCVSERQREHPFIVTEPGEVARGKKNGLDYLFHLYELCHDFLIQVQNNAKDCGDKCPTKVTNQVFRFAKKAGATYINKPKMRHYVHCYALHCLDEETSNALRRGFKERGENVGAWRQACYKPLVAIAAR

SEQ ID NO: 22591 - protein, 380 aa, Fagopyrum statice
PSLPPAYRLLETQAPPPQQQQPLSYPYGIMTSAHHHHHHQLHRAPPPPQPPQPPPAPPMMMSGHQQLGGLEELFQAYGIRYYTASKIAELGFTVNTLLDMREEELDDMINSLTHIFRWDLLVGERYGIKAAVRAERRRLQELEYSSRHGGGNGLSLMSADTTTHPLDAFSQEGISEERVQGEKEVVRSGGGTNWEMVAMQQQQVQHHHHERKKQKQQQQQQRRSKKMAVMNDDEEDGEDNEDEDEDEGVGGGCVSERQREHPFIVTEPGEVARGKKNGLDYLFHLYELCHDFLIQVQNNAKDCGDKCPTKVTNQVFRFAKKAGATYINKPKMRHYVHCYALHCLDEETSNALRRAFKERGENVGAWRQACYKPLVAIAAR

SEQ ID NO: 22592 - protein, 378 aa, Fagopyrum macrocarpum
PSLPPAYRLLETPAPPPQQQPLSYPYGMMTSAHHHHHQLHRAPPPAAQPQPPPAAPMMMSGHQQLGGLEELFQAYGIRYYTASKIAELGFTVNTLLDMREEELDDMINSLTHIFRWDLLVGERYGIKAAVRAERRRLQELEYSSRHAAGNGLSLMSADTTTHPLDAFSQEGISEERVPGEKEVVRSGGGTNWEMLAMQQQQQVQHHHHERKKQKQHQQQRRSKKMAVMNDDEEDGEDNDDEDEDEGVGGGCVSERQREHPFIVTEPGEVARGKKNGLDYLFHLYELCHDFLIQVQNNAKDCGDKCPTKVTNQVFRFAKKAGATYINKPKMRHYVHCYALHCLDEETSNALRRGFKERGENVGAWRQACYKPLVAIAAR

SEQ ID NO: 22593 - protein, 379 aa, Fagopyrum pleioramosum
PSLPPAYRLLETPAPPPQQQPLSYPYGMMTSAHHHHHHQLHRAPPPAAQPQPPPAAPMMMSGHQQLGGLEELFQAYGIRYYTASKIAELGFTVNTLLDMREEELDDMINSLTHIFRWDLLVGERYGIKAAVRAERRRLQELEYSSRHAAGNGLSLMSADTTTHPLDAFSQEGISEERVPGEKEVVRSGGGTNWEMLAMQQQQQVQHHHHERKKQKQHQQQRRSKKMAVMNDDEEDGEDNDDEDEDEGVGGGCVSERQREHPFIVTEPGEVARGKKNGFDYLFHLYELCHDFLIQVQNNAKDCGDKCPTKVTNQVFRFAKKAGATYINKPKMRHYVHCYALHCLDEETSNALRRGFKERGENVGAWRQACYKPLVAIAAR

SEQ ID NO: 22594 - protein, 382 aa, Fagopyrum rubifolium
PSLPPAYRLLETQAPPPQQQQPLSYPYGMMTSAHHHHHHQLHRAPPPPAQPQPPPAPPMMMSGHQQLGGLEELFQAYGIRYYTASKIAELGFTVNTLLDMREEELDDMINSLTHIFRWDLLVGERYGIKAAVRAERRRLQELEYSSRHGGGNGLSLMSADTTTHPLDAFSQEGISEERVQGEKEVVRSGGGTNWEMVAMQQQQQVQHHHHERKKQKQQQQQQQRRSKKMAVMNDDEEDGEDNEDEDEDEGVGGGCVSERQREHPFIVTEPGEVARGKKNGLDYLFHLYELCHDFLIQVQNNAKDCGDKCPTKVTNQVFRFAKKAGATYINKPKMRHYVHCYALHCLDEETSNALRRAFKERGENVGAWRQACYKPLVAIAAR

SEQ ID NO: 22595 - protein, 379 aa, Fagopyrum cymosum
TSLPPAYRLLETPAPLPQQPPPSYPYGLMTSAHHHHHHQLHRAPPAQLQPPAAPMMSHPQLGGLEELFQAYGIRYYTASKIAELGFTVNTLLDMREEELDDMINSLTHIFRWDLLVGERYGIKAAVRAERRRLQELEYSARHGGGGGLSLMSADTTTHPLDAFSQEGISEERVQREKEVVRSGGATNWEMVAMQQQQQVQHHHHERKKQKHQQQQQQQQRRTKKMPVMNGDNEEDGEDNDDEDEDDGAGGGCVSERQREHPFIVTEPGEVARGKKNGLDYLFHLYELCHDFLIQVQNIAKDSGDKCPTKVTNQVFRFAKKAGATYINKPKMRHYVHCYALHCLDEETSNVLRRAFKERGENVGAWRQACYKPLVAIAAR

SEQ ID NO: 22596 - protein, 378 aa, Fagopyrum cymosum
TSLPPAYRLLETPAPLPQQPPPSYPYGLMTSAHHHHHHQLHRAPPAQLQPPAAPMMSHPQLGGLEELFQAYGVRYYTASKIAELGFTVNTLLDMREEELDDMINSLTHIFRWDLLVGERYGIKAAVRAERRRLQELEYSARHGGGGGLSLMSADTTTHPLDAFSQEGISEERVQGEKEVVRSGGATNWEMVAMQQQQQVQHHHHERKKQKHQQQQQQQRRTKKMPVMNGDNEEDGEDNDDEDEDDGAGGGCVSERQREHPFIVTEPGEVARGKKNGLDYLFHLYELCHDFLIQVQNIAKDSGDKCPTKVTNQVFRFAKKAGATYINKPKMRHYVHCYALHCLDEETSNVLRRAFKERGENVGAWRQACYKPLVAIAAR

SEQ ID NO: 22597 - protein, 377 aa, Fagopyrum esculentum
TSLPPAYRLLETPAPLPQQPPPSYPYGMMTSAHHHHHHQLHRAPPAQLQPAAAPMMSHPQVGGLEELFQAYGIRYYTASKIAELGFTVNTLLDMREEELDDMINSLTHIFRWDLLVGERYGIKAAVRAERRRLQELDYSARHGGGGGGLSLMSADTTTHPLDAFSQEGISEERVQGEKEVVRSGGATNWEMVVMQQQQQVQHHHHERKKQKQQQHQQRRSKKTATINGDNEEDGEDNDDEDEDDGAGGGCVSERQREHPFIVTEPGEVARGKKNGLDYLFHLYELCHDFLIQVQNIAKDSGDKCPTKVTNQVFRFAKKAGATYINKPKMRHYVHCYALHCLDEETSNVLRRAFKERGENVGAWRQACYKPLVAIAAR

SEQ ID NO: 22598 - protein, 378 aa, Fagopyrum rubifolium
PSLPPAYRLLETQAPPPQQQPISYPYGMMTSAHHHHHQLHRAPPPAQPPQPPPAAPMMMSGHQQLGGLEELFQAYGIRYYTASKIAELGFTVNTLLDMREEELDDMINSLTHIFRWDLLVGERYGIKAAVRAERRRLQELEYSSRHGAGNGLSLMSADTTTHPLDAFSQEGISEERVQGEKEVVRSGGGTNWEMVAMQQQQVQHHHHERKKQKQQQQQQRRSKKMAVMNDDEEDGEDNEDEDEDEGVGGGCVSERQREHPFIVTEPGEVARGKKNGLDYLFHLYELCHDFLIQVQNNAKDYGDKCPTKVTNQVFRFAKKAGATYINKPKMRHYVHCYALHCLDEETSNALRRAFKERGENVGAWRQACYKPLVAIAAR

SEQ ID NO: 22599 - protein, 381 aa, Fagopyrum gilesii
PSLPPAYRLLETPAPPPQQQPLSYTYGMMTSAHHHHHHQLHRAPPPPAQPQPPPPPAPPMIMSGHQQLGGLEELFQAYGIRYYTASKIAELGFTVNTLLDMREEELDDMINSLTHIFRWDLLVGERYGIKAAVRAERRRLQELEYSSRHGAGNGLSLMSADTTTHPLDAFSQEGISEERVQGEKEVVRSGGGTNWEMVAMQQQQVQHHHHERKKQKQQQQQQRRSKKMAVMNDDEEDGEDNEDEDEDDGVGGGCVNERQREHPFIVAEPGEVARGKKNGLDYLFHLYELCHDFLIQVQNNAKDCGDKCPTKVTNQVFRFAKKAGATYINKPKMRHYVHCYALHCLDEETSNALRRAFKERGENVGAWRQACYKPLVTIAGR

SEQ ID NO: 22600 - protein, 379 aa, Fagopyrum sp. C97106
PSLPPAYRLLETPAPPPQQQPISYPYGMMTSAHHHHHHQLHRAPPPAQPPQQPPAAPMMMSGHQQLGGLEELFQAYGIRYYTASKIAELGFTVNTLLDMREEELDDMINSLTHIFRWDLLVGERYGIKAAVRAERRRLQELEYSSRHGAGNGLSLMSADTTTHPLDAFSQEGISEERVQGEKEVVRSGGGTNWEMVAMQQQQVQHHHHERKKQKQQQQQQRRSKKMAVMNDDEEDGEDNEDEDEDEGVGGGCVSERQREHPFIVTEPGEVARGKKNGLDYLFHLYELCHDFLIQVQNNAKDCGDKCPTKVTNQVFRFAKRAGATYINKPKMRHYVHCYALHCLDEETSNALRRAFKERGENVGAWRQACYKPLVTIAAR

SEQ ID NO: 22601 - protein, 380 aa, Fagopyrum sp. C97107
PSLPPAYRLLETPAPPPQQQPLSYPYGMMTSAHHHHHHQLHRAPPPPAQPQPPPPAPPMMMSGHQQLGGLEELFQAYGIRYYTASKIAELGFTVNTLLDMREEELDDMINSLTHIFRWDLLVGERYGIKAAVRAERRRLQELEYSSRHGAGNGLSLMSADTTTHPLDAFSQEGISEERVQGEKEVVRSGGGTNWEMVAMQQQQVQHHHHERKKQKQQQQQQRRSKKMVVMNDDEEDGEDNEDEDEDEGVGGGCVSERQREHPFIVTEPGEVARGKKNGLDYLFHLYELCHDFLIQVQNNAKDCGDKCPTKVTNQVFRFAKKAGATYINKPKMRHYVHCYALHCLDEETSNALRRAFKERGENVGAWRQACYKPLVAIAAR

SEQ ID NO: 22602 - protein, 461 aa, Raphanus sativus
MERRREFQRKVQEAQLPVEEQDEMMRSLARRETEYMRLQRRKIGIDDFELLTVIGKGAFGEVRLCRLRSTGEVYAMKKLKKTDMLSRGQVEHVRSERNLLAEVDSRYIVKLFYSFQDSECLYLIMEYLPGGDIMTLLMREDILSEDVARFYIAESILAIHSIHQHSYVHRDIKPDNLILDKSGHLKLSDFGLCKPLDDKYSSLLLEDEEMLSQEAESQSGKADSDKAPWQMPKEQLLQWKRNRRALAYSTVGTLDYMAPEVLLKKGYGMECDWWSLGAILYEMLVGYPPFCSDDPRITCRKIINWRVCLKFPEEPKISEEARDLICRLLCDVESRLGTRGAEEIKTHPWFNGTQWDKLYEMEAAYRPTVDGELDTQNFEKFPEVEGSASEAPQVGPWRKMLTSKDNNFIGFTFKKSDITRSMENTGTDMKPNGSGDAPSLISLLGRINMEEAEGGELNQKT

SEQ ID NO: 22603 - protein, 541 aa, Raphanus sativus
MAIHVERIRRRRLWRERERERKEMEDIQEEENGTDVEVLGSSLTMEKVAAAKQYIENHYKAQNKNIQERKERRWILERKLASSGVPKEEQINMIKDLERKETEFMRLKRNKISVDDFELLTIIGRGAFGEVRLCREKKSGNIYAMKKLKKSEMVMKGQVEHVRAERNLLAEVASHYIVKLYYSFQDAEYLYLIMEYLPGGDMMTLLMREDTLREDVARFYIAQSVLAIESIHRYNYIHRDIKPDNLLLDKDGHMKLSDFGLCKPLDCRTLPSIQENRATDDEAVSEPMDVDRAFPDTDNKRSWRSPQEQLQHWQMNRRTLAFSTVGTPDYIAPEVLLKKGYGMECDWWSLGAIMYGMLVGYPPFYADDPLSTCRKIVNWRNHLQFPEDAKLSREAKDLICRLLCNVDHRLGTGGGAQQIKVHPWFKDVVWEKLYEMEAAYKPEVNDELDTQNFMKFDEVNSPATERTKSGTSRKNLAPKDLSFVGYTYKNFDAVKGLRHSLEMARTMSLDRSPAEVMPVGRISGEAAEAQMVSTMDDPMVI

SEQ ID NO: 22604 - protein, 518 aa, Raphanus sativus
MEDIQEEENGTDVEVLGLSLTMEKVAAAKQYIENHYKAQNKNIQERKERRWILERKLASSGVPKEEQINMIKDLERKETEFMRLKRNKISVDDFELLTIIGRGAFGEVRLCREKKSGNIYAMKKLKKSEMVMKGQVEHVRAERNLLAEVASHYIVKLYYSFQDAEYLYLIMEYLPGGDMMTLLMREDTLREDVARFYIAQSVLAIESIHRYNYIHRDIKPDNLLLDKDGHMKLSDFGLCKPLDCRTLPSIQENRATDDEAVSEPMDVDRAFPDTDNKRSWRSPQEQLQHWQMNRRTLAFSTVGTPDYIAPEVLLKKGYGMECDWWSLGAIMYEMLVGYPPFYADDPLSTCRKIVNWRNHLQFPEDAKLSREAKDLICRLLCNVDHRLGTGGGAQQIKVHPWFKDVVWEKLYEMEAAYKPEVNDELDTQNFMKFDEVNSPATERTKSGTSRKNLAPKDLSFVGYTYKNFDAVKGLRHSLEMARTMSLDRSPAEVMPVERISGEAAEAQMVSSMDDPMVI

SEQ ID NO: 22605 - protein, 584 aa, Vicia faba
MGSVEDDSSRLEEALIQDEESKLYTGDGSVDFKGRPVLKKNTGNWKACPFILGNECCERLAYYGIATNLVKPILLAKLHEGNVSAARNVTTWQGTCYLAPLIGAVLADSYWGRYWTIAIFSMIYFIGMGTLTLSASIPALKPAECLGAVCPPATPAQYAVFFIGLYLIALGTGGIKPCVSSFGADQFDDTDSRERVKKGSFFNWFYFSINIGALISSSFIVWIQENAGWGLGFGIPALFMGLAIGSFFLGTPLYRFQKPGGSPLTRMCQVVAASFRKRNLTVPEDSSLLYETPDKSSAIEGSRKLQHSDELRCLDRAAVISDDERKRGDYSNLWRLCTVTQVEELKILIRMFPVWATGIVFSAVYAQMSTMFVEQGTMMDTSVGSFKIPAASLSTFDVISVIFWVPVYDRFIVPIARKFTGKERGFSELQRMGIGLFISVLCMSAAAIVEIKRLQLAKELDLVDKAVPVPLTIFLQIPQYFLLGAAEVFTFVGQLEFFYDQSPDAMRSLCSALSLLTTSLGNYLSSFILTVVLYFTTRGGNPGWIPDNLNKGHLDYFSGLAGLSFLNMFLYIVAAKRYKSKKAS

SEQ ID NO: 22606 - protein, 317 aa, Vicia faba
FGADQFDEFEPKERSYKLSFFNWWFFSIFVGTLFSNTFLIYIQDRVGWAVGYGLPTAGLTISVLVFLIGTPLYRHKLPSGSPITRMLQVFVASIRKVEGTSPDDPKELHELSIDEYAYNGRNRIDHSSSLRSFLDKAAMKTSQTSSWMLCTVTQVEETKQMTKMIPILITTIIPSTLIVQSTTLFIKQGTTLDRSMGPHFDIPPACLTAFITIFMLISIVVYDRAFVPMVRRYTKNPRGITMLQRLGIGLVLHIAIMVTACLAERKRLRVARENNLFGRHDTIPLTIFILLPQFALGGVADSFVEIAKLEFFYDQSP

SEQ ID NO: 22607 - protein, 823 aa, Mus musculus
MMLRWSGVWGFHPPRIFPSLLVVVALVGLLPVLRSHGLQHSPTASTIRGSEPPRERSIGDVTTAPSEPLHRPDDHNLTNLIIEHGGKPSRKAFPVLDIDYPHVRTPFEISLWILLACLMKIGFHVIPTISSIVPESCLLIVVGLLVGGLIKGVGETPPFLQSDVFFLFLLPPIILDAGYFLPLRQFTENLGTILIFAVVGTLWNAFFLGGLLYAVCLVGGEQINNIGLLDTLLFGSIISAVDPVAVLAVFEEIHINELLHILVFGESLLNDAVTVVLYHLFEEFASYDSVGISDIFLGFLSFFVVALGGVFVGVVYGVIAAFTSRFTSHIRVIEPLFVFLYSYMAYLSAELFHLSGIMALIASGVVMRPYVEANISHKSHTTIKYFLKMWSSVSETLIFIFLGVSTVAGSHQWNWTFVISTLLFCLIARVLGVLVLTWFINKFRIVKLTPKDQFIIAYGGLRGAIAFSLGYLLDKKHFPMCDLFLTAIITVIFFTVFVQGMTIRPLVDLLAVKKKQETKRSINEEIHTQFLDHLLTGIEDICGHYGHHHWKDKLNRFNKKYVKKCLIAGERSKEPQLIAFYHKMEMKQAIELVESGGMGKIPSAVSTVSMQNIHPKAVTSDRILPALSKDKEEEIRKILRSNLQKTRQRLRSYNRHTLVADPYEEAWNQMLLRRQKARQLEQKITNYLTVPAHKLDSPTLSRARIGSDPLAYEPKADLPVITIDPASPQSPESVDLVNEELKGKVLGLNRGPRVTPEEEEEDEDGIIMIRSKEPSSPGTDDVFTPGSSDSPSSQRIQRCLSDPGPHPEGVSELLCWALGHIRQ

SEQ ID NO: 22608 - protein, 605 aa, Solanum tuberosum
MDAVSIRVPYKNLKQQEVELTNVDESRFTQLEIRSDSSSPRASNGEMNDSHLPLPPPPVRNSLLTLILSCTVAAGVQFGWALQLSLLTPYIQTLGIEHAFSSFIWLCGPITGLVVQPCVGIWSDKCHSKYGRRRPFIFIGAVMISIAVIIIGFSAADIGYLLGDTKEHCSTFKGTRSRAAIVFVVGFWMLDLANNTVQGPARALLADLSGPDQRNTANAVFCSWMAVGNILGFSAGASGGWHRWFPFLTNRACCEPCGNLKAAFLVAVVFLTLCTLVTLYFANEVPLSPKQYKRLSDSAPLLDSPQNTGFDLSQSKRELQSVNSVANNESEMGRVADNSPKNEEQRPDKDQGDSFADSPGAVLVNLLTSLRHLPPAMHSVLIVMALTWLPWFPFFLFDTDWMGREVYHGDPKGEADEVNAYNQGVREGAFGLLLNSVVLGVSSFLIEPMCKWIGSRLVWAVSNFIVFVCMACTAIISVVSISAHTEGVQHVIGATKSTQIAALVVFSLLGIPLAVTYSVPFSITAELTADAGGGQGLAIGVLNLAIVLPQMVVSLGAGPWDALFGGGNIPAFVLASLAALAAGIFAMLRLPNLSSNFKSTGFHFG

SEQ ID NO: 22609 - protein, 350 aa, Trypanosoma brucei
MVSFSIDGRIEQRYKILCHIGSGAYGVVWCALDRVTKMKVAIKKVYDAFGNRQDAQRTYREVMLLSTLQLDNIVPLLNVIRSINGTDLYLVFELAETDLSVVLRHNIMESVQRQYVAYQIVYAVAGLHARGVIHRDLKPANVFLNSDCNIKLGDFGLARCFNTQGGDNDLTEYIATRWYRSPEVLVKSTCYTTAMDMWAVGCILGELFTGSPLFTGNSTLHQIGLIVAALGEPSAEDLESLKSEETWPLIDSLPAIDPDPLPERLSKYNADAVDLICKCIVFDPNKRPTAREALQHPYFAPFTSPSDFEELDKAVPIKLPFPDEEERPADQYRSALYDIIGNRRKQKLAL

SEQ ID NO: 22610 - protein, 425 aa, Oryza sativa (japonica cultivar-group)
MERVFSVEEISDPFWVPPPPPQSAAAAQQQGGGGVASGGGGGVAGGGGGGNAMNRCPSEWYFQKFLEEAVLDSPVPNPSPRAEAGGIRGAGGVVPVDVKQPQLSAAAAAAATTSAVVDPVEYNAMLKQKLEKDLAAVAMWRASGTVPPERPGAGSSLLNADVSHIGAPNSIGGNATPVQNMLSGPSGGSGSQLVQNVDVLVKQPTSSSSREQSDDDDMEGEAETTGTARPADQRLQRRKQSNRESARRSRSRKAAHLNELEAQVSQLRVENSSLLRRLADVNQKYNDAAVDNRVLKADVETLRAKVKMAEDSVKRVTGMNALFPAASDMSSLSMPFNSSPSEATSDAAVPIQDDPNNYFATNNDIGGNNNYMPDIPSSAQEDEDFVNGALAAGKIGRTASLQRVASLEHLQKRMCGGPASSGSTS

SEQ ID NO: 22611 - protein, 3454 aa, Oryza sativa (japonica cultivar-group)
MQNPRPPYAAHHQLQQHLASLLSAAAGEPPHPSDDASRAAALSTLRLSLLHPPNRPLLPSLAHFIAPPISVLLADDASYAVRRAAVSAYAALCAVLCAHEAPGGLPDRFVAWGLPLLGEPTSAALLAEGLRELLATGDVPAVERFVPPLLAACRDVLEDERTSLTVLRCLLGLLTLVAAKFPHCFRPQFVDIVDLLLGWVFVPDLAESDRSTIMDSFLQFQWHWLGNLQFSLGLLPKFLADMEVLVHDPNLAASHNSGRLRPLFACFSTVLQIMASGVAERNSLKELIAGPLEGLSPQLLRCASVIASKLGWSERMEEASRCLVLLAEILQERFAEFYGMFVDVLAQSLEVASSVQLVAALKTNLQVLSLQNLGLRASAVEALLDFSSFLSRLRLHPNHTMVTNVATTYLFVLQHGLEDVVDQAISSLMKELELLKSLLETGRASYPDIQNLSLGSNSETQSKSNSSTFSLVGYSEHQLLSLMKFDLKILLATISVDTKKRNDKAASLTSFISAKLDPFGTPFHDFLEMQFHIFSILHRLSSMDLSSTIAPSKANGSGDSGSQTQLVIESRKSFCDCKNKFMHKYGKLVVWGLNASSSMTLKLEALAWIDTFGNLVLGMERDVDKRNISYEVHEGATLLNTILFAILDCAYDREPKVRLHVATSLEILFLGRLINPMDFSVVTQVLLDKLSDPDNAVKKGFSRLLSIALPITTYTFGLLENRWSYQHSPDTANMSKHCMSWRHVLAVKQQPRKLHWQQLVSILSYLSLRLKLPLSSWVQRLFFSYRGKKDMFSGQTDVSGDSDGNELFKGPDVDRTIIDRIYSVNNLAAVWWGIHEAARHCINLRLRTHLGGPTQTFAALERMLLDVPNLLAPEATEGEGRYIAPSDTSLLPMRLLLDFVEALKKYVYNAYEGSFVLPAPPKASSLFFRANKRVCEEWFSRICDPMLNAGLALHCNDAVIHYCSSRLLDIRNLAASSLKDNSRMGGATESHHAFRERLEADFLKVLRHASLALCRCHETDALVGLQRWAISTFYTYFEQDKQLVRGVSDSQNHFSWMSGLIYQSQGKYEKAAAHYSHLLQFEEGLASMESDGIQYIIARVIECYTSLSDWKCLEGWLSELQVLRAVHAGKPYSGALTSAGNELNAVHAMACFDGGDFHSAWGYLDLTPKSSSELSLDPKVAVERSELMLLRAMLQSHSKPDKAREELNKAKLMLDEALSVVPLNGLTEAAACAGQLYCIFAFEETTELACPNRTNQSPALMDYLLRLLQDPIDRINQDCNIWLKIFKVYCTTQPSSLPTLLLCQKLASLARKQSNLKLASRLNQYIINHPLSSSDEMEKEMLTLNIKYEGALLKHDQGKKEEALTDLWSLVRATVLSTVSDSSGAGTPLIAKACLKFSTWMERENSTHIMNMILPKVIEDINDSGGFQNGAEKLLLGDNGSVSASNSHVVSQEIIGIARKTSWQLCPSMGKAWHSYASWCITHANYSLSGTDSKLQNSLFPALQSELSPDRFHLTDNEKSEVQEIIRNFCADKDGNYVDCSISPTAGCSYNSEGNPIVSLIEQTICLLETAAGAPGSEACDGEGPSVRLSSELTVLFCKCDSAKDSSMTLIGKLIEIWWTLRRRRVSLFGHAAHAYFQYLSHSSTGLQPSYHRDVLKGKTKSYTLRALLYLLHIILNYGVELKEIVESGLSTVPLLPWQEIIPQLFARLSFHPEKIVRKQLESILVKLGNLSPCSIVYPTLVDINACEGEPSDELQRILDFLVKQYPKLVKDVKLAIEELGMVTVLWEEQWLSTLQDLHSDVLRRINILKEEAARVAANSTLSSAEKNKINAAKYSAIMTPIVVALERRLASTSREPKTSHEVWFHKEYNAQLKSAITALKTPPGSPSALGEIWRPFDSIAASLATHLRKSCISLSEIAPQLAALSTSNIPMPGFEKQIFSSSESSFADSHGTITISSFCKEVTVLSTKTRPKKLVLQGSDGQKYTYLLKGREDLRLDSRIMQLLEAINSFFYSSSDTRSRNMAIRFYSVTPISGRAGLIQWVENVSSIYNVYKTWQKRSQLAQAQLSSVNTVNNSIHKSVPPVPRPSDMFYGKIIPALKEKGIKRVISRRDWPLDVKRKVLLELMKETPKQILWQEMWCASEGFRNFNSKVKRFSSSVAAMSMIGHVLGLGDRHLDNILMDFSSGDVVHIDYNICFDKGKRLKIPEIVPFRLTQTIESALGLTGVEGVFRVTCEEVMAVLLRNKDIILMLLEVFLWDPLMEWTRGNIQDEAGIAGEEKKGMELAVSLSLFSSRIQEIRVPLQEHQDLLVTNLPATLSSLKKFLDTLEQYEVISAMFYHAEKERSSALQSETSAKSMLAEASSLAEKSRTSFELHAHELAETKAAANDEANKLAVWVEKHGRILEAIRDNSIAGVESCMQLNSKDDALSLISAVLESEVPLTVVPEPTRAQCSELDREVSQLILELQGGLSAALESLGEYALVLQQVLPVNYITTSPVTGWAQALQLSVSSGSEDLLPLAKRQAAEVIAKVQGEGINLVQQRYRDLLNQMESYVVCIERLARERSELMNSIGFENEVRSKEWILSAFMNSIQLPSPKRDMGNIPFLQSGNVGVKTPAHEDIQDETGIVLSILGIAVGQLYSDVRAKVSELSSKVTGIAKFRTDEAGLQADAGTSLQLFDQQVEKCALISGFVGEVHGVMEAKLVEMNTAYAKPQHGQWASTFQRILCSSTNMIEQMTEVFLPEIIRSFISYNSEVMEAFGSVSQIRGSVDTALEKLVRIELERASMTEFEQSYFMKVGRITEQQIALEEAAMMGRDHLSWEEAEELASQEEACRAQLEQLQETWSQKDMTISSLMKVESSAMNSLLSSKQYFSSLVNVDQESEFHLRRSKALLSVLTKPLADLEALDHMLSACGLFPYHDHCFFVWKLSLLDSILDLCMHEISSSVEHSFTTNQLYTALKTKLTNHVEKQVYRYIMERIAPAFILQLDKEISDLLQLSQGRRESGQPKRDSAAVGRIAVMLEEYCNAHETARAARTAVSLMQRQSNDLTEALRKIVLEIIQVEWLHDLSSPHAQKSKVLSQNILSDDKFISVLLNISRGNLLDKIQSSVSLVTRSIECLQACENTSVSAEGQLERAMGWACAGPNTSGAGSSTTKASGIPSEFHDHLLKRRKLLWVIQEQASDLANICTSVLEFEGSRDGIYLIPEDKSSGQSTDRGRTWQQTFLNLLTRLDAAYRSFTCAEQEWKLSQFNMESAGKSLYSVTNQLSVVSSRAKSALECSVYIFPVNLQDTLVSMYERASEVTASLSGFKHVSQDRTALTSECGSLLEEVLAIAEGLHDVYIVGKEAAVMHNSIMSNLSKANTILLPLEASLSADLAVMSEAISKEREKNNTSMPLIHGKALYQSYIIRIRDAYKNLEPLVPPLADDAKELHSLMTKLGRLSSIHAGSLHKVLN

SEQ ID NO: 22612 - protein, 282 aa, Mus musculus
MSRQAATALSTGTSKCPPSQRVPALTDTTASNNDLASLFECPVCFDYVLPPILQCQSGHLVCSNCRPKLTCCPTCRGPLGSIRNLAVEKVANSVLFPCKYSASGCEITLPHTKKAEHEELCEFRPYSCPCPGASCKWQGSLDAVMPHLMHQHKSITTLQGEDIVFLATDINLPGAVDWVMMQSCFGFHFMLVLEKQEKYDGHQQFFAIVQLIGTRKQAENFAYRLELNGHRRRLTWEATPRSIHEGIATAIMNSDCLVFDTSIAQLFAENGNLGINVTISMC

SEQ ID NO: 22613 - protein, 374 aa, Equus caballus
STAGKVIKCKAAVLWEEKKPFSIEEVEVAPPKAHEVRIKMVATGICRSDDHVVSGTLVTPLPVIAGHEAAGIVESIGEGVTTVRPGDKVIPLWTPQCGKCRVCKHPEGNFCLKNDLSMPRGTMQDGTSRFTCRGKPIHHFLGTSTFSQYTVVDEISVAKIDAASPLEKVCLIGCGFSTGYGSAVKVAKVTQGSTCAVFGLGGVGLSVIMGCKAAGAARIIGVDINKDKFAKAKEVGATECVNPQDYKKPIQEVLTEMSNGGVDFSFEVIGRLDTMVTALSCCQEAYGVSVIVGVPPDSQNLSMNPMLLLSGRTWKGAIFGGFKSKDSVPKLVADFMAKKFALDPLITHVLPFEKINEGFDLLRSGESIRTILTF

SEQ ID NO: 22614 - protein, 374 aa, Equus caballus
STAGKVIKCKAAVLWEEKKPFSIEEVEVAPPKAHEVRIKMVATGICRSDDHVVSGTLVTPLPVIAGHEAAGIVESIGEGVTTVRPGDKVIPLFTPQCGKCRVCKHPEGNFCLKNDLSMPRGTMQDGTSRFTCRGKPIHHFLGTSTFSQYTVVDEISVAKIDAASPLEKVCLIGCGFSTGYGSAVKVAKVTQGSTCAVFGLGGAGLSVIMGCKAAGAARIIGVDINKDKFAKAKEVGATECVNPQDYKKPIQEVLTEMSNGGVDFSFEVIGRLDTMVTALSCCQEAYGVSVIVGVPPDSQNLSMNPMLLLSGRTWKGAIFGGFKSKDSVPKLVADFMAKKFALDPLITHVLPFEKINEGFDLLRSGESIRTILTF

SEQ ID NO: 22615 - protein, 724 aa, Mentha x piperita
MASSCGVIKSSFLPSLHSEDSTFLSRAPTSLPLKNHKLNVVAALQQDSSNDVVPSGDRLSRPKSRALSFTGEKPPIPILDTINYPNHMKNLSVEELANLADELREEIVYTVSKTGGHLSSSLGVSELTVALHHVFNTPDDKIIWDVGHQAYPHKILTGRRARMHTIRQTFGLAGFPKRDESAHDAFGAGHSSTSISAGLGMAVARDLLQKNNHVISVIGDGAMTAGQAYEALNNAGFLDSNLIIVLNDNKQVSLPTATVDGPAPPVGALSKALTKLQASRKFRQLREAAKSMTKQMGAPAHEIASKLTQYVKGMMGKPGASLFEELGIYYIGPVDGHNVEDLVYIFKKVKEMPAPGPVLIHIITEKGKGYPPAEIAADKMHGVVKFDAKTGKQMKTKNKTKSYTQYFAESLVAEAEHDDKIVAIHAAMGGGTGLNIFQKQFPDRCFDVGIAEQHAVTFAAGMAAEGLKPFCAIYSSFLQRGYDQVVHDVDLQKLPVRFMMDRAGVVGADGPTHCGAFDTTYMACLPNMVVMAPSDEAELMNMIATAAIIDDRPSCVRYPRGNGIGVALPSNNKGTPLEIGKGRILKEGSKVAILGFGTIVQNCMAAANLLEQHGISVTVADARFCKPLDGDLIKKLVQEHEVLITVEEGSIGGFSAHISHFLSLNGLLDGNLKWRPMVLPDRYIDHGAQSDQIEEAGLSPKHIAGTVVSLIGGGKDSLHLINNL

SEQ ID NO: 22616 - protein, 183 aa, Eucalyptus grandis
MGRGRVELKRIENKINRQVTFAKRRNGLLKKAYELSVLCDAEVGLIIFSNRGKLYEFCSSSSMLKTLERYQKCNYGALEPNVSARESLELSCQQEYLRLKARYEGLQRTQRNLLGEELGQLCSKELESLERQLDGSLKQIRSRRTQYMLDQVTDLQHREQVVHEANRTLNQRLMEGYQVMRSS

SEQ ID NO: 22617 - protein, 208 aa, Eucalyptus grandis
MGRGKIEIKRIENSNNRQVTYSKRRNGLIKKAKEISVLCDAQVSVIIFGSSGKMHEYCSSNTSLVDILDQYHTQCGKRLWDAKQENLSNELDRIKKENDNLQIQLRHLKGEDITSLNHRELIILEDTLENGVGCVRDQKDEVLMTHRRNQKQLEEDAKELHFYAQQKDMMMAETGRAGNDGYHQRMKADFGPSTYHVQPIQPNLQRRF

SEQ ID NO: 22618 - protein, 245 aa, Eucalyptus grandis
  unsure (1)..(245): unsure at all Xaa locations
MGRGKVELKRIENKINRQVTFAKRRNGLLKKAYELSVLCDAEVALIIFSNRGKLYEFCSSSSMMKTIEKYQKCSYGSLETNCSINEMQNSYQDYLKLKARVEVLQRSQRNPPWEELGPLNSKELEQLEHQLENSLKQIRSAKTQFMFDQLXHLQHKEQMLVEANRELWKKLEESNTRIPLRLGWEAEDHNNISYSRLPTQSQGLIFQPLGGNPTLQIGYNPAGSNELNVSAADQHPNGFIPGWML

SEQ ID NO: 22619 - protein, 370 aa, Rhodococcus rhodochrous
MMKTQAAILWERGGPWSVEEIDLDPPRHGEVLVEMGGSGLCHSDEHVLTGDLPWPLPMVGGHEGAGTVVEVGPGVEGLAAGDRVIFGFLPACGRCAACSAGMQNLCELGQYLGDGTQISDHTSRHHARGQDLGLMCLLGTFAQHTVVSEANCIKIDDDIALDKACLLGCGVVTGWGSAVFTGGVKPGDTSVVVGVGGIGINAVQGAAMNGSQYVVAVDPVEFKRTKALELGATHAVATSEEAQALVADLTYGRGANVVVNTTGVGEGDQIGASLAMTAKRGTVVVTNLHRATEETVKMSALDLVLMEKRVVGSLFGSANPRLHIPKMLGLYRSGHLKLDELATRSYKLDEVNTGYQDMREGRNLRGVITF

SEQ ID NO: 22620 - protein, 482 aa, Rhodococcus rhodochrous
MSMQYDSLFIGGDWIAPSSSKRITAISASTEQPIGSVPEAQEADVDAAVAAARRALDDPAGWAHWAPAARAAAIERLADVLERRAEDVVQCVSAQNGMPVAVARQLEGVFPVVLLRYYAGLARDTATEETRPGLFGGSTLVCREPLGVVGAIVPWNFPQTLAAFKYAPALAAGCTLVIKPSPETVLDAFVFAEAVAEAGIPAGVVNVVPGGREVGAYLVEHPGVDKISFTGSTAAGRSIGEVCGRLLRPVTLELGGKSAAIVLDDAGLDLQTMSEKLFAATLLNNGQTCFLGTRVLAPRSRYSEIVDLFTDLAGTLKVGDALDDTTQIGPMATAAQRDRVEQYIAKGLGDGARITIGGGRPADQDKGWFVEPTIFADVENNHTIAQEEIFGPVLSVIPYSDEDEAVRIANDSDFGLGGTVWTNDPDRGLALAKRVQTGTIGINGYLPEPTAPFGGVKASGLGRELGPEALSNYQQLKSIYLD

SEQ ID NO: 22621 - protein, 478 aa, Suberites domuncula
MSDKSKKSLDKLSEESLMREPEEVFDLLEKIGEGAYGAVYKAMHKESGQLLAIKQVPVDSDLQDIIKEISIMQQCDSQYVVKYYGSYFKNTDLWIVMEYCGAGSVSDIMRIINRPLREEEIAIVMQYALKGLEYLHFKRKIHRDIKAGNILLNLEGHAKLADFGVAGQLTDTMAKRNTVIGTPFWMAPEVIQEVGYDCLADIWSLGITALEIAEGKPPYADVHPMRAIFMIPTKPPPTLKDTDKFSNEFSDFISRCLVKNPEERMSATALLQHKFIKSAKPVAVLKELIQDAMRILEEEEGSGSDEEDDNDVDDQFFTASNTLVQRGGGGARGVAPPVGDGTITDLGTMVIIDDTDEDDLGTMKRVDTGVVDKESKEYRPGFMQHFDQKEEQQKKKNVGRKQAPQGPHDISFYFPDIPDGMDFREFLKSLNQQTLEEYLSALDNHMSTELESLRERYPQKRLPILKAMDAKKKQQFRN

SEQ ID NO: 22622 - protein, 673 aa, Suberites domuncula
MSDSGQVRRPKRRNAVRQRQVVEIRGHKFVLNYFKQFTFCGHCTRFLWGVTGPQGYKCLLCDLAIHRRCMEYVSFICPGTSLPEGIEPRPHKFRATTYHTPTWCDHCGSLLYGIIRQGVQCSDCGINVHHRCKGLVPKTCGLGQSEKRGRIKVTFSTLQLDDAHIRVNIMIHECRNLPPMDANGLADPYVKLRLYPEPTDTPNIKQKTERKEKTLEPKFEEDFFYDVNMNHLDTFLVIEVWDWDKFTANDYVGGFALRIGEIIELTKMEPHSSWYKLLDEKRSKTHHERILADEEATKLIEEFRKATILDKAKNLVTDVPIMRRGSELVPGAKDMPKMKLEDFNLLVVLGKGSFGKVFLAEQKTTKDVYAIKSLKKDLIVQEDDVECTLNERKVLALQEKPPFLTGLHSCFQTRDHLFFVMEYINGGDLMFHILELGRFPENQTKFYAGEIVLGLRFLHKRGIIYRDLKLDNVMLDADGHIKIADFGLCKEGILGGNKTRTFCGTPDYIAPEIISYQPYDAAVDWWALGVLTYEMLVGRPPFDGDDDDQLFNNIMEKPVHYPRGMSDPAKKIIQGFLTKHPSRRLGCHPETGEQDIKGAPFFKSIDWDRLGRRELKPPYKPKIRGKKSVSNFDPEFTKEPCRLSPVDPTVIGAIEPEVFEGFSFTNPEMYHEP

SEQ ID NO: 22623 - protein, 248 aa, Sphingomonas sp. UG30
MTSPASTIDMLVTQITRVAKDINSYELRPEPGVILPEFTAGAHIGVSLPNGILRSYSLVNPQGERDRYVITVNLDRNSRGGSRYLHEQLRVGQRLSIVPPANNFNLVETARHSVLFAGGIGITPIWSMIQRLRELGSSWELHYACRGKEFVAFRQELEQAASEAGATFNLHLDEEANGGFLDLSGPVARAGEDSIFYCCGPEAMLQAYKAASADLPSERVRFEHFGAAPSSAPADDVFTVLARSGQEF

SEQ ID NO: 22624 - protein, 482 aa, Pseudomonas fluorescens
MLDVPLLIGGQSCPARDGRTFERRNPVTGELVSRVAAATLEDADAAVAAAQQAFPAWAALAPNERRSRLLKAAEQLQARSGEFIEAAGETGAMANWYGFNVRLAANMLREAASMTTQVNGEVIPSDVPGSFAMALRQPCGVVLGIAPWNAPVILATRAIAMPLACGNTVVLKASELSPAVHRLIGQVLQDAGLGDGVVNVISNAPADAAQIVERLIANPAVRRVNFTGSTHVGRIVGELSARHLKPALLELGGKAPLLVLDDADLEAAVQAAAFGAYFNQGQICMSTERLIVDAKVADAFVAQLAAKVETLRAGDPADPESVLGSLVDASAGTRIKALIDDAVAKGARLVIGGQLEGSILQPTLLDGVDASMRLYREESFGPVAVVLRGEGEEALLQLANDSEFGLSAAIFSRDTGRALALAQRVESGICHINGPTVHDEAQMPFGGVKSSGYGSFGGKASIEHFTQLRWVTLQNGPRHYPI

SEQ ID NO: 22625 - protein, 687 aa, Saccharomyces cerevisiae
MTDITPVLCNDVDVNGNNVNDDVSSNLKRPIDQGDPSNGLAEEENPANNQLHLKKARLDGDALTSSPAGLAENGIEGATLAANGENGYNATGSGPEDEQQGLKKEEGGQGTKQEDLDENSKQELPMEVPKEPAPAPPPEPDMNNLPQNPIPKHQQKHALLAIKAVKRLKDARPFLQPVDPVKLDIPFYFNYIKRPMDLSTIERKLNVGAYEVPEQITEDFNLMVNNSIKFNGPNAGISQMARNIQASFEKHMLNMPAKDAPPVIAKGRRSSAQEDAPIVIRRPQTHNGRPKRTIHPPKSKDIYPYESKKPKSKRLQQAMKFCQSVLKELMAKKHASYNYPFLEPVDPVSMNLPTYFDYVKEPMDLGTIAKKLNDWQYQTMEDFEREVRLVFKNCYTFNPDGTIVNMMGHRLEEVFNSKWADRPNLDDYDSDEDSRTQGDYDDYESEYSESDIDETIITNPAIQYLEEQLARMKVELQQLKKQELEKIRKERRLARGSKKRGKRSKGRSGSKNASSKGRRDKKNKLKTVVTYDMKRIITERINDLPTSKLERAIDIIKKSMPNISEDDEVELDLDTLDNHTILTLYNTFFRQYESSSGASNGLDGTSGVTRDASSLSPTSAGSRKRRSKALSQEEQSRQIEKIKNKLAILDSASPLSQNGSPGQIQSAAHNGFSSSSDDDVSSESEEE

SEQ ID NO: 22626 - protein, 111 aa, Anopheles gambiae str. PEST
MVERIEDLNLPNTSVTRLIKEAIPADVKISSECRVALARATSVFVLYLTSAATTAAQQKNQKSLTADHVLKGLEEIEFESFIEPLKGELENFRKMIKSRKDKKAAKPDVDT

SEQ ID NO: 22627 - protein, 533 aa, Anopheles gambiae str. PEST
DLYVSDSMVNYTGKHGHAYAINGQLPAPTLYFTEGDTAEIHVHNRLKKENTALHWHGVMLENKEDGIPFLTQKPIKPGETYIYRFKISQNGTYWYHSHQGLQEQMGMYGMLVFRKRGETETDRKVQADIPVMLSEWTDEHPHQVMRRLQMGVADWYAIKKKSVQSYSEAIASGNFFTKLKNEWKRMEAMDISDVYYDKFLLNGQPSASYKNLKAGDKVRLRIANGGASSYFWLTYGGGKMTVVGNDGNDVEPVEVDKLIIGISETYDVEVTIPENKSFEFRATSEDRTGHSSLWLGEGEKVEAPELKRLMLFEGMKSMNNMMKMNGDMKPMNMKMGLQRMDANSVMYPEVPEEDRKATMQHLKDMMNPPKKAKSKKEDHSGHDMPLKLSDSKADEHAGHSMETKNEDAPLQLSDSKAGEHAGHNMTDMPKEKPVILNYDMLASTEMTSLPADAPVKELKFTLEGNMRRYVWSLDNKTVVETDKIKIKRGEIVRITLYNNSMMRHPMHLHGHDFRVINSKGDYSPLKNVLDLMP

SEQ ID NO: 22628 - protein, 40 aa, Anopheles gambiae str. PEST
MKLNENFLVDFGGEPYGPGLPHEMRYPGGDCTSDIWLVNE

SEQ ID NO: 22629 - protein, 229 aa, Anopheles gambiae str. PEST
GADVPSDAPAHCPGTQSDDAGKASACAGCPNQQLCATGPKGPDPAIALDNLSLMSIGFLLGSPDDAIIWRGPKKNGMIRQFLTEVDWGQLDYLVLDTPPGTSDEHLSATTFLKGTDGSWGAVLVTTPQEVALLDVRKEISFCKKLAIPVVGVIENMSAFVCPKCTTETRIFPARTGGAEQMCIEMEVPYLGQLPLDPRLTKCCDEGKDFITEFPTSPAVVALEEIVTKV

SEQ ID NO: 22630 - protein, 310 aa, Anopheles gambiae str. PEST
MTTALEQVFADALGIDVGSVSDQLAYNSIPQWDSVAHMGLIAQLEDCYGAGDPRQVRGRPLMQGLLQGKRVLITGAGRGIGLAIARQFAAQGAELWLAGRDEAAMSRLADELGAEFGVPCQPLCVDVAQPQAVKQAFQQLFAQTRQLDVLVNNAGILEEGLLGMVNQAQLEQTFSHNTFSVVYCSQYAARLMQRSGGGSIINLASLMGRVGAAGLCSYAGSKAAVIGITQSLAKELAASRIRVNAIAPGFIDTEMAHVIPDDKFAERLASIAMGRIGTPDEVAKVALFLASDLASYVTGQVIGVDGGMTV

SEQ ID NO: 22631 - protein, 113 aa, Anopheles gambiae str. PEST
NPTNTNTNTSMTGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 22632 - protein, 336 aa, Anopheles gambiae str. PEST
MSNIEALYKALNARILILDGAMGTMLQRHKFEEEDFRGDRFKDWPSPLKGNNDLLSLTQPQAIEDVHKQYFEAGADIIETNTFSGTTIAMADYGMEELVTELNYESARIARKVADEYTAKTPDKPRFVAGAIGPTNKTASLSPDVNDPGYRAITFDELKEAYKQQAKALLDGGSDILLVETIFDTLNAKAALFAIDEIQDERNIRVPIMVSGTITDASGRTLSGQTAEAFLISVSHLNLLSVGFNCALGAQQLTPYLEVLSHNTDFAVSAYPNAGLPNAFGQYDETPEDMAEQIKEFVDKGLINIIGGCCGTTPEHIKAIADLAKNYKPREISVKS

SEQ ID NO: 22633 - protein, 357 aa, Anopheles gambiae str. PEST
ALPFYIIRAMESLRDGMLVGLGNPLLDISAVVEKDLLNKYDMQPNNAILAEEKHMPIYQELIEKYQAEYIAGGSVQNSLRVAQWILQRPRTAIFFGCVGQDEYARILEERATSNGVNVQYQRSATSPTGTCAVLVTGTQRSLCANLAAANDFTPEHLRSDGNRAYLQGAQFFYVSGFFFTVSFESALSVAKEAAATGRMFMMNLSAPFVPQFYKNNLEEIFPYVDVLFGNETEAIALAKEFNYGTEDLREIGKRIAALPKENGKRKRIVIITQGSDPVLLIEAGTDNVREFPVQKLAPEQMVDTNGAGDAFVGGFLAQLLQSRTVDVCIKCGIWAAREIIQRSGCTFEGEPSFCADN

SEQ ID NO: 22634 - protein, 185 aa, Anopheles gambiae str. PEST
ISEDDGCVSRWPIVYRSTVGTGPLIKCIRCQFHCAVIWSSSNMSESSNANVVRVMQHRWTRFGMVRWRSCCTLYAYSRTWTRSMVTISLRWTLIPPVQRTVIHRTYTNSKHNELHHSGWNTCSSCHFVPGGKEVPTRDRLVLPCLNSDRIFVIDTGTDPRAPKLAKVIEGDVLKDADCTAPHTTH

SEQ ID NO: 22635 - protein, 751 aa, Anopheles gambiae str. PEST
KLIISCCFMMLKQKVSLEWKKRVKNEYMKIRLSKRHKKVDDVRSAWNRNRQALLGMLVAENDAWLSTNATWLQCEVEQLPHVNCMKKAVVIDHEGNHQNVSIRVVNAVTTIPTMYTWAPTQQNFMVEDETVLHNIPYMGDEVLDKDGSFIEELIKNYDGKVHGDKEDSIDDAMFVELVHTLMQYTNQESNIDEKTAHSKSPIGEKSPISIHNFDQSIGKASSSKMEKDNNCDENLTCNDLNTNKELRLLQPNAMKKNRLNVKAFPAPIIFQAISSLFPENGTGEELRDKYIELTERVDPERPPECTPNIDGPRAESVSREQTLHSYHTLFCRRCFKYDCFLHRLQACHPGPNLQRRRWPELKPPGKPCGEACYLHLDGVKQLISFDNIGKSPVMLDSGNEACSEDSNDSSQCSKDATLTKSSKNGSNLFEIFDPKDTEWNGSDKSFFRTLQKTFLNNYCAIAEAMLTKTCQQVYRFVQQEAAACLPIEVNKDNTPPRKKKKKHRLWSVHCRKIQLRKEDSSNHVFNYSPCDHPGQCDANCPCYSAQNFCEKFCNCSSDCQNRFPGCRCKAQCNTKQCPCYLAVRECDPDLCQTCGAEHYEIGKITCKNVSVQRALHKHLLMAPSDVAGWGIFLKESAQKNEFISEYCGEIISQDEADRRGKVYDKYMCSFLFNLNNDFVVDATRKGNKIRFANHSINPNCYAKVMMVNGDHRIGIFAKRAIQPGEELFFDYRYGPTEQLKFVGIEREMEIL

SEQ ID NO: 22636 - protein, 109 aa, Anopheles gambiae str. PEST
SISSFIMTGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 22637 - protein, 383 aa, Anopheles gambiae str. PEST
MGCFGSAGSKQSDSNSSEDTKSQKRRSDAITRQLQKDKQVYRATHRLLLLGAGESGKSTIVKQMRILHVNGFSDSERKQKIEDIKKNIRDAILTITGAMSTLTPPIQLEKPENQARVDYIQDYASGPDFNYPPEFYEHTEELWKDRGVQQTYERSNEYQLIDCAKYFLDRVSEIKQPNYTPTEQDILRCRVLTSGIFETRFQVDKVNFHMFDVGGQRDERRKWIQCFNDVTAIIFVTACSSYNMVLREDPTQNRLRESLDLFKSIWNNRWLRTISVILFLNKQDLLAEKIKAGKSKLSDYFGEFNRYQTPADAVCEMGEDPEVIRAKYFIRDEFLRISTASGDGKHYCYPHFTCAVDTENIKRVFNDCRDIIQRMHLRQYELL

SEQ ID NO: 22638 - protein, 335 aa, Anopheles gambiae str. PEST
AVCILQALNAYHPKRKMTCNVVPNAIFKNGNSIPMFGLGTWNSPPGQVAQAVKDAIDVGYRHIDCAHVYQNEHEVGEGIAAKIAEGVVKREDLFVTSKLWNTFHRPDLVEGACKTTLQNLKLDYLDLYLIHWPVGYQEGTELFPMGPDGKTFLFSDADYVDTWPEMEKLVDAGLVRNIGVSNFNAKQVQRVLDVARIPPATNQIECHPYLHQSKITTFCAEKGIIVTAYSPLGSPARPWVKADDPVLMDDATVGQLAKKHGKSAAQILIRYQIQLGHVVIPKSVTKERIASNFDVFSFQLDEDDMKQLAGLERNGRICPESSAFGHPHHPFEKEE

SEQ ID NO: 22639 - protein, 300 aa, Anopheles gambiae str. PEST
SPPGQVAQAVKDAIDVGYRHIDCAHVYQNEHEVGEGIAAKIAEGVVKREDLFVTSKLWNTFHRPDLVEGACKTTLQNLKLDYLDLYLIHWPVGYQEDLDCITITVFPIGATVDSNGTTVLTDVDYVTTWKAMEQLLDTGLVRSLGVSNFNSEQLRRVLENGSVAPVTNQVECHVRLNQKKLIKFCKDRNVIVTAYSPLYRPGSTLGPEDGQSSKHPMEDARVVEIAERYKKTPAQVLLRYLVDIGTVPIPKSGNPDRIRQNLNIFDFALTPAEVVTLDALNTGERLVKFEMGLAHPFYPF

SEQ ID NO: 22640 - protein, 286 aa, Anopheles gambiae str. PEST
MDAKATLVTLNNGKKMPVLGLGTYNLRGQNCVDAVKTAIDAGYRHIDTASLYQNEAEVGQAIREKIADGTIKREDIFLTTKLWNTSHEPAQVREAFDASLSKLNVDYVDLYLMHSPIGATVDSNGTTVLTDVDYVTTWKAMEQLLDTGLVRSLGVSNFNSEQLRRVLENGSVAPVTNQVECHVRLNQKKLIKFCKDRNVIVTAYSPLYRPGSTLGPEDGQSSKHPMEDARVVEIAERYKKTPAQVLLRYLVDIGTVPIPKSGNPDRIRQNLNIFDFALTPAEVVTL

SEQ ID NO: 22641 - protein, 351 aa, Anopheles gambiae str. PEST
RPTPGTHSLPIHRSRRTFSHRYRFATMAPKVPSVRLNNGLEMPVLGLGTYLATEEEGIAAVKMAIDEGYRHIDTAYFYQNENQVGQAVRAKIAEGLIKREDVFIVTKVWNTYHAPEHVAEACQRSLDNLGLGYIDLFLIHWPMGWKFCGWTGDDLLPMNANGKSIDSDVDYLDTWKAMERLVKEGKVKSIGVSNFNSEQLTRLLANCEIKPVTNQVECNPGINQRKLIEFCRQHDIVITAYSPLGRPNMADPVVGTAGIPKHALDDPRVIAIGQKYGKSAGQVVLRYLVELGTLPIPKSSKLERIRQNIDIFDFSLTEEEIKLMDGFNTGGRTVPFHFSSEHKYFPFKLEY

SEQ ID NO: 22642 - protein, 534 aa, Anopheles gambiae str. PEST
AVEQEHYSSMSIFFVLCVIALGILLIHMMLQTGFQYLPESIVVVFLGALIGLILNVSSVKHIANWEREEVFSPTAFFLVLLPPIIFESGYNLHKGNFFQNIGSILVFAIIGTTISALVIGSGVYLLGLAEVAYRLNFVESFAFGSLISAVDPVATVAIFHALDVDPVLNMLVFGESILNDAISIVLTTTVMPMVSDSGSSTGESIFSALNTFCMMFFASAGIGVVFALMSALLLKHVDLRKHPSLEFGLMLVFTYAPYVLAEGIHLSGIMAILFCGIVMSHYTHFNLSTVTQITMQQTMRTLAFIAETCVFAYLGLAIFSFKHRCELSFVIWAIVLCLIGRACNIFPLAWLVNRFREHKITNRMAFIMWFSGLRGAISYALSLHMQFSTEESRHVVITTTLIIVLFTTLFFGGSTMPLMKYLQGGKKVKRTARAGRAGRKRKEKALSLSKTREWGQAIDSEHLSELTEEEEVSFTQSRIGGFTRWDRKFFTPFFTRRFTHQELHDCKSQMADLTNKWYQAIRISPDDPDEEDED

SEQ ID NO: 22643 - protein, 374 aa, Anopheles gambiae str. PEST
SKLSCARCCGDFFGYLLRLRVSPEELEQRYKSREIDKILEKDKHAFRRQVKLLLLGAGESGKSTFLKQMRIIHGINFEPELIKEYQHVIYQNIVKGMQVLCDARDKLDIPWEHPTSQLAANEAVMFHSGCLLDAEQFHQYVPLINILWTDGAIRKAYDRRREFQISDSVSYFLDELDRISRLDYKPTHRDILHCRKATKGVFEFTIRIQNIPFVFVDVGGQRTQRQKWTKCFDCSVTSILFLVSTSEFDQVLAEDRKTNRLEESRNIFDTIVNNTTFEGISIILFLNKTDLLQQKVKNPETDIRWYYPQFTGNPHSILDVQNFILQMFMNVRKNTKTPIYHHFTNAVDTQNIQVVFSSVKDTILHRNLSALMLQ

SEQ ID NO: 22644 - protein, 340 aa, Anopheles gambiae str. PEST
LAHFVATFPVAACCKIKTVKNSTKKKGNGGESERKHIQTHRAMEDFQKIEKIGEGTYGVVYKGRNKHTGEIVAMKKIRLETEDEGIPSTAIREISLLKELKHRNVVSLKDVLMEENRLYLIFEFLSMDLKKYMDSLPPEKMIDADLVKSYMYQITAAMLFCHRRRVLHRDLKPQNLLINKEGVIKVADFGLGRSFGIPVRNYTHEIVTLWYRAPEVLLGSLRYSCPVDIWSIGCIFAEMATRKPLFQGDSEIDQLFRMFRILRTPTDDIWPGVTSLPDYKSSFPCWTQNNLASQVSNLDSAGIDLLQKCLIYDPMLRISAKKILEHKYFDGFERCNIPTE

SEQ ID NO: 22645 - protein, 334 aa, Anopheles gambiae str. PEST
SAVDIKTGRRLAVKKLSQPFQDVTFAKRAYRELKLMRLVDHPNIIKLLYAYTPQQTLDTFRDVYIFTELMDSSLQHVFGTKLDHERISFLVYQMLCGIRYLHSAGIIHRDLKPSNIVVRKNCTLKILDFGLARSIDTSFTMTQYVVTRHYRAPEIILNMEYDTKVDLWSIGCIMAELITGAVLFPGTDHVDQWMRIVETLGTPRPEFIARTTPGTQRYISNQPVVAGRPFGELFPDEVFEGMASPNVPQLTNDAARDFLRRMLAFDPMERISVDEALAHPYVSVWYYEEDVMRPPPKPYDHALDARNLTVEQWKRLLFEEIQDIQRTMSLDEAG

SEQ ID NO: 22646 - protein, 531 aa, Anopheles gambiae str. PEST
SSSSSSSSSSSSSSASSSSSSSSSSSSNVATSSGSGAAPSEPAPGGTTTTPTVLISVSATTTGTSSARQSSLASDLLLNQMLNIAQHRVQQQQQQQQQQQPSSSSSPSPSSSAPSSSSAVSSSGTPAVSSQLPTGGPSTVAAGDPLPPTLITLSATPSPSSSSAAAAAAAPSHGTNAAAARPVQLPVRPLELVKQQQAPASRSVHGRPADPADDCGEPEAKRKKKGDKPNAKVEKLELRLGGILCCAVCLDLPRTAMYQCSMGHLMCAGCFTHLLADGRLRDQNATCPNCRTEISKNNSSRNLAVEKAVSELPAECQYCSKEFPNKSIDYHESTECEDRPTDCKYARIGCQWRGPIHEVTSHEGNCAHPRKSGADVMVALQAHDAKAAEDKKLFLTLIDLLSYEKIIFNDLQLKPYRTDEYVHRLYYETSRFSAFNHQWVVKAIINKSQRDPHESCERDITYQLILKSKTTSPLPMHFFVLRGPFSDIKVDTQIYKHDFADTETESPFKLLPLPDTAECNRLLAAKAINFR

SEQ ID NO: 22647 - protein, 129 aa, Anopheles gambiae str. PEST
KMVGKGKLPVESEDAQKLRFQVELEFVQCLANPNYLHFLAQRGYFKDAAFVNYLKYLLYWKEPEYAKYLKFPMCLYFLDLLQYEHFRREIVSAQCCKFIDDQAILLWQHYTRRRTRLTALGTTSLTGLA

SEQ ID NO: 22648 - protein, 1668 aa, Anopheles gambiae str. PEST
LQLITPTRSLVLCAESRREMEDWLQALKAASAREFFEPGPPDQHDFLSGHHHWYATSHARPTYCNVCREALSGVTSHGLSCEVCKCKVHKRCAAKAISNCKWTTLASVGKDIIEDSDGNIVMPHQWMEGNLPVSSKCLVCDKTCGSVMRLQDWRCLWCRSTVHTACRPQSPNSCPLGPARVSMVPPTSLHSIGLDEAWDVCKPHGSFSPLLVFVNSKSGDNQGVKFLRRFKQLLNPAQVFDLISSGPGLGLRLFRHFDPFRILICSGDGSVGWVLSEIDHLNMQKQCQIAVLPLGTGNDLARVLGWGSSCDDDAHLPQLLERYEKASTKMLDRWSVMVFERDIGIASTRTPKMSISHYPDPLLSQYEDSALWHLQSIVYNEDTQMMIQSTRILCETVNDFIARVRETSSEEEQLSVKCDILRKTIEKNEKDKLNSKERISRIDRRSEKEALLCRANSLKRAIHEVVEMSEKIIPYAPQKRLSVPMNTLRATASSSDNSVNTSPATLPPPPTGMMSPSVSTSRLTCISPLPDMRRDSMDEHFFSTLNLPVPKQFADGGSRRSSGVPESYRISSIEELEENSVHTEPKLADRILEPPIEGESEMTTDNQGKDQDDTLNQKSTTTTTSDSQSTTAPYDFSFESDTKTVKFDLDPNSGGGGYLQFQPIEVYERNYYRTHAQRLGVGGAGKAGLAGGSGEATSAKAGASCNMLQVPTICIPSLEKPPENIYFSENITIIDTDMPERSSSDEVPGDGSDILSAISNEECSVTSEILDRQSDNNSQVHVGDIIQDLDNDRFSHIDSPETSDTTEALHGESLMDDISSVLGQDLLGALQDNTITEDTTTLCTLEHTKRRSFKGKRTVAAASEPVELDQCGFENRVFDIDNRCDDQKVKEPRFCSLAKFVEGNDIARKSFKRPHRGGAVRNLGPQRYANRLSVGENEYENIKSFARNLLPVHGSPSDVSVSETDTVRSSGFEYRKLVSAANAEDEDESLPDDELGERSLLGRDDEHEKDDRSEKSFQLPCIPTINVVVEPPSPAISDELRSLRVPDIRRHSEHTPNLLAPREIDINRRHSNNNPNLLGFDSEHIRFLNCSPAASRRISSGSLLFKPEGLGSSKSNIFSSNLGLFGTDKDAEERKKEEKEERVKKLPIINPLVRLPSWPNVSTGTGFISKCLLANADTLCAAVSPLMDPDETLLEGYYEKAVMNNYFGIGIDAKISLDFHNKREEHPEKCRSRAKNYMWYGVLGSKQWLQKTYKNLEQKVQLECDGQRIPLPSLQGIVVLNIPSFMGGTNFWGSKKEDDCFLAQSFDDRILEVVAVFGSVQMAASRLINLQHHRIAQCQSVQINILGEECVPIQVDGEAWLQPPGMIRIIHKNRVQMLCRNRSLEVSLKSWQEKQRQHSISIAREQPSTASEHHVAPSEDMFSERETYLLLNFIECVSTLVKWVKFLIISHPSLQPNLYVVASKTADALESIHPGGKIIEGPNLRRQLTQLVRCARQLYEDTCELLRERSHSLILREDLETKLSVSLANMEMELGKCSLQQSSDTGETKVYLNVLAPNEEIDHRKKQKPFWLRFRSGHSSHHSPALSGAGPKAAGTTSRETVSNWGVGEVVTWLEAMQLAEYVDSFIKNDIRGKELLTLARRDLKDLGVTKVGHVKRILQAIKDLGAG

SEQ ID NO: 22649 - protein, 286 aa, Anopheles gambiae str. PEST
MDAKATLVTLNNGKKMPVLGLGTYNLRGQNCVDAVKTAIDAGYRHIDTASLYQNEAEVGQAIREKIADGTIKREDIFLTTKLWNTSHEPAQVREAFDASLSKLNVDYVDLYLMHSPIGATVDSNGTTVLTDVDYVTTWKAMEQLLDTGLVRSLGVSNFNSEQLRRVLENGSVAPVTNQVECHVRLNQKKLIKFCKDRNVIVTAYSPLYRPGSTLGPEDGQSSKHPMEDARVIEIAERYKKTPAQVLLRYLVDIGTVPIPKSGNPDRIRQNLNIFDFALTPAEVVTL

SEQ ID NO: 22650 - protein, 292 aa, Anopheles gambiae str. PEST
SPPGEVAQAVKDAIDIGYRHIDCAHVYQNEHEVGEGVKAKIDEGVVKREDLFITSKLWNTFHRPDLVEGACRTTLKNLGLDYIDLYLIHWPMAYREGPELFPQDENGKTAFSDVDYVDTYKALEKLVELGLTKSIGISNCNSKQVERVLAAATIKPVTNQIECHPYLTQSKLSPFCTERGMIVTAYSPLGSPNRPWAKPGDAQLMEDPKIVALAEKYNKTPAQILIRYQIQRGHVVIPKSVTKSRIASNFEVFDFELTKDDVAQIDTFDCNGRLVPITSAAGHPYHPFENEE

SEQ ID NO: 22651 - protein, 248 aa, Anopheles gambiae str. PEST
MSTVDKEELVQKAKLAEQSERYDDMAQAMKSVTETGVELSNEERNLLSVAYKNVVGARRSSWRVISSIEQKTESSARKQQLAREYRERVEKELREICYEVLGLLDKFLIPKASNPESKVFYLKMKGDYYRYLAEVATGETRHTVVDDSQAAYQDAFEISKGKMQPTHPIRLGLALNFSVFYYEILNSPDKACQLAKQAFDDAIAELDTLNEDSYKDSTLIMQLLRDNLTLWTSDTQGDGDEPQEGGDN

SEQ ID NO: 22652 - protein, 392 aa, Anopheles gambiae str. PEST
DVGEPLFLTPFITNHSIEAGRQAARVTHSAIPADVESYSGYLTVDEATNSNLFFWYFAAKLDREAPVVLWLQGGPGASSLYGLFTENGPFSVRSDLKLQPRKYSWHLNHHLIYIDNPVGTGFSFTDKEEGYSTNETQVGANLHNALQQFFALFPDLQQHPFFVTGESYGGKYVPAVAHTIHRHNADAKVKLNMQGIAIGNGLKKDFECAFDVFDELINGDQYPSGSLFKNASGFTTYFNYLQTSPDPSDEYMGKFLQLAETRRAIHVGNNSFHDLEGENKVEDHLKLDVMQSVMPYLNELLHSYRVIIYNGQLDIIVAYPLTMNYVTKLNFPGMEDYKKAPRHIWRVDGEIAGYAKEAGNLVEVLVRNAGHMVPKDRPKWALDLLMRLTHGK

SEQ ID NO: 22653 - protein, 282 aa, Anopheles gambiae str. PEST
MFRSIAGSATLTQTIRKTMERNLCSGSAIAAKRLTGKVAVVTASTEGIGYAIAERLGQEGAKVVVSSRKQQNVDRAVNDLRTAGLEVSGIKCHVANATDRKALFEHAAQKFGGIDILVSNAAVNPEVGGVLECSESAWDKIFDVNVKCSYLLAKEVLPFIRERKGGSIVFISSIAGFQPFSLLGAYSVSKTALFGLTKAASQELAAENIRVNCIAPGVVQTKFAGALQESDAAKEETLSRIPMGRIAQPKEISGVCAFLVSDDASYITGETIVASGGMASRL

SEQ ID NO: 22654 - protein, 502 aa, Anopheles gambiae str. PEST
LFFAVSNEVPEHPCISPKSGAIFERRLIEKYIVENECDPINGQPLTAEELIDVKTPPIVRPKPPSATSIPATLKTMQDEWDALMLHSFTQRQQLQTARQELSHALYQHDAACRVIARLNKEVAAAREALATLKPQTGMSAIQAAPQPSIASEAGGVAAQPIEQAGMSAEVIQKLQDKATVLTQERKKKGRTVPEELVSQEKLRGFLTLASHPGLHSASVPGILALDINHSDQSKILTGGNDKNATVFNKDTEQIVAVLKGHTKKVTKVIFHPEEDTVITGSPDCNIRVWHVPTSQTQLLLRCHDGPVTGLSLHPTGDYVLSTSSDKHWAFSDIRSGRLLTKVADTAEYGLTSAQFHPDGLIFGTGTEDSQVKIWDLKEQSNVANFAGHTGPITAISFSENGYYLATAADDACVKLWDLRKLKNFKTIQLDDGYEVKDLCFDQSGTYLSIAGTDIRVYLCKQWQELKVFNDHTALATGVRFGKHAQYIASTSMDRTLKLYGIE

SEQ ID NO: 22655 - protein, 613 aa, Anopheles gambiae str. PEST
EHFQRNLWCLFRFCFPFVTMVKRNHKFKSGEGAMYYTRKAAMNKLQLNIKDFRQLCILKGIYPREPKHRARAQHGSREMKILYHKKDITFLLHEPIVWTLRDRKIFNRRIKHAAAKQNMNLRDIRLHNYPQLKLDHIVKERYPTFIDAIKELDDCMTLLFMFSTFPATKIITRELTRMSRRLTVEFMHYVIAAQALRKVFISIKGYYFQAEIKGETVTWIVPHYFPYSPHRGEMVDLSIMKSFGDFFTVMAGFINYRLYHSINLVYPPQFAHSLDSDETMGNEQKFVSERIAALNVELLRSDGGNGDTEEPELLEWTGNDEELPHVSQIRQEAQNVNKLKTLFKGLKFFLNREVPREPLVFIIRCFGGKVSWDKTMFVGATFDESDETITHQIVDRPSMEKQHISRDYIQPQWVFDSVNQRRLLPTNKYFMGAVLPPHLSPFTSANARYVPPEELAARKAAEGEEEEETFEPAEVNADHEHISDDEEVQDPENEQEMQDYALMKAFNDERTDSLNSGKKEGADDATDNGMAVRRGTVYRENEAEKKIVDKQEEALRARMVKSRHRKLYSKLVEREKKADKNARLLANKRERIEKQKRAEQMEKQKQQRKQILA

SEQ ID NO: 22656 - protein, 337 aa, Anopheles gambiae str. PEST
LFILLICALRTVKALDRVLRRVFLTVASVTRPDPSKMTKKADPYGFAKDFLAGGISAAVSKTAVAPIERVKLLLQVQAASKQIAVDQQYKGIVDCFVRIPKEQGIGAFWRGNLANVIRYFPTQALNFAFKDVYKQVFLGGVDKNTQFWRYFLGNLGSGGAAGATSLCFVYPLDFARTRLGADVGRGAGEREFNGLLDCLKKTVKSDGIIGLYRGFNVSVQGIIIYRAAYFGCFDTAKGMLPDPKNTSIFVSWAIAQVVTTASGIISYPFDTVRRRMMMQSGRAKSEVMYKNTLDCWVKIAKQEGSGAFFKGAFSNVLRGTGGALVLVFYDEVKALLG

SEQ ID NO: 22657 - protein, 463 aa, Anopheles gambiae str. PEST
HAWKSVKLLARSCVCSVCDTSMSSNGHFCESCGVCSDNGCVRKADEKFPCKQLRIRTRADDGSTCRHLWVKGNLPLGSECCVCREDIDQTSELGLFGQRCAWCQRMAHDKCFSEVSSTLCDFGPFKEMIFPPKCILASRSKVAQKVHLTGIIPPEWKANWRPLIVVANSKSGSSGADQVVALMRGILHPLQVFELVGWVLNTILQMKVEPHPEVAILPLGTGNDLSRVLGWGAEGPDEFDPIDYLTRIAQAETVQLDRWLAEINTHSSLARFHVPGFSQSRHFYMYNYLSVGVDALVTLNFHKARESSFYLYSSRFVNKLLYLCFGTQQVVQQDCVELEKHLDLYLDGVRIDLPSLQSVVVLNIDSWGAGVKLWEMSKNSPTHSIMKEIHSISDGILEVFGVVSSFHIAQLQVGLSKPVRLGQAKSVRIVLKRTLPMQADGEPWMQSPCDINIQHYGQATMLK

SEQ ID NO: 22658 - protein, 826 aa, Anopheles gambiae str. PEST
SNIHKWEKLSPSEFQQLQDLASYSTKKLQNVLQEFCSPATPSASRFHPDGDIDYDGFRKFLDSFLDCETPDDLSQHLFISFLQPALYQAQQQQHSHGKALSQMAAISSNAACAPVTSHNRDVRLIPRKQSFLDPLLLKVPLKDVVCYLSLLEAGRPEDKLEFMFRLYDTDGNGVLDTTETDAIVNQMMSVAEYLGWDVSELRPILQDMMTEIDYDGDGCVSLEEWQRGGLTTIPLLVLLGVDNTLKEDGYHVWRLKHFSKPAYCNMCLNMLVGLGKKGLCCVLCKYTVHERCVQRAPASCIATYVKSKKSKATATFQHHWVEGNCYGRCSKCRKRIKAYNGITGLTCRWCRMMLHNKCATLVKAECTLGEFANLVLPPTAICPAVLDRQKSINFTTNKGKDNRSVFIHFSSHCPLSPIVGIVPFFQSVPSTIHFQITSDPSWCPLLVFINPKSGGRQGDRILRKFQYLLNPRQVYDLSKGGPLEGLTMFKDVPNFKVICCGGDGTVGWVLEAMDSIVLQTQPSIGVIPLGTGNDLARCLRWGGGYEGESIPKILDKINRASVVMLDRWSIEVKNNPLAAEETPTATTMPGHKVGSEFTVPYNIVNNYFSVGVDAAICVKFHLEREKNPHKFNSRMKNKLWYFEYATSETFAASCKNLHEYLEIVCDGVSLELANGPQLQGIALLNIPYTHGGSNLWGEHLSQKRMRKGPFRKKLKNSDKELSANSFNSVDLSIAIQDIGDSKIEVIGLENCLHMGQVRTGLRASGRRLAQCSEVIMTTKKTFPMQIDGEPWMQGPCTIKLTHKNQVPMLMAPRSEKGSGFFSFLKR

SEQ ID NO: 22659 - protein, 408 aa, Anopheles gambiae str. PEST
MPLFGKKDSGKKIRKDVKDGCDKLPNIDDKYVIKELLGTGAFSEVRLCEHRETAQQYAVKIIDKKALKGKEDSLENEIRVLKRFSARRSDGSGVQTAAPPIGGPRFAHPNIVQLLETFEDKSKVYLIMELVTGGELFDRIVEKGSYTERDASNLIRQVLEAVDYMHEQGVVHRDLKPENLLYYSAAEDSKIMISDFGLSKMEDSGFMATACGTPGYVAPEVLAQKPYGKAVDVWSIGVISYILLCGYPPFYDENDANLFAQILKGEFEFDSPYWDEISDSAKDFIRNLMCVNVERRFTCKQALAHPWISGNAASSKNIHGTVSEQLKKNFAKSRWKQAYHAATVIRQMQRMALSSGGSGTAYGRSSSRISNVAADGTSSAAGGGGGAGNETSGDGQADTATTAASGSK

SEQ ID NO: 22660 - protein, 392 aa, Anopheles gambiae str. PEST
NHTHQDLTDIGYNHILDAARIGKSDRTRVDTINRARRLRKIGDRLPPPYPNGWFSVLESENLTRGEAKSVDCLGQNLVVFRTEAGEVNVLDAYCPHLGANLGVGGIVRGDCIECPFHHWSFSGQDGQCTNIPYSKSGTVPKVARLRKWRSLEVNGFIFVWHHVDPEVEPWTINVVQEIEDGRWVYYGKNEFLVNCHIQDVPENGADVAHLSAVHGPNMISGSDIRYSRPAWADFGMHSWFASWKAPEEGEPMHIAKMDLVHSFRIFNKFEMGKIDVRAYQIGPGYVQLMMNTSMGPFVVLQTVTPIEPLVQKVIHRFYAPRSMWNAIFQKFAILAESIMFERDMMVWNHKQFIDNPLLIKEDRLIKSYRKWYSQFYSENSMSFTMAKEKLDW

SEQ ID NO: 22661 - protein, 224 aa, Anopheles gambiae str. PEST
IKTHTDRSSENKKMALLLRVTVACGAVLALVTVRGQAANPTTEAFERNEIVPDLIDVAPEQTIKITYPQSDVEVSLGNQLTPTQVKARPKLCWEVEPSALYTLLMADPDAPSRSNPEMRSWKHWLVGNIPGADVDAGDVLADYVGSGPPQGTGLHRYVFLVYKQPSRIVFNETVLSSRNPNRGKWNPAEFVKDYELGVPVAGNFYQAQYDDYVPELYATFTDTA

SEQ ID NO: 22662 - protein, 241 aa, Anopheles gambiae str. PEST
CEISVMAPARLPSARRRTATLALVSLWLCLVLDDISSASGDATTAATSNNMTTEVQQVFAQHEVIPDVIDAAPKEFAKITYPSGVTVSGGNELRPTQVKDQPRVEWTAKPDAYYTLFMVDPDAPNRQEPKFREIGHWLVGNIPGTQVEDGDHMYAFVGSGPPNGSGLHRYVFLVYEQPGGKIDFSKAPRVSNRSRNHRVKYRHREFVKQYGLGELVAGNFYQAQYDDYVPTLHAQLSSGTE

SEQ ID NO: 22663 - protein, 660 aa, Anopheles gambiae str. PEST
NSIEVRTNSTVRSPTPLILPFTPYPVTRKADSNMPTYHKPEAKTIQELKDIAHKLRIDSINATQASKSGHPTSCASIAEIMSVLFFNTMRYKLSAPRDPSSDRFILSKGHAAPILYAAWAEAGLFPVEDLMNLRKIDSDLEGHPTPRLNFIDVGTGSLGQGVAVACGMAYVGKNLDKADYRTYVLVGDGESAEGSIWESLHFAGYYKLNNLCVIFDVNRLGQSEATSLQHQMEVYRKRLDAFGFNAIVVDGHDVEELCKAFFEAASTTDRPTAIIAKTYKGKHFPNIEDLENWHGKPLGDAAADVVAHLQKQIRNPGPIALAPPSPQKESAPKVSIKGVELATPPAYQKGEQVATRLAYGTALAKIAMNNDRVIALDGDTKNSTYSDKLRKAFPERFIECFIAEQNLVGVAIGAACRDRTVAFVSTFATFFTRAFDQIRMGAISQTNVNFVGSHCGVSIGEDGPSQMGLEDIAMFRAIPGSTVFYPADAVSTERAVEMAANTPGVCFIRTSRPNTAVIYENNEKFEIGKCKVVKQNANDSVLLIGAGITLYEALKAAEELEKSGIHCRVIDPFTVKPLDQEGIIKHGAQCGGRVVVVEDHYKQGGLGEAVLSALAEQRNFVVKHLGVDKLPRSGPPTVLVDMFGISARSVAAAVQEIIKM

SEQ ID NO: 22664 - protein, 1642 aa, Anopheles gambiae str. PEST
MENVLFESLYSLIMYYRQNALRSAEFYITLKEPVPQPNKHETKEWYHQTTTREQSEIVLNQIPQDGAFLVRPSEKGPKAFVISFRAHGKFKHCRIRVEGRLYEMGGMEFESLVDLVNFYSKHPLYRKVTLTYPIPREMIRRINTMDVPEESGGYGYMDPATVTNENVTVKALYDYKAQRDDELSFCKHAIITNVVKRGNDWWLGDYGGKRQHYFPANYVQELSAMDDGTLVEEGANEPLMLGSLQKGSLDVHGAVVEMAYSNHPDIERILRIQNPTMQNVFEVGVQTKELAYEWMCAIKEAAQNASAMENERRKMERNSRVAKEMSDLIIYCRSVPFKHHPAAWVFYEMSSFPETKAEKYFLQAETRALFVRYHRNHLSRVYPKGQRLDSSNYHPTALWNCGSQMIALNFQTPDKPMQLNQAKFRDNGGCGYLLKPEFMFRDEFDPTDPNTLVGVGEVIVNVRIIGGRNLCKIIWSSVQTNGRSNYEGSLELREVKEVRPGKKSKDFEKWPEEAKKSEPRKCFVILHGNDFKLRTVSIVAFSEKEADMWLKGLKYLISDTVSAPYWLQIERWLRREFYLMEANGTASLKDVRSFLPKINCKISTAKLNEVFHEVDTRRRNELGFDDFTRLYQRLILPPASLPEYFDGLRMATYSQNGETVTLQEFRRFLTKEQQEDEGSPGGGHSEETVAKFINDYIQDPARDVSEPYLRLHEFIDFLFSRQNEIWDKRCDTVYQDMSRPLAHYWISSSHNTYLTGDQFSSESSVEAYARALRMGCRCIELDCWDGPDNMPLIFHGHTFTTRIKFMDVIRTIKEHAFITSEYPLILSIEQNCSLTQQRRMAQAMLEVFGEMLLTQPIDKAEAQLPSPQQLKRKIILKHKKLPENGMLVVDEAGKESAVLMRGNDESELDIRNTVKNGILYLEDPVDKGWNAHFFVLTQHKLFYTDSQRPDRDADGRDDEREENGFATNRQSRDGAVLSNDELHFGENWFHGKLSGGREEAEKLLQQFSHLGDGTFLVRESVTFVGDYCLSFWRQGKPNHCRIKLKQDKGVTKYYLMENVLFESLYSLIMYYRQNALRSAEFYITLKEPVPQPNKHETKEWYHQTTTREQSEIVLNQIPQDGAFLVRPSEKGTKAFVISFRAHGKFKHCRIRVEGRLYEMGGMEFESLVDLVNFYSKHPLYRKVTLTYPIPREMIRRINTMDVPEESGGYGYMDPATVTNENVTVKALYDYKAQRDDELSFCKHAIITNVVKRGNDWWLGDYGGKRQHYFPANYVQELSAMDDGTLVEEGANEPLMLGSLQKGSLDVHGAVVEMAYSNHPDIERILRIQNPTMQNVFEVGVQTKELAYEWMCAIKEAAQNASAMENERRKMERNSRVAKEMSDLIIYCRSVPFKHHPAAWVFYEMSSFPETKAEKYFLQAETRALFVRYHRNHLSRVYPKGQRLDSSNYHPTALWNCGSQMIALNFQTPDKPMQLNQAKFRDNGGCGYLLKPEFMFRDEFDPTDPNTLVGVGEVIVNVRIIGGRNLCKVSRNITSPLVEVEVLGASFDGGIKHRTRAIADNGLNPIWNEICEFRIANPHFAMIRFEVQDEDMFGEPNFIGQAVFPLGSIRTGYRSVVLRNKYSEELELATLLVHTSIRPLQTE

SEQ ID NO: 22665 - protein, 559 aa, Anopheles gambiae str. PEST
HHSATRCIEFPHHHVFLRNPKEACVRACVFGVWPTGNAWLIPAGLRTMENGTSNNLQDGLSCEELFRKSDGLTYNDFIILPGYIDFTAEEVDLSSPLTKKIMLKAPLVSSPMDTVTEAEMAISMALCGGIGIIHHNCTPEYQANEVHKVKKYKHGFIRDPLVMGPENTVADVLEAKRKNGFTGYPITENGKIGTRLVGIVTSRDIDFREHDVDIKLKDIMTKLEDLITAPNGVTLQEANNIMEKSKKGKLPIVNKTGELVALIARTDLKKGRTYPNALKDSNKQLLVGAAIGTRDEDKERLELLYQNGVDVIVLDSSQGNSLYQINMIKYIKEKYPSLQVIAGNVVTRQQAYNLITAGCDALRVGMGSGSICITQEVMACGCPQATAVYQVCNLARQYGVPVIADGGIQSIGHIVKALSLGASAVMMGSLLAGTSEAPGEYYFSDGVRLKKYRGMGSLEAMERKDGKGSASSRYYHTEIEKMRVAQGVSGSIVDKGSILRFVPYLLCGLQHSCQDIGARSIANLRKMIYNGELRFMKRTHSAQLEGNVHGLFSYEKRLF

SEQ ID NO: 22666 - protein, 122 aa, Anopheles gambiae str. PEST
TTQNAAAVRFMGSLVSRSVPANMSGPVAEFVKSAIAKDKVVIFSKTYCPYCTMAKEPFKKLNQEYACYELDKRNDGDEIQSVLGELTGARTVPRVFIGGNFVGGGTDIKKMYDDGRLQKMLA

SEQ ID NO: 22667 - protein, 214 aa, Anopheles gambiae str. PEST
HGADEGNIGADKKEGGEGAAAAAKMHTFSETGSVPAFLAKLWRLVEDSETNDLISWSTDGRSFIIQNQAQFAKELLPLNYKHNNMASFIRQLNMYGFHKITSIDNGGLRFDKDEMEFTHPCFQKDHPYLLEHIKRKIATSKQQQLQAQQQAEDKSALKLEAVSRVLSEVKNMRGRQDTLDSRFQTMKQENEALWREIAILRQKHHKQQQIVNKV

SEQ ID NO: 22668 - protein, 244 aa, Anopheles gambiae str. PEST
QAVKDAIDVGYRHIDCAHVYENEHEVGAGIAAKVAQGNVKREDLFITSKLWNTYHRPDLVKGALQATLRNLNLKYLDLYLIHWPVAYREDYIETWPAMERLVEAGLVRNIGLSNFNVQQVQRVLDVARIPPATNQIECHPYLHQASLTEFCKRHDVTITAYSPLGSPARPWVKQDDPVLLEDAVVQRLAQKHSKTPAQILIRYQHQLGHVVIPKSVSRQRIASNADVFGFELDAADLQQLAGLE

SEQ ID NO: 22669 - protein, 244 aa, Anopheles gambiae str. PEST
QAVKDAIDVGYRHIDCAHVYDNEHEVGAGIAAKVAQGNVKREDLFITSKLWNTYHRPDLVMGALQATLRNLNLKYLDLYLIHWPVAYREDYIETWPAMERLVEAGLVRNIGLSNFNVQQVQRVLDVARIPPATNQIECHPYLHQASLTEFCKRHDVTITAYSPLGSPARPWVKQDDPVLLEDAVVQRLAQKHSKTPAQILIRYQNQLGHVVIPKSVSRQRIASNADVFGFELDAADLQQLAGLE

SEQ ID NO: 22670 - protein, 265 aa, Anopheles gambiae str. PEST
DTIFAKMLDKVKHIILVLSGKGGVGKSTVSTQLALTLAEADHKVGLLDIDLCGPSVPYLLGLEDRDVHQCDEGWVPVYTSAEKRLAVMSIGFLLKNRSDAVIWRGPKKTAMIKQFLEDVNWDELDYLIIDTPPGTSDEHITVMECLKTVRTEGAIIVTTPQEMALEDVRKEVTFCKKTGIPILGIVENMSGFVCPNCSECTNIFSSGGGHSLAELAKVPHLGTLPIDPRVGELAGTGKACVKELPDCTTSEVLRELVRTLTTVGQ

SEQ ID NO: 22671 - protein, 521 aa, Anopheles gambiae str. PEST
MYGTYQQQERLTEDDILQGMLESRQRFAKLDNSRGYQHSFRKKSKWELVRLSLLIVGIECTYATETALVAPILLGIGLPHTVMTMIWATPSLAGLLFAPVIASVSDRLRSRWGRRRPVLLALGCTILTGMLVLPNGPAIGELVGLTSVGWVATITTVGLIMSDFSAETSNGLCRTYAMEVCTIRDQARVLSIMVLTGGIGATMGALFGAINWNRLGIGRLLGGNGPSVFAANWIVLFLGLLVTLTSFSEIPLPVQESEPMLRPVTQKMLLDEVKRAQGEGRVQEEKEEVQEVVGFKQFVHNVLHMPRSMKVLCLTQLLSHMSYLTYCLYYTDFVGATVYEGDVRALKGSAAAELYDDGVRFACLGMALCSTTSSIYSVFIEGLIVRFGARPVYVGGLLAHCCGMLAMGLMPHKLVVFGCCALTGVMYATIYSIPFLLISHYHSKNCFTEVDGQYVESIEPRGFGVDVSMMSSMLCLAQLIVSLAIGAVIDAVGSTIIITFISSAFMLCAAGSAMAILYMEL

SEQ ID NO: 22672 - protein, 504 aa, Anopheles gambiae str. PEST
KKSRLELIRLSSVIVGIEFLYAAETAFVTPILLGIGLSHTFMTMVWAFSPVLGFFFAPMIASFSDTIRVQWGRRRPVLLALGLAMMTGMWILPHGKTIGVFFGDPDVPVDQMEGFRWSIPVTIIGLVLTDFDAETSNGIARAYFMDMCAPDDQSRVLTTAMFIGGLGGTAGYVLGAIDWSQTNLDILGSNEATVFMFVFIVMGVGLLITLTSYREVPLPLLERDPLLRPINSNAFEAEKSRQLAVYSISKDVIPQPIKPDQDAAIGIGDDDDEKPLRLRDFVRNIVHMPKSLFILYSTQFFSQLGYLSYCLYFTDFVGSEVFGGDVAGAPGSPELALYEEGVRYGCWGMAVFAVCSAFYSAVIERLVKRFSARPVYMAGLLLFSLGMLLMGLVKEKFMIFIACPTVGIMYATMYSLPYLLISQYHSKNSFEVKDGKCVPNTTKRGFGADVSMMSCMLFLAQLIISLAIGSIIDAVETNVVVIFSASIFSLVAALTASQIVYMGL

SEQ ID NO: 22673 - protein, 679 aa, Anopheles gambiae str. PEST
MYREIKSIYNWLASAAISGTQTLTDSRRPIIRALQCSRRQRSFSSSSSSRGGTADLTMVKTGPGGGPSAASGRVVLARRKSLAQKDPLVEELRKAREENARQQQYDYSHVFRYEGHWVGGGRIMQISEMIREPCKKKTLLDFVRLSFVIMGIEIVYSAETAFVTPILLGIGIEHQLMTIVWGISPLIGFIVSPFLGTFSDRCRSRFGRRRPLLVVLGIGLVLGCLLLPFGETIGHWLGDTGESEKPVINNTVTIGGNRNPYGSATASTAHYKWAIVVTILGTILLDFCADSSQAPSMAYLLDVSLPDDHGQACSTYSLLSGVGGCIGYLIGAIDWNGTMLGELLGGNINTVFILVTVIFVLCLAVTVGSFREIPLPLMERDELLQPLTERAVTEQRQRTTVEKGLRPMKDIADALLLELEGDDSEPSDRTALLSYSEKEPLMGDFLQEKPKSSAKEFLRITFRIPATLAVLCVTNLFCWMSHISYSLYFTDFVGEKVFGGDPMAHSDSDEYALYIEGVRYGCFGMAIYSIACSTYSCTIERLIRVFRARNVYSGGLLIDFVGMLLMAMFPSKVTVYVFSVTGGIVGALLFTMPYIILAKYHAKGLLDTCDETNSIQPRRGLASDISIIGSMLFVAQIILSLTMGPLVTLTGTTASVIYTASVCSLVASLCATQIQYLDL

SEQ ID NO: 22674 - protein, 605 aa, Anopheles gambiae str. PEST
MVAGAGGSNFHSEFRNDPVVKEMRQIREENARRQKHDYSHVFRISAVIMGMEFVYSAETAFVSPILLSIGIEHQLMTMVWGISPLIGFFLSPVIGSVSDRCRSRFGRRRPVLFALGVGLITGCILVPYGRNIGAWFGDLGEYVDDPANTINGAAALIDINGTVVSDALRSYNFYRIEEQIAEHRTDYRWAIVITIIGTILTDFNADNCMTPSRAFLLDVSLPEDHGRACSTFSILAGLGGSIGYAMGGINWDETSFGEFLGGSIKTVFTLVVIIFTICLTISLTSFREIPLPLLESDDLLRPLTEAAIKKEKARRQNQIFVVKDVSKALTAQLQSIQSPQDAVPQKINNALVDVERAPRGKDEVELVEEEDENVQMGPMDFIKSIVMMPKSIAVLCLTNLFCWMSHLSYALYFTDFVGEEVFKGNPAAPSNSDEYKLFLEGVRYACFGMAIYSISCSTCSFTIEKLIKVLRARTVYCGGLILDAIGMACMAFFPNKVTVYVLSATGGIVYALLFTMPFLLLGQYHAKGTFKVAKPGAEVTQERKRGLATDIAVVGGMIFVAQIIVALGMGSLISAFGTTSVVVFSASICSLIASICASQVVYMDL

SEQ ID NO: 22675 - protein, 479 aa, Anopheles gambiae str. PEST
STKTRWELVRLSLLIVGIECTYATETAFVAPILLAIGLPHTLMTMMWAMPPIVGVLFVPVVASVSDRLRSSWGRRRPVLLLLGIAMLLGMMLLPHGRAIGEAIGLRSVAWVATITTLGLTTTDFSAEASNGLCRTYAMEVCTIRDQARVLSTMMLIGGLGGMLGYLFGAIDWIALPIGQYFESNEAAVFTANWIVLLIGLVSTLTSFAEIPLPVQEQDAMLRPVTHSMLQNEVKRMRGDEYATQTQLSESIGFRQFVRNTVQMPRSMKILCLTQFLSHMGYLPYCLYFTDFVGAEVFGGDVQAPEHSPAFVLYEEGLRFACWGMALFAGCASLYSLVIERLIDRVGARPVYVGGLMAHCVGMVAMGLLRHRAIVMLCCSLTGIMYTTIYSIPFLLISHYHSKNSFHMKDGKCVESTEPRGFGADVSMMSSVLCLAQLIVSLVMGVLIDAAGTTTVITYVAGGCTLLAALSAMAVLYMGL

SEQ ID NO: 22676 - protein, 493 aa, Anopheles gambiae str. PEST
ISEDDGCVSRWPIVYRSTVGTGPLIKCIRCQSHCEVVWSSSSSSNMSESKCKCGPGYATPLDAVRNGPVEKLLYVVCVQPNLDEEHGDYLATVDVDPASPTYCQVIHRTYTNSKHNELHHSGWNTCSSCHFVPGGKEVPTRDRLVLPCLNSDRIFVIDTGTDPRAPKLAKVIEGDVLKGADCTAPHTTHCLPNGNIMISIMGDAEGNAKGDFVEFDKNFELVGTWSRGDRKALCGYDYWYQPHFNVMVASEWGAPKLFRRGYHPTDCDDRTQYGCRLNFYRWQERELFQTIDLGDDGLTPLEIRFLHNPRENQGYGENGEIEMMGGMMTDILISLDDRYLYFSNWRHGDVRQYDISDRANPRLTGQVFLGGAIQRDAPRRVLNDPELKEAPEPVFLKGRRLLGGPQMLQLSLDGRRLYVSSSLFSPWDKQFYPEMVAAGGTIVQLDIDVENGGMKLNENFLVDFGGEPYGPGLPHEMRYPGGDCTSDIWLVNE

SEQ ID NO: 22677 - protein, 364 aa, Anopheles gambiae str. PEST
SSRHAFYTVEVGDTKFTILKRYQNLKPIGSGAQGIVCAAYDTVTQQNVAIKKLSRPFQNVTHAKRAYREFKLMKLVNHKNIIGLLNAFTPQRTLEEFQDVYLVMELMDANLCQVIQMDLDHERMSYLLYQMLCGIKHLHSAGIIHRDLKPSNIVVKSDCTLKILDFGLARTAGTTFMMTPYVVTRYYRAPEVILGMGYKENVDIWSVGCIMGEMIRGGVLFPGTDHIDQWNKIIEQLGTPSQNFMTRLQPTVRNYVENRPRYSGYAFDRLFPDVLFPTDSNEHNRLKASQARDLLSRMLVVDPEHRISVDQALVHSYINVWFDESEVNAPAPGPYDHSVDEREHTVEQWKELIYQEVMEYEARN

SEQ ID NO: 22678 - protein, 376 aa, Anopheles gambiae str. PEST
MSRRTTNYVRYQFSDTEFEVPERYTKLEAKGFGAQGTVCAAYDTVTQQNVAIKKLSRPFQNVTHAKRAYREFKLMKLVNHKNIIGLLNAFTPQRTLEEFQDVYLVMELMDANLCQVIQMDLDHERMSYLLYQMLCGIKHLHSAGIIHRDLKPSNIVVKSDCTLKILDFGLARTAGTTFMMTPYVVTRYYRAPEVILGMGYKENVDIWSVGCIMGEMIRGGVLFPGTDHIDQWNKIIEQLGTPSQNFMTRLQPTVRNYVENRPRYSGYAFDRLFPDVLFPTDSNEHNRLKASQARDLLSRMLVVDPEHRISVDQALVHSYINVWFDESEVNAPAPGPYDHSVDEREHTVEQWKELIYQEVMEYEARNNLADGEGAPR

SEQ ID NO: 22679 - protein, 487 aa, Anopheles gambiae str. PEST
INRMMPGPAIEVCENDIIVVDVENHLMGESTTIHWHGLHQRRTPYMDGVPHVSQCPISPGTTFRYTFRADNPGTHFWHSHTGMQRGDGAFGALIIRKDNDIQELLYDHDLSEHVITVQDWGHEQGVSLFASHHHSTGDNKPPNLLINGRGKYFQRRVPSTLMPSSYRKHIPLKVFHVEKGRRYRFRLINAEFLNCPVELSIENHNLTVIASDGFGIQPLEDLGSFVSYAGERFDFIVKANQPIGNYLIRFRGVQLNSLNRGPGAENVITIAETSALDQEDLLLLRNETDYKFYVYYDFYGKDNPHFHVPSLYGFQQVVNNTNRLYTPQLNHISMRMPPVPFLPGKDVLDESQFCNETSVRDRNCRQEFCECSHVLQIPLHATVEMVMIDEGFTFDANHPFHLHGHAFRVVGMDRVSRNTTIEDIRRMDEEGRLPRRLKRAPIKDTVTIPDGGYTIIRFIANNPGYWLFHCHIEFHAEIGMSLVLKVG

SEQ ID NO: 22680 - protein, 649 aa, Anopheles gambiae str. PEST
SVDDKTNDFLCPICFDIINEAYITRCGHTFCHQCIARSIDVAKKCPKCNYPLASHEHIVPNFLLNELITKHRLKGGGGGGGDTLKHFLATESKKLSLSDVNVMLEILTQRKTLLEAESCAAQNRLLHEFLKHLLKQKEQQQLQIANEIALIRSDLLDVEKVLKDVQSSCPTVAEVEQSVRDEKDEHVVAIKREIIQIIDTIDNITVPSNRSLVDDTCSNVTESYEGFNLHGTRRGGHGGSISGGSLSSNPSSFLARKQRMYQHFDDFVQCYFAARSEDLYFGKDRSCSSDSLGVGERSTSNTTRSSGRSSLDTFRESLIKFSKYSALRPLATLNYSNDSNYVSTIVSSIEFDKDSEYFAIAGVTKRIKIFDYYTAIRDAAVDINYPINEMTCNSKISCVIWNSYFKQVLASSDYEGIVTIWDVLTRTRTKTFEEHDKRCWCVDFNEVDTRLLASGSDDARVKLWSLNVDHSVATIEARANVCCVKFNPKSSCHLAFGTADHCVNYYDLRNLKQPLCLFKGHRKAVSYVKFLNTDEIVSASTDGQLKLWNINSPPFCLRSFTGHINEKNFAGLATNNDYLACGSEDNSLCVYYKGLSKQLFNLNSRTSGLQSTDMERSNSEGNEFVSAVCWRKQSNIIIAGNSEGVIKIL

SEQ ID NO: 22681 - protein, 842 aa, Anopheles gambiae str. PEST
RCTPDWSENAVSGDHLWVPTSVSGDCCCVGDNECTKHGPRMKCAACKIIAHASCISVLMERSHLQCKPTFRDVGVRQYREQTKTTHHWVHRRTEKGKCKQCGKSLQAKLTFSSKEIVALSCAWCKASYHNKEACFNPERIGEECTLGTHRSIVVPPSWIVKLPRKGNFKSSLRKTPQKKKSKAGKKVSIPREPRTFVIKPIPTANLTPVLVFINPKSGGNQGAKLLQKFQWLLNPRQVFDLTQGGPRMGLELFRKVPQLRILACGGDGTVGWVLSVLDQINFVPPPAVGVLPLGTGNDLARALGWGGGYTDEPIGKILANIGNSDTVLLDRWSLKVEPNTSVPNTGDGKDNLPLNVVNNYFSLGVDAHIALEFHEAREAHPEKFNSRLRNKMFYGQAGGKDLLKRKWKGLAEFVTLECDGKDLTPKLKEHKVHAIVFLNIPSYGGGTHPWNKSGGQFEPATDDGMIEVVGLTTYQLPLLQAGGHGTCITQCRTARIVTSKTIPMQVDGEACKLNPSNIELTLLNKAVMLAKKKPGRANVPYVQEKLESLHMSLMKIMMADYEQHHYDKELLKQSAVNLGSLEVPVTDLEQVRVLINKYCGEQPDSPKLSPDWCFIDSCTAERFFRVDRAQENLHFITDIANDCVFVLDQESPTLPQTPEDEHRRLGAHGTPVAGSLEWSTSKGTFSPFPPSDILPLHSVLCSPAPCHMHTHLLARLRGKWRTLKDLHLQGYSLLSIDSTGQTALHHGARCGHKDIVRYLISYAPNSIINMIDNETGQTALHKAAAGRQRSICYMLVAGGANLNIQDNDGRTARMLASNADDFELAFYLESEYLEHLVSHFSL

SEQ ID NO: 22682 - protein, 299 aa, Anopheles gambiae str. PEST
RKLFVGGLSWETSDKELKEHFSQYGDIESINVKTDPNTGRSRGFAFIVYKSADSIDKVVAVSEHVINNKKVDPKKAKARYGKIFVGGLTSEISDEEIKTFFGQFGNIVEVEMPFDKQKNQRKGFCFITFDSEQVVNELLKTPKQTISGKEVDVKKATPKPENMGPMGPMGGRGGMRGPPPRGMRGGRGGPGGPKGGYGQGWGGQGYGGYGYGQGYGGGYGDYGYDYLARWYGGYNNGGYDLSGGYYGGRDDYGYGGYDGGYMNGGGRPGGPRGGKGAGAYGGGKQRGNSGGRQQRHAPY

SEQ ID NO: 22683 - protein, 411 aa, Anopheles gambiae str. PEST
AYSESTEGSAPMADSASAAGESCPGDTAEPELAVVRLRSLDESQSPSIRSDGSGSGSGGCRKSSLYVYGDGQFSITLKHYDSIVSEVKCPGCAEPMDGPITMCGTGHSICAVCRVKRGTCPLCGDRVTELRNYTLEAIVSKVQFPCRNAVKGCSVRLPLQLLRWHKERCGYKLIECFMGKVWGGCGWHGCERDWLAHCLAEHADHVHEDRCVELQWAYGAEAAQRAPELQLVVAYHVVRAYGEAFNLYQVYDQDSRTVLWTVICATKESQVSGRYAFELELYSPVNTWQLLVQRFPCHSELDPDFLKDGHCAKLALADALRFMADDKVLHYRVRVLEVGASRTQSLMKLNTGGGGSSISTSATHLPTNYCCKNIENVNLKAVPEGNIICRKQPAHNSETPGSPDDDEVFLP

SEQ ID NO: 22684 - protein, 2593 aa, Anopheles gambiae str. PEST
RKAPYPTRAPDVAAGIRDEPPCPLTKEHVPLSAPGRHDAGQTMGGKGDTKPSQQQCAAKRRTKKKPATDQQRQPKTIPSGGGGSGLVRASSGDRQEQEMSAGGGKRYQTARTQAASQRRVRRLASDGPAGPGGGGAVPHELAANVPADMRISKLLRRLVGETSGGPLFVELCDRLELVILDPSNASYVRKSFDLLAHTVAQILEGGLRECQDRVAQLFGMLLHVLVGGAGPDCGAVLRGWTDRYLNQSKRIRRPALVALRQLVVLDRTERGLEPVADWLVGYLQQILEQTDVLDVFLLVTDVMVRLADGYGHAFAPHFSDIVDIVVGWQLESTQPTAVKLHCARVLLAFRPFWCEQRDVTFNLLEQFSEDIDGHCGDVEYADRAQADDANRLFGALLTAFNSVFKCLQDAAGDGTFLLQPDELARFDCCCCTIVAIVVRLLEAPPTGLAVAAICEFIMLKLMLPATTLTPLGEDELLEIVGRLVQHGSGYSDEQIGAVLHLLLQYADAGGNTERQHARALALRPLIFAESGPFYAFRYRQSAAVKRALLLLYHRMLTLKHAEVLQGAYRSILADIDDALGRLRAVGNRTPSPGTLVRLQYRIQFNLLLLSPLAMARSSIFITWTLREDPVLHVLLERLAPADGRLWDRRTHAPLHYAVLLTAFHHCSANNHFISSSGLLRPAGRTVVERFRRDTSDTDAPPESPTADHFGLVLRFLGTILRQWGTRQQSGGRLYGAVRGTELLPLLLDWCVAIVTQTTRYHDVLHECDDFNQLLVHVGTVAVERGSESETIGLRCADCLDAACRFASLHPSAYQAIAEACCVHLCSVYGSLRTRYTVIFSKLPLRHSLRQVNEFTGVNRRRWEQIGELKNGLYHQGGYALQHSATLRMADLRTLFNRIAFSRDGSEYAGGYLHELLTRSFNQPSRYGEMALRDLRCLIPWAQWEAAQLCVNQKLRTPFGKPQSTFLRIESIVKQCARILALTDRFPVRDIRTSIANQRHARILLGFLEALEKSIYNAAEGTAYALPAPEKPARTFFRVNQSTCAEWFTRIRTAVDLVALHCMEPEMVIRYSEAVLRELVAAGKTGDPIFEHMLMSLVWALVRNWESDALYGVYVWSKRLTGRKYSWIRMAAEEASGHRETAASGFRSILADPGSAGMDRHIRDFIVDQTILSLLFTGDYRQLYEFLLAEESSGTPRATIPLITVTAAQIRSIIRYEETHDVSVIDISQWELVDVGTNIPNDFSCHKAICAVENSLSGIILQEQIEQRQRMIDASTELIQCYLQECLLTRCREYLFQLTITNHILYKIAQRIRAPDATAAAGEAAGATASATADGSGGLGSLNVEKFYGTLTLMRLLAWSEFLLADAGAGEQQQNIDLRLDLVSIGRKEKNYALCRRELEKYYHKSNLIGRLGAAGDEPPKQQRLTLEQVAAALTARSAGAAVWDENLSRAVYEHCKWLHCQPGKRLEAINFAACATAAIDGVLRERRGSEPRLAERVGRFLLTISDWMAGEAGEPTANELASVRRLGQLLPAVGAKPLAADHAHMFRASDRLIGTLLQGAVDRCPSLAKAWFALGSWLYRWGKRLVEHSAADGSPSSSPVRISVDQVAGIVAGPAVSLADCERIVEILNEHEPARMMAGPDGGEGDEPDELELDSSATIGSIGLLDALHRAMPRLERNVPPDRLHAIIDIWRSNHRAVYGHYEAAAEAYFRFLQLSSGRNEAVEEEGVDSERARSVTVTLRLLRLIVKHALGLKEVLEEGLATTPSEPWRVITPQLFSRLAHHEPYVRRRVSELLCRVAKDAPHLIIFPAVVGSVQEEPGQLAVVDVLRDGVEEVSNRLEGEGESAQSAQDGGAGLSFCFNALLDILSREIPDTVKQVQTLVHELRRISLLWEELWVVSLQQIYADYTKRIPTFEAEYRRLYASGQLTDQRRALLAEKHRLLLRPLLFVLEQLYGITSRPAETNHERHFQERYHRYIRNMLAKLREPADFSRPIEGWNRFRTLYAQLQQRSQKRFSFFLRLADVSPNLLRLSNTAIAMPGIDTTLAGSRQPILIRTVDNNIQILPTKTRPKKLTFCGNDGRRFGYLSKGLEDLHLDERIMQFLSIANLMMTKSIDCNGNVTHYRAEHYSVIPLGPRSGLITWVDHTVPIFSLYKKWQQREALQKKEGKGAGSSATLRPSELFYNKLTPLLQSHGLKANASRREWPLPVLKQVLAELQQETPRDLLAKELWCHSATASSWRQVIRSYSLSLAVMSVIGYIIGLGDRHLDNVLVKLATGEIVHIDYNVCFEKGKTLRVPEKVPFRMTPNLEEALGMTGIEGTFRLACEHVLKSLKKGRETLLTLLEAFVYDPLVDWAVGEEIGSGLPMTATDITVSTAAAASHAPGSVATTRSISQAKKQLDREVTRDTLAVRFAECRTDWYQNRDELLQHLLCLQKLVRELGEVRRETAESERLRSLYSQMLQLIGEVGYLDTAFGSHPLASLAQRLEMRAQLQEVYGVQRTQMAQQADRLAQQLAQYERVRRAVEEQKQKEQKEQKRNAYAVSVWRRIRMKLEGRDPDPGRRCGVSDQVGWMIDEAMDPNNLAVLYEGWTPWV

SEQ ID NO: 22685 - protein, 135 aa, Anopheles gambiae str. PEST
AQTSSNKSKMAGGKAGKDSGKAKAKAVSRSARAGLQFPVGRIHRHLKNRTTSHGRVGATAAVYSAAILEYLTAEVLELAGNASKDLKVKRITPRHLQLAIRGDEELDSLIKATIAGGGVIPHIHKSLIGKKGGPE

SEQ ID NO: 22686 - protein, 438 aa, Anopheles gambiae str. PEST
LIRISAAVMGIEFSYAAETAFVSPTLLKIGVEHQHMTLVWCLSPLVGFFLTPVLGSLSDRCRSKFGRRRPFIMLLSLGVLLGLLLVPNGEDVGTVDPVVSTVIPPTVPEHRPRHPWGIFFTILGTVLLDFDADACQSPARAFLLDVTVPEDHARGLSTFTIMAGLGGFMGYSLGGIDWDSTSLGIVLGGHVRAVFSLITVIFIVCVLCTVTSFSEIPLWILEEELERQDPPVEGRSNRLASEEPATYGATRHDRRSQPEASPASASYDELPGENFTETSFSGDKPTVTLSMYLLSIVYMPHSLRMVCLTNLFCWMAHVCYSLYFTDFVGEAVFDGDPKALDGTEKYLLYEAGVRFGCWGMAMYSLSCACYSLIIERLIKRFRAKSVYVGGLLFYCLGMSLMALSKHRVGVIVFSWTAGVMYSTLFTMPYLLVAHYHSE

SEQ ID NO: 22687 - protein, 490 aa, Anopheles gambiae str. PEST
MAAQPACTRFSDNYELKEELGKGAFSIVKRCVQKSTGFEFAAKIINTKKLTSRDFQKLEREARICRKLQHPNIVRLHDSIQEENFHYLVFDLVTGGELFEDIVAREFYSEADASHCIQQILESVNHCHQNGVVHRDLKPENLLLASKAKGAAVKLADFGLAIEVQGDQQAWFGFAGTPGYLSPEVLKKEPYGKAVDIWACGVILYILLVGYPPFWDEDQHRLYVQIKAGTYDYPSPEWDTVTPEAKSLINQMLTVNPYKRISAADALKHPWICQRERVASVVHRQETVDCLKKFNARRKLKGAILTTMLATRNFSSKSMIAKKGDGSQVKESTDSSSTTVEDDDCKARRQEIIKITEQLIEAINNGDYETYTKICDPHLTSFEPEALGNLIEGMDFHKFNFENVLGKSNKAINTTILNPHVHIFGEDTACIAYVRLTQYIDKQGHPHTVQTEETRVWHKKDNKWQNVHFHGSRNGSFSNTATQYDFVNHK

SEQ ID NO: 22688 - protein, 344 aa, Anopheles gambiae str. PEST
MSGTTGKRKEIYKYLAPWPLYSMNWSVRPDKRFRLALGSFVEEYNNKVQIISLDEDTSEFSAKSTFDHPYPTTKIMWIPDSKGVYPDLLATSGDYLRLWRAGEPDTRLECVLNNNKNSDFCAPLTSFDWNEVDLNLVGTSSIDTTCTIWGLETSQPLGRVNLVSGHVKTQLIAHDKEVYDIAFSRAGGGRDMFASVGADGSVRMFDLRHLEHSTIIYEDPAHTPLLRLAWNKQDPNYLATVAMDSCEVIILDVRVPCTPVARLSNHRACVNGIAWAPHSSCHICTAGDDHQALIWDIQQMPRPIEDPILAYTAAEGEVNQIQWGATQPDWIAICYKTACEILRV

SEQ ID NO: 22689 - protein, 490 aa, Anopheles gambiae str. PEST
SNGQHRDAAASSLSAPRATVKAVQSDGHQRNGRRRPNDQSTIKRVSDQSSTKHKRLEKMAKPAYKVADISLAEFGRKEIVLAENEMPGLMACRQKYGPLKILKGARIAGCLHMTIQTAVLIETLIELGAEVQWSSCNIFSTQDHAAAAMAKAGVPVYAWKGETDEEYMWCIRQTLIFPDGKPLNMILDDGGDLTNLVHAEHPELLKEIRGLSEETTTGVHNLYKMFREGRLGMPAINVNDSVTKSKFDNLYGCRESLLDGIKRATDVMIAGKVCVVAGYGDVGKGCAQALRGSGGRVLITEIDPINALQAAMEGYEVTTMEEASKEAQIFVTTTGCTDIIMGEHFLNMKDDSIVCNIGHFDCEINVTWLQENAVEKVNIKPQVDRYRLANGNHIILLAEGRLVNLGCAMGHSSFVMSNSFTNQVLAQIELWTNREQYAIGVHVLPKKLDEEVAALHLDKLGVKLTKLSARQAEYLNLPAEGPYKPEHYRY

SEQ ID NO: 22690 - protein, 272 aa, Anopheles gambiae str. PEST
GFVQQLNRKRLTERRQPQAFQLDAPFDPSRFNFTRVDPAEVQLELVAPSPTTMLINNSPVTVYHSLVVPDRAGQHSQLLTSGGVRVAFELLLRLPDRRYRIGYNSPGAQASVNHLHLHLLRIDTALYVQRAELLPVRGTPLLHRLADHLPAQGYCFVLRDPTTELEPVCSGLMKLIQALAERQMAHNLFWTWTDLHRGGELRALVFPRVTQCVNKAACSFNAAFLELCGFVSVGEGNDYDRLTEEAIVQALREAQGDVYGMLGGIFPVASTD

SEQ ID NO: 22691 - protein, 499 aa, Anopheles gambiae str. PEST
TPGTLARPVRLQSQPQQLASQRANPTYQSYQPTKPLSSSKMSMSSYTESSSEEDDLSPRDKVQQNSKGYADFCVRNIKQHSFGRHEIEIAEQEMPGIMALRKQALDDKPLKGANIVGCTHVNAQTAVLIETLICLGANVRWAACNIYSTQNEVAAALAESGVPIFAWRGEIEEDFWWCIDKCVHAENWQPNMILDDGGDATHLMLKKYPVMFKMIKGIVDESVTGVHRLYQLSKTSKLTVPAMNVKDAITKTKFDSLYSCKESVIDSLKRATDIMIGGKQIVLCGYGEVGKGCAQALKGLGCIVYVTEIDPICALQACMDGFRVVKLNEVIRTVDVVITCTGNKNVVTREHMDKMKNGCIVCNMGHSNTEIDVNSLRTSELQWEKMRSQVDHIIWPGPDGKRIILLAEGRLVNLSCSSISSFVASISATTQALALIELFNAPPGRYKADVYLLPKKMDEYVASLHLQTLDAHLTELTDEQARYMGLNKAGPFKPNYYRY

SEQ ID NO: 22692 - protein, 364 aa, Anopheles gambiae str. PEST
LRCLNCNFDIAMMLASAVRNLSRRSFSTSKAVSAQQLTVRDALNAALDEEMERDEKVFLLGEEVAQYDGAYKVSRGLWKKYGDKRVIDTPITEMGFAGIAVGAAMAGLRPVCEFMTFNFSMQAIDHVINSAAKTFYMSAGTVNVPIVFRGPNGAAAGVAAQHSQCFGAWYSHCPGLKVVSPYDSEDAKGLLKAAIRDPDPVVVLENEMVYGVSYPVSDQVLDKNFVLPIGKAKIMRPGKHITLVAHSKSVETAMLAANELAGKGIEAEVINLRSLRPMDSETIFKSVQKTHHLVTVEQGWPQGGIGSEICARIMEHETFFHLDAPIWRVTGADVPMPYAKTLEAAALPQVPDVVTAVNKVLGVK

SEQ ID NO: 22693 - protein, 683 aa, Anopheles gambiae str. PEST
IISNEFCERFNYYGMRTVLVLYLTRKLDFDDDTATVLYHTFTTLVYFMCVIGAIIADSWLGKFRTILYLSIVYTIGSGCITLGAIPTWDLDARAMTIAGLLLIAFGSGGIKPCVAAFGGEQFKLPEQAKYLALFFSMFYFAVNSGSFVSTMVTPILREDVKCFDDDDCFPLAFGVPGVLMVISIIIFIIGKPLYKISAPAGNMFVKVSKCIWTAIRTRSREKSINPREHWLDYSEKRWGRQLVDETRILLNVLKLYIPLPVFWALFDQQGSRWTFQATRMDGDLGFWTIKPDQMQVINPLLILVFIPLYEVAFYPLLSLIGIRRPLQKLTLGGIFAGLAFVISTIVEIQLESTYAVMPKAGEAQLRIFNGMPCDYRIQSNIPEHADFTLKSMSMFEEKYLNVKGSATYTYTLSSTGPGPNCAVAEEQRTFVVDEEKQLSYFIRKQDSGISLLRYEDDTEKSSKGYPVFRVLGNTATNRTVVFRDIDSSDAFDRHKNGSYVYDRVESYPSDYEIYVDGELTLTYTMRLGGVYAFIVSDIDGMSTTPIIVTEPNSVNMLWLIPQYVVMTLGEVMYSITGLEFSFTQAPESMKSVLQGCWQLTVAVGNLIVVIVAEAKIFDEQKWEFVLFAVLMFVDMGLFSILAWRYKQIPLKNYDEEDDPNATLPIDQKEESGLDNPVFKKSDE

SEQ ID NO: 22694 - protein, 540 aa, Anopheles gambiae str. PEST
LVGANIEIVSMMSALSHQVNMNNFLSLLVGASLVAANSSPSHDIASLSQPTEFSNGVSSFALPAEDRMAIESSTLAYLNYSFTGPDGHLIEFGSESAKYGEGRVLNRSGLLVHISNSANHSDHTGCSKQWSGTLGGTIPERDAPWIALVRRGSCNFEDKVKHAYERGAAGIIIYNDKNDTKLEKMKINDKERNITAVFTTNAMGRELIEILEVHRSVVQMRIIEGSRQFRNLGNINRTSVLFVSISFIVLMIISLVWLVFYYVQRFRYLQTKDKQSKRLCSVAKRIIAKIPTKSIKSDDKEIDNDCCAICIEPYKVTDVIRVLPCKHEFHKVCIDPWLLEHRTCPMCKMDILKHYGFVVGSSSSSQINSAIAEYLNVAPPPPPSNTSTITTSSIASTEESSRRVSWSTGADMGPATSATVDGSIPTTLFGNDYVAGRNGGTSVGQLTDIVTIIINIDDNESPTGRGDTVTGSSGASGGGSNSRMGVLCDLSTHDVVNCSSASASSNDRDNSNCDNGNTISNDSNESNSDSHLISRKITDV

SEQ ID NO: 22695 - protein, 226 aa, Anopheles gambiae str. PEST
STMEAISEALQPYKEQVGMAAGILTVGQMFSGCFVCNDIRKKGTTDGFSAMPFVGGCGLTVLFLQHGMLMNDSAMTNANLVGLTISLAYAIFFLLYTPPTGRSSYWRQVGGTALFTITLLGYVKVENPSVVEDRFGMIITVLMLALIGQPLFGLPDIIRRKSTEGLPFAMILSGTIVGLSWLLYGVILNNVFVVCQNLAAVTLSGIQLALFAIYPSKAAPPSKKRE

SEQ ID NO: 22696 - protein, 248 aa, Anopheles gambiae str. PEST
MSRLFGSSSGSVLGTAGSKMSSFRKVTHCIFDMDGLLLDTEKIYENILRDLLKLYNSPYPWPTRMKVMGTTEQRTCSILVNDLKLPCSVDEFLARFRRDQLLHLGRAPLMQGAERLVRHLHQHNVPIALATSSGADSVEVKTKNHRELFELFGHKVMGSSDPDVKEGKPAPDIFLVAADRFPDRPAPDQCLVFEDAPNGVTAAIAAGMQAVMVPDPHIEEDQRKHATVVLKSLEDFHPEQFGLPPFTS

SEQ ID NO: 22697 - protein, 323 aa, Anopheles gambiae str. PEST
LACVQNRQKRKKPVHGVLLLFFFSWRKYTENLYTQVTQSIAEPYGKTYTWEIKQTIMGLQRDEAAEAIVAALELPLTPAEYVEISTERINRVMEQCQLMPDTEKIYENILRDLLKLYNSPYPWPTRMKVMGTTEQRTCSILVNDLKLPCSVDEFLARFRRDQLLHLGRAPLMQGFPFFSSFVCDGIGAERLVRHLHQHNVPIALATSSGADSVEVKTKNHRELFELFGHKVMGSSDPDVKEGKPAPDIFLVAADRFPDRPAPDQCLVFEDAPNGVTAAIAAGMQAVMVPDPHIEEDQRKHATVVLKSLEDFHPEQFGLPPFTS

SEQ ID NO: 22698 - protein, 385 aa, Anopheles gambiae str. PEST
LNCISHTVFKLQSMVSAGTSTDVPMESVESTGPATTGAASPNTVNGNGNDLATNAEDMTSRDYYFDSYAHFGIHEEMLKDEVRTLSYRNSMYHNKHLFKGKVVLDIGCGTGILSMFAAKAGAAKVIAIECSNIIDYAQKIIEANNLQETITLVKGKVEEVTLPAGYEQVDIIISEWMGYCLFYESMLDTVIYARDKWLKKDTGMMFPDRCTLFVTAIEDRQYKDEKINWWDDVYGFNMSSIRKVAISEPLVDVVDPKQVVTSSYMVKEIDLYTVKKEDLEFESPFYLTVRRNDFVQALVTYFNVEFTKCHKRLAFSTAPDAPYTHWKQTVFYFDDYLTVKKGEEIQGTFKMKPNVRNNRDLDFTIDLHFKGELSQVDEKNHYRMR

SEQ ID NO: 22699 - protein, 292 aa, Anopheles gambiae str. PEST
QVAIKIIDKSQLDPGNLQKVYREVEIMKRLDHPHVIKLYQVMETQSMIYIVSEYASQGEIFDYIAKYGRLNERAARNKFWQILSAVEYCHNKGIVHRDLKAENLLLDSKMDIKIADFGFSNFYKKGELLATWCGSPPYAAPEVFEGKRYTGPEIDIWSLGVVLYVLVCGALPFDGSSLQSLRDRVLSGRFRIPFFMSSDCESLIRKMLVLDPSRRFSIDQIKRHRWMMVEIIDTPKISSIVINGSVSEVSALETEPNEQILKIMQNLGIDILKTRESLKLHSYDHYTAFYLL

SEQ ID NO: 22700 - protein, 518 aa, Anopheles gambiae str. PEST
MSNNSLMVFFLLFLRFQVAIKIIDKSQLDPGNLQKVYREVEIMKRLDHPHVIKLYQVMETQSMIYIVSEYASQGEIFDYIAKYGRLNERAARNKFWQILSAVEYCHNKGIVHRDLKAENLLLDSKMDIKIADFGFSNFYKKGELLATWCGSPPYAAPEVFEGKRYTGPEIDIWSLGVVLYVLVCGALPFDGSSLQSLRDRVLSGRFRIPFFMSSDCESLIRKMLVLDPSRRFSIDQIKRHRWMMVEIIDTPKISSIVINGSVSEVSALETEPNEQILKIMQNLGIDILKTRESLKLHSYDHYTAFYLLLLERLKSRTVSHENATAVAGCIGGGKSGMHESQRRRPSNVAEQAMRKLAISAQHKSDQPSSSPKHQQVSSGLNNHSSETLHGLLSAAQQVGSGVSPALPAMAPGMMLLRDTSIREQQPVLKDSSYFRGVSYTSSSGFTDASLYQLASLRERDCSSTYLTGTVGLLPSSLSSNVAGTLAAAAAGASSSSARESNSIVLRESGILSSRISSS

SEQ ID NO: 22701 - protein, 326 aa, Anopheles gambiae str. PEST
MSSAGPLPYWQQVYQIERELSAALRQVALPGDVAACYDPIEYAAEIHCAYLQRFLDGPKPVLFIGMNPGPWGMCQTGVPFGYVPAVRDWMGLRGTVSKPSPELSARPVEGLACTREEQSGKRWWGLFEELCGTSDRFFRSCFVYNLCPLAFFHQSGRNITPSELKDALQQARIANDLKEVPVGCVFVRTDGQTETIIARGCNLVNETKNATRHVEFICIDQALEYARQQDVTPPEAIFSTVTVVVTVEPCIMCAAALIELGVKEIIYGCRNDRFGGCTVLDVPGLLSATVPIRGGVRDAEAMELLKEFYKGENPSAPIPKPRAKKA

SEQ ID NO: 22702 - protein, 217 aa, Anopheles gambiae str. PEST
MSNAEAIQVSSLPLPPAQYINLYTDENIRKNRAPKPPAPIQDAYTMFGSPFSNDDNIIRPLESQGFKRLYPQHFDRRKELKKLNHSLLVNFLDLIDLLVHYPDSPRRAEKIEDLSLLFVHIHHLLNEFRPHQARETLRVMMELQKRQRIETAQRFQNHLEKVREMVKNAFASLPDLTDADRLAGGLEPMDVGESGDLAGGRGEGCHPLDRLMCELVD

SEQ ID NO: 22703 - protein, 247 aa, Anopheles gambiae str. PEST
MDGSSGPSSGASGAGTDMGEGSAGGGSSSSSGSGGGGAGAAAAGGGDTRPSVRFTGRRGSRRRGVQNINHVDQILREILISVSGGGNGAGASGPMFFMGNPGDYAWGREGIDTIVTQLLNQMDNSGPPPLEKERIAAIPTVTISEEQVERKLQCSVCFEDFVVGESVRKLPCLHVYHEPCIIPWLELHGTCPICRNSLSPEESHTGAQPQDSSQSPTENSQQSTQQQTASQSDPSGRQNSNFLTFTI

SEQ ID NO: 22704 - protein, 572 aa, Anopheles gambiae str. PEST
INPNISGMADKGSQPGGTPQPLVKIGHYILGATLGTGSFGKVKIGEHQVTKHKVAVKILNRQKIKSLDVVGKIRREIQNLKLFRHPHIIKLYQVISTPTDIFMIMEYVSGGELFDYIVKNGKLQESEARRFFQQIISGVDYCHRHMIVHRDLKPENLLLDHNRHVKIADFGLSNMMLDGEFLRTSCGSPNYAAPEVISGKLYAGPEVDIWSCGVILYALLCGTLPFDDEHVPTLFRKIKSGVFPIPEYLNKQVVSLLCQMLQVDPLKRATVEEIKKHEWFQKDLPAYLFPSPVEQDSSVVDTNAIREVCEKFSVKEHEVHNALLSGDPHDQLAIAYHLIIDNKRIADEAAKAELKEFYVAGSPPPPGADSKFGTPLGPGSIAPTQAGTPSEPFKSPSIHPERIAPLRERPVTAAQNMPVPTLSTMSPSAVMPIDKHRGTPVKRAKWHLGIRSQSKPNDIMLEVYRAMKALDFEWKIINPYHVRVRKYNARNDKHVKMSLQLYQVDPKNYLLDFKSLTNDEVEQGDDVIMESLTPPPPVGFGGMGIPSNHQPSGHHTMEFFEMCGALIAQLAR

SEQ ID NO: 22705 - protein, 416 aa, Anopheles gambiae str. PEST
MAKDEEDDLLPDKDAAKGFYAKYEPKEILGRGISSTVRRCIEKETGKEFAAKIIDLGAAETGDSNHMLEATRQEIQILRQVMGHKFIIELQDVFESDAFIFLVFELCRQGELFDYLTSVVTLSEKKSRYIMRQIFEGVDYIHSKNIVHRDLKPENILLDDNLNVKITDFGFARVLKEGEKLYDLCGTPGYLAPETLKCNMFEDAPGYSKEVDIWACGVIMFTLLVGCPPFWHRKQMVMLRNIMEGKYSFTSPEWADISEDPKDLIRKCLVVDPSKRITVTEALKHPFFNTVLFEQDIGPLKRSLSVKSRRFSRIADLALLRKQSQFNARKKFQFAILCVRAMIRIKRLRYTPEPLRVEDALRDPYRVKVLRKVIDGCAFRVYGHWVKKGEGQNRAALFENTPRCEVYNLYINSLNR

SEQ ID NO: 22706 - protein, 298 aa, Anopheles gambiae str. PEST
SRGPRGIPRNATRRKSVHNFVLLLKQTSPSSRKRTTMESTVALYKQLKTEWTKSPINLKLCGTILDKLKVALAGMSYIPTGNAQANQQELLIARDILEIGVEYSIATKNIPAFERYILQLKWFYYDYNTLIGESKNKYQLLGLNLLFLLSQNRVAEFHTELELLPADIIQTNAFIRHPLALEQYLMEGRYNKIFQAKGNVPAESYNFFIDILLQTVRNEIGACLESSYERISLQEAAKRLNLKSKEEVKQFGEKKAWKLSPDGFYHFVNELAKPKEPIPSQELAEQAIMYARELEMIV

SEQ ID NO: 22707 - protein, 824 aa, Anopheles gambiae str. PEST
LNNTLNFTLAGYDLSGHLRQFREMRFTDLNLCERYDVSQEQRIRFGQSYYRKCVLSVNRLVEDFRAVEFLSLYVSYYEQRVRLMRSVPILIENAFTQNTDPEPDRWQLVKRFLLVDTVSGLNELHKPKLYGEIDVKNQFFFLRYAKKIELEFKLHPDHGKHPNRISIPLVRVEYALLNTSAAGQGALTGSTVEFEFRVTFTKAYSYASLLEILLPIFILLAFSMSVFQSYCYKLRQSKQYYDMEIFWNFFIYLGSYLGTAFLIVLGVIVLHALFTYKTQSTVHLLLPLEVQNLVEVFIYVGFALKLIKLMRVFFYMANVDIFFIDWERPKIFDISTMGQRLHQLDTPSIASSTNTKPSSHDSVSAWRNYFIANEWQELATKRKISMFAHIVLLALAFVILGFENWASNAFDLHLHRNSEHLGERDKMLLIAVGILIYTTVYVAQRLYNFLIHDRFIENAIQQFIDVASIANISVFVLSMESYGYYIHGRSPHGFSDTDMCSMIMQFKREEDNLCGNRGLLPGSEQQTYSILVPKNLRLFYDKLITPLRNSSSLGPHQHLNRPQLIGSAKMSASEVFTSPGGGRLEYNFERTILTYYNVNRFFAAFVDHALKDLDYIIQERTILENILNCEFQNYITENKGVFYIDNGHSFDQILFNGNESIFFQVELLLFCCVVLLTGNYLLGIVGSRHEQEKLLRVSSTLYVGNLSFYTTEEQIHELFSRCGDVRRIIMGLDKFKKTPCGFCFVEYYSRLDAESAMRYINGTRLDDRIVRVDWDAGFIEGRQYGRGKTGGQVRDEYRQDHDLGRGGYGKMVQMGQLGAPSMRE

SEQ ID NO: 22708 - protein, 865 aa, Anopheles gambiae str. PEST
RHEPEAAHRIENCLSFEGFARYMIDKDNYAFLSEIMPESTYMNLPMSHYYIASSHNTYLTGHQLKGESSVELYSQVLLTGARCVELDCWDGDDGTPVIYHGHTFTTKIPFRAVVEAINKSAFIQSSYPVILSIENHCSVQQQQRMANIFQAIFGEKLVTNFMFDQDYSDEPYLPSPLSLKHKILIKNKKLIVEIPATLSTGLTRQNTFKQSNLSSRASSIISNTSGSSLNEEFSDDEYEDDDDFDNIDEKTYHTTWGSIEDKYRHSVCHSNITPTKSKAQDQDERSRKRSNQIARELSDLVIYVQAIKFRGLNPYSPHNSIPKCAQDERVGRDGGKHKNSSGDTLSLPSSSHLSDSLSLSYDASSISGSESHLPPTSNSIRNRTLPNANHPCYQCSSINEASAKKLCRKDPLGLIAHTESQLMRTYPAGLRIDSSNFNPVFFWAFGIQMVALNYQTEDIPMHINKAMFEENNSCGYVRKPDVLWNRSHLMYRRYSPLEKEFDGLHVTQLVLNIVSGQYLNQASLYSSTFVEIELLGIPVDCGKRKTKIIRKNSFNPLWNETFYFKIMFHDLAFLKFSVYDAETGLVIAQRVISLKCIRPGYRHVRLRSPTNQPLNMASLFVYTRVEEESLDRSRLDIANSLESKVPQLKRKMFFLTVYDVVPDKPYTILKITQESTTKDVLTQAMGKMNKSAQDMANFILIEEVYRGWEKKDRLLPPSQRVLDMAEKPLQAQGHWKGEGRFILKKIGNDPSSRAWEPTADDLLALENVDNFLVCVYNVSQDIPYAILRVPMKSTAQDVLAQALLKARRLDNPNNFVLVEELNYSTKGNDTMQRILLDDENVYVTQANWKTIGRFVIHERSQLTPS

SEQ ID NO: 22709 - protein, 289 aa, Anopheles gambiae str. PEST
TIGSDKKPPAAGVIDKTQLHRDINRSAPCLTSAMDFTGKVVLITGASSGIGEGTAIYFAKFGASLALTGRNEANLKKVGDACEAQSKSKPLLIVADVTKEEDNKRVLDEIVAKYGKLDVLVNNAGILGNGSIENTSLQQYDELMNTNVRGVYHLTMLAVPLLIETKGNIVNLSSVAGNRSFPGILAYSMSKAAIDQFTRCTALELAPKQVRVNAVNPGVIITDIHKRGGMDEESYAAFLKKCEQTHALGRPGVAEEVASTIAFLASDGASFITGVTLNVDGGRHAMCPR

SEQ ID NO: 22710 - protein, 269 aa, Anopheles gambiae str. PEST
ELALHNDHNRTLPSPVAMNLAGKVVLITGASSGIGAATALKFSQLGASLALTGRKLDNLNEVASQCGGSPFVVAGDISKEADTERVLKATIEKYGKLDVLVNNAGIIETGTIETTSLEQYDRVMNTNIRAVYHLTMLAVPHLLQSQGNVVNVSSVNGIRSFPGVLAYNISKMAVDQFTRCVALELAAKGVRVNCVNPGVTVTNLHKRGGMDEQTYAKFLEHSKNTHAMGRPGQASEVADAIVFLASDAASFITGASLPIDGGRHAMCPR

SEQ ID NO: 22711 - protein, 565 aa, Anopheles gambiae str. PEST
MTRAAMRKQQAVDVNQKTQQDRPISVMKGKENVPSSSDTVSGNVAGVSVATGAEIATNDSASNGEQKKSQQAANACLAKHAEVVVKPKRGRMSSEFEASDNSLYVTAVDNFEDGSAASAGTGPDCVDPLGPDCVDPLGPEIAPRNEPAPPAAKPLAARADVKPKQRGRGSSEFEDSGTLYMTAVDNLDDGATISNKGKAVAAAGRVATTGASLAAPDKKTKARVEDENGPWKMLITENVALTRAATAEIGVPRKQPPASVEDYDLCYWNDIYQVSEYAQDIFDYLQEREPAYDIPDYMVRQKHLTKRMRALLVDWMIEIQETFELNHETLYLAVKILDTYLSRVTIGHEVLQLVGIAGMLIASKYDERLPPTVDDFVYFCDGAYDRNDLLKMERTVFRTIEFDLGFPLSYRFLRRYARVNRIPMMTLTLARYILETGLMDYNTVLVRDSKLACGALFIARRMLDQPGWNETLEYYSSYKVEQFTDAIVLLNNGMSSRQYSFDTVHKKYSHELFFEVAKRPVITSMEKLFATSSVMYKAAPTALPVAADATTKENVAPIPAAVSNK

SEQ ID NO: 22712 - protein, 1123 aa, Anopheles gambiae str. PEST
MKKFISKFETKNEPCSAGGSSSRETNSFVGKTFKLSKENVVTVEEVLAEGGFAVVFLVKGAKGERYALKRLYVNNEYDLGVCNREIKIASNLSGHKNIIGYIDHSINAKGNGVHEILLLMPYCKTNLLTQMNARLGTGFTEPEVLQIFCDVAEAVARLHQCQTPIIHRDLKVENVLQNDLGHYVLCDFGSATARILNPTSHGRTTVEEEIQRYTTLSYRAPEMIDLFNGQDITVKADIWALGCLLYKVCFFTLPFGESTLAIQSGQFSIPDGSKYSRGVHQLIRYMLEPDADRRPNIYQVCEVAFGIAGRANPVRNLTKCSVPPLDTLPVPPFESETKRLPTASGGPAGGQHGGSTPKPAKPSAGQLPLEGGTSVAPRQRPKASQVATPGQMGVSSFSLGLPPNPSPKNIISSPTPGMAPVAGTIGTTAPTDAPEAFVAKFAANFPPASNSSSVPTVAAASAGSIDPTAPTVAGKDGTAVTALPAQPVAVAALFQTTYPDPFREAELAPIPSGGEMPTASAPNSSSSSLSMVHSPSHAGTQQQHPGPSSAAAQTPTLGGSNSSSSSGVHGAGVGILAPPKPSGHRRNVSDTSAFNKAFATETSQFLAPFDQSTNNYQPSSSVSPSVGQTAASVGASMASGSNSSLHKQQQQHASSLASSSNPQLFQQQRSTSSAGGSANWNPFGDPTPFSQMTEDHIFGEEFDKIREQGSQGSLKTPPEVPRHSSLPLIQTAASAAGNMAALSTVQQAAPFSPENIPDTLGDDEDDPFSSAPFSLPVRTDKSKSFKLASRKVIVIDGGFSTQLTEHVGAKLDKDPLWTSRFNATNPAAVLETHLDYLKAGADCILTNTYQASIEGYMDFLDLNEDESLKLIRASVELARRARTRYLAEKLENKSHKIPWVVGSIGPYGAHLHDGSEYTGAYAEHVPANRLQKWHRPRINAIVEAGVDALAIETIPCRMEAEALLDLLSADHPTVRFWISFQCRDGASLAHGENFAETVLGLWNRARQLANPNLLAIGVNCVNPQHVLPLLRSVHELLQQRAAGTPPESERIPLIVYPNSGEHWDAAASCWRGAENLTPLETYLPQWVEMGVKFVGGCCRTNARDIKRIKKAVIGLYGSRSNEN

SEQ ID NO: 22713 - protein, 1442 aa, Anopheles gambiae str. PEST
FRGEEFADSTESQELEEALHASSIDEVLNQWADQYGSTPPRTRIKNKNRSSKQRMEGTVKMRTGGGRLARPRTDRRNTVDCALLNQMIMEPANGEEKVRSDKRSTQLLRDSERDIKMSAAATVLPLRASANYGSQLPAGAGGPVLEERAESLPLSVPGGLGGLVAVGSGAAGSPAPPPTLIESCNRFMSVTSRPVGCRISAPPVAYRDVIFNSQPGVIEGVSGARTVDCAIPQNRINFHATFSDLIKLGSVDKERAARSGVLSNEERLWQTHVNDLIWLELQAWHADRSIEQQDRLLCQARHEIGDLLEEIMSFRFQRKPAAVRRAGSETSTGTTADSGIETATTTGGSGGVEGNRFCFGCLSMYCKDCLEVQTAAMKQVEELLLRLESKECLFPSSRAMGSAFPVYQSEAFVNRVKAMCLWYNMTRQHRMTLLILGKLLARLQGPSKKESSIHWPIMEHHAEGSSSSSVQDESGSSADSGAHYSANGGGGSTSGSGSGTSSNCSKRVQFADGGGCCAGDGSASESVNSDETDFSDLSLNRERPYPGDTEYGRYMNNLNFYNEHTLTELSAQSASSMGNALYRKYIENVLKCRGLGKSLTFLHRLHNVVLRKAQLTLEKPGRQQEDDCLFDEEDVPCIEPPLEREQEIELRRYGAWSEEAKQLNLPSYVSAFLFLSLIPLEVIHEFLKMRLETRPKQPNPLSLEQHIKELKEGLTLAMIHRERFQKHINTVLSDREQELNKYMHQMELFDDTVRNIFELYLELCEQWILDTVPEGHQKAVLDEEWRFTKLISPMIPREHGPAARRFCSIVERVLERTGSDMMRQLKELMEKSQQIDSTTDGKKWQFFALCRETQRMFTVSREKALKTMAFAKTLFRDLEHADFHRDHCEDDSESELLNGGDDGDDLELVGVVLRSGNLRRSARGAPDAANPIGHTRSPVCSEVVESLQMLKRNALLLRNKLAAVIEELQLLCSDESLEEFDEIDRLGALTRVREILHQGYKFGFEYHKDVARLYETRLNNCRDGESELMLAKAIIQFAKLWMNFVMERCERGRGLRPRWANQGLEFLIAACDPLCTSHLTDAEFEDLKLKMDACISHVIGNIREPERIRKSPRSRKSSPSPKSFQNQLSLREDGVMLRTNSPIEAADLYRKQTSCDNVTEGRFGKVYTAVNNSTGELMAMKEIAIQPGETAAIRKVAEELKIFEGISHQHLVKYYGVEVHREELIIFMELCPEGTLESLVELNGGLPEAQTRRYTHQLLSAVAELHRNGVVHRDIKTANIFLHKDGNCLKLGDFGSAVKIQAHTTMAGELKGYVGTQAYMAPEVFTRNNTEGHGRAADIWSVGCVVVEMSSGRRPWHQFDSNFQIMFKVGMGESPEIPENLSEEGKDFVGICLQHDPKDRQKADELLQHIFCKFTFYDPEAIDKKLRGTFRRNLKSTTSASS

SEQ ID NO: 22714 - protein, 305 aa, Anopheles gambiae str. PEST
TTTPTMPGLSDPVAFIKDFAAGGISAAISKTAVAPIERVKLLLQVQHISKQIAEADRYKGMVDCFVRIPREQGFSAFWRGNLANVIRYFPTQALNFAFKDKYKQVFLGGVDKNTQFTRYFIGNLASGGMAGATSLCFVYPLDFARTRLAADVGKGAEAREFKGLGDCISKIFKTDGLVGLYRGFGVSVQGIIIYRAAYFGFYDTARGMLPNPKTTPWYVSWAIAQCVTTVAGIVSYPFDTVRRRMMMQSGRAKSEIVYKGTLHCWATIAKQEGTGAFFKGAFSNVLRGTGGAFVLVLYDEIKKVL

SEQ ID NO: 22715 - protein, 295 aa, Anopheles gambiae str. PEST
DPVAFIKDFAAGGISAAISKTAVAPIERVKLLLQVQHISKQIAEADRYKGMVDCFVRIPREQGFSAFWRGNLANVIRYFPTQALNFAFKDKYKQVFLGGVDKNTQFTRYFIGNLASGGMAGATSLCFVYPLDFARTRLAADVGKGAEAREFKGLGDCISKIFKTDGLVGLYRGFGVSVQGIIIYRAAYFGFYDTARGMLPNPKTTPWYVSWAIAQCVTTVAGIVSYPFDTVRRRMMMQSGRAKSEIVYKGTLHCWATIAKQEGTGAFFKGAFSNVLRGTGGAFVLVLYDEIKKVL

SEQ ID NO: 22716 - protein, 182 aa, Anopheles gambiae str. PEST
RHRKSRGWRKGIHTLKNCSPLVHSLAADVGKGAEAREFKGLGDCISKIFKTDGLVGLYRGFGVSVQGIIIYRAAYFGFYDTARGMLPNPKTTPWYVSWAIAQCVTTVAGIVSYPFDTVRRRMMMQSGRAKSEIVYKGTLHCWATIAKQEGTGAFFKGAFSNVLRGTGGAFVLVLYDEIKKVL

SEQ ID NO: 22717 - protein, 251 aa, Anopheles gambiae str. PEST
VDVGEAPALSLRSSSSSYMSTLSQRASDTAKMADPDEGGGLALATARTTKPPPPHRLPAIPEVPKASTGGGREQLRHCFVPADENGCLGLHLSRTPWDPYPWVSGVVDGSGADLAGVRTGDCVLEANGEDLLGLKVIDIARRVRSRRSSRSAPAGVGLLLWNSGFEKNNLNPQSLSRFANCLQGIAGLLECPICLEVIRPPSWQCNHGHLICSGCRSRTTKCPICREVLGRGRCIVADKLFHYLVQTLGHE

SEQ ID NO: 22718 - protein, 115 aa, Anopheles gambiae str. PEST
EMIETHTFPHKYKRLRRASETDEDSEKCTICLSQFEIDNDVRRLPCMHLFHKDCVDQWLVTNKHCPICRVDIEPRTSSSSTPVDGPRQYHYTAALPLVVAHLDETTLDGEGGDGT

SEQ ID NO: 22719 - protein, 383 aa, Anopheles gambiae str. PEST
IENIMSGIENTGAVKMNNHRKKLRQRLVPSEGSKQSSFFSIFLFDIIKKLGQGTYGKVQLGINKETGQEVAIKTIKKSKIETEADLIRIRREVQIMSSVQHPNIIHIYEVFENREKMVLVMEFAAGGELYDYLSERKVLAEEEARRIFRQVSTAIYYCHKHKICHRDLKLENILLDEHGNAKIADFGLSNVFDEQRLLATFCGSPLYASPEIVKGTPYQGPEVDCWSLGVLLYTLVYGAMPFDGANFKRLVKQISQGDYFEPKKPSRASPLIREMLTVCPSHRANIEQICNHWWVNEGYEESCLDLAEELANQTPVRLDVLLSLAPPSVTADQLLVGNGQEDAKAKDRIQRSHSMGSIVEMGGTEAERRILDMVAAGGEAALM

SEQ ID NO: 22720 - protein, 347 aa, Anopheles gambiae str. PEST
MAGRGTHDNNRYGDRARKPLPTEPPYLAYVGNLPNGVVQGDINAIFKEYAVKSVRLVKDKETDVFKGFCYVEFDTLEDLEKVLQLDGMIVLNDRPEPLRIDVAEQKKNDRGGFNRRGGQQNRGGPGGPGNGGGGGGGGGGGFNRGGPNQMNNRPIGSGGGGGGGVGGGGGGNRAPNRGRYGNFGDERDGGGRDEWSRDNDRDGGRDGRGGAGGGGRYNDRDNYGRDDGNRYGNYGRNNQYRDNDRRKDAAPSNYPPPSNPNLNMEERPRLKLAPRSTNAPLNALAETKQSAAIFGNARPREEKLGGPETGRKHANSVGSEGSSADGGGSGGGGGGNSASSSATGGDN

SEQ ID NO: 22721 - protein, 962 aa, Anopheles gambiae str. PEST
DCTAVAKDEETMLVFSTLGGGLTAIDPLTGETRWSIADEPAIRVPAPSDTSAHYLPDPRDGSLYRMNGLEGGLKKLPYTIPQLVASAPCRSSDGILYSGKKSDVWFLIDPKTGQREKVLGFGGAPPQAASKDADGTDSIGWATSRAVYLGRTQYTVMMYDSLATDRNSKPWNVTFFDYSAHSMAPELTKEYEFLHLTSSSSGLTATFEQNKGTPMWQKDLSSPVVAVFLLGSEGLLSVPFQTVSDEVLQEINERAESGNFDDMKLFETVYIGEAGNNLYAIPSLVDKNTATLPSEPSINLLGGPLKRRPASSPSSSAALSENNQDDTPGRGLISKASRLGGKNENIIILGHYQTPKTDDSIKLDIAPSGPASMGKEHELEYGETNETNSMKLQGSTDFIRALFSRLYMDTKLWLDAQPNKLPTILLITLFGLVVFGFYYINLQMKALKEQSQQGSQTSNSNRSSGGSGGSGSGSYSEPMDFGDGEMRVGKINFNTQNVLGKGCEGTFVFRGMFEKREVAVKRILPGCFTLADREVTLLRESDAHENVVRYFCTEQDRQFRYIAVELCAATLQDYVDGKGTSTVVAANTVTVGLLRKKISALDILRQATSGLMHLHSLSIVHRDIKPQNILLSLPDNRQRVRAMISDFGLCKKLNYGKASFSRRSGVTGTDGWIAPEMQRGQRATTSVDIFSLGCVFYYVLSDGFHPFGDNLKRQANILSDEFDLGMLRRENSQPDCRTILAEELVTDMIRSEPGKRPSAKAVSRHPLFWNNGRILAFLQDVSDRVEKLEVMTEPLRSLEKNARFVVREDWSRYLDAEITADLRKFRGYQGYSVRDLLRALRNKKHHYHELTPSMQSALGTIPHQFTQYWISRFPRLLSHSYHALADCSREPIFRPYYNEDEETENASGAVPSLSSGYKFTKPSYFKEENNDNYELIRYYENAQQMKNATKSPKRRPPAGADG

SEQ ID NO: 22722 - protein, 411 aa, Anopheles gambiae str. PEST
SDKENDHGFVRVYPGKLQVENAYVIIPVDNDTTVKDLICESLKKFGLQSHQIEDYRCSEILLDRGVTERVLSWNERPWEIMKQLGKDSIRQMELMRFYLQLKQDPHGPNLALFVGNLPPGLSQRNYEHILTEFLGFENKFSSIGPIYYEYGSLVITYENASKAVRAFQALRESKYEEKHLLVLLLPNIEPSMVPAGVQPLLVFVNVKSGGCQGLELISSFRKLLNPYQVFDLDNGGPLPGLYVFRHIQDYKILVCGGDGTIGWVLQCLDNVGQDSECSSPPCAIVPLGTVVGGAQSEDNSQIFVMNNYFGIGIDADLCLDFHNAREENPNKFNSRLHNKGVYVKMGLRKMVGRKMVKELHKELRLEVDGKVVELPPVEGIIILNILSWGSGANPWGPEKEDQFSKPNHWDG

SEQ ID NO: 22723 - protein, 279 aa, Anopheles gambiae str. PEST
IFCYSVQLQHSTKMAGNFWQSSHHQQWILDKQDLIRERQHDLKTLSEEEYQKLFMFFANIIQVLGEQLKLRQQVIATATVYFKRFYARNSLKCIDPLLLAPTCILLSSKVEEFGVISNSRLITTCQTVIKNKFSYAYQQEFPYRTNHILECEFYLLENLDCCLIVYQPYRPLLQLMQDIGQEEQLLTLTWRLINDSLRTDVSLLYPPYQIAIGCLQIACVILQKELKSWFAELNVDMDKVQEIARAIVNLFELWKGYDEKKEIQALLEKMPKPKPHPQR

SEQ ID NO: 22724 - protein, 229 aa, Anopheles gambiae str. PEST
TPSEGAYRLRRCGVVCVSGLVLRPQPVSVLRVTGRCRDMQVDIGQFFAEHDIVPMLVDRAPDAFAKVVYRGKKLVDAGKELSPAEVREEPKVEWYADPTALYTLIMTDPDSPSRMEPWNREFAHWLVGNVPGRHVQNGDTLFEYIPVFPRSGVGFHRYIFLVFRQQSWNDYSQAPRASSKNRTPRIRFCTRDFARHYSLGSPVAGNFFIAQYDDYVPVILSRYPASDDY

SEQ ID NO: 22725 - protein, 624 aa, Anopheles gambiae str. PEST
KFSISSVRENCISFSFHISVCIFSCCFTWFPFHTRESAANQLRFWCVCFRFRKGATMSDDEDCPPLCDAMDARDDSNGEDDEWEVAEEQNDPVKCLFCETISPTMTVAIRHAKQQHDFDLAGVRRRFHLDEYSYIKMINYIRREKPAPEQFKTATGSSLPWADDKYLQPVENETWLMFDLDELDEIMLNNGSGGSGGAGVGGNGGVSGEKETGSDLGDTMTLTTDQYRKLQGIINDLSAQLREKENLLQHAASSIEKMKESFRNVLADQQQQQPNGKENGKAGTEEGAEGDKKLEQIKRKLEHCVSSVSVDDDQSYFNTYSHFGIHHDMLSDEVRTSSYRDAILRNADIVKDKTVLDLGCGTAILSMFASKAGAKEVISVDQSDIIYQAMDIVRKNSIENIRFVKGRLEDTELPVEKVDIIVSEWMGYFLLFEGMMDSVIYARKQYLREGGLILPNRCNISIAGYGDLERHNEFIGFWKNVYGFDMSCMKKEVLREATVEVCKPEHIITNANIIANFDLMEVDVDCPNFSYDFELKVKRDTQLTAIIGYFDTFFELPEHIEFSTSPYSRPTHWKQTIFYLEEPVPVREGQTIGGKFVCRRDPKDVRSLFINIELLNMVLKYTLN

SEQ ID NO: 22726 - protein, 804 aa, Anopheles gambiae str. PEST
LVAPLKRKPSIEKDAPQSPLHMQRTSPALDSGAGSSRSNSPHSQQPFSAAHVVGRSSQYSPSPCPTNFSDAPPIPPPRCSSTPSTPQPPNPMHLLKRMSPASVASGRNGQFGGAASQSPARGSSPIASSGNHPGLRQPIIVQNGPQVQQQLSQQMAVYTGNEPPPPYPQLGPSSPPNYLTSFHSRQSPTQSSSAQSDFRKSPSSGFYSNASIGSSSPITVQKPILQTAVAPAAPAGGVPGTSGGSGGGHPLHNNPPPPSYAVSVQAKLNKAASGYATPPPPSPSALGHEGGGGAGGSGGGGGGEDNPRKIKHQSPIPERKNLSKEKEAERSECKVKHYSPQAYKFFMEQHIENVLKSYSQRNFRIKQLESEMSKLDLPEETKIEMRKLLCQKESNYIRLKRAKMDKSMFAKIKTIGVGAFGEVTLVKKIDTTNHLYAMKTLRKADVLKRNQVAHVKAERDILAEADNEWVVKLYYSFQDKDNLYFVMDYIPGGDLMSLLIKKGIFEEDLARFYIAELTCAIDSVHKMGFIHRDIKPDNVLIDRKGHIKLTDFGLCTGFRWTHDSKYYQKNDHARQDSMEAWSKFGPDIPPPLERRKFREKNRAKAHSIVGTPNYIAPEVLMRSGYTQLCDWWSVGVILYEMLVGQPPFLANTAEETQIKVINWRQTLRIPVDAHLTPEAMDIILRLCKNEDERIGRNVDEIKSHPFFRTIDFTKDLRSQQALYEPKIKYPTDTSNFDPIDPGRLQDSSSSCDENGHGNLDEVCDSGKPFHHGFFEFTFRRFFDDECDHKITLDSSEGQAEAIYV

SEQ ID NO: 22727 - protein, 353 aa, Anopheles gambiae str. PEST
MECCLSEEAKEQKRINQEIERQLRRDKRDARRELKLLLLGTGESGKSTFIKQMRIIHGSGYSDEDKRGFIKLVYQNIFMAMQSMIRAMDLLKILYSDPANIEHAELIRSVDFETVTTFEPPYVQAIKDLWADAGIQECYDRRREYQLTDSAKYYLMEIDRVAAPNYLPTEQDILRVRVPTTGIIEYPFDLEEIRFRMVDVGGQRSERRKWIHCFENVTSIIFLVALSEYDQILFESENENRMEESKALFKTIITYPWFQHSSVILFLNKKDLLEEKIMYSHLVDYFPEYDGPQRDAIAAREFILRMFVDLNPDSEKIIYSHFTCATDTENIRFVFAAVKDTILQSNLKEYNLV

SEQ ID NO: 22728 - protein, 384 aa, Anopheles gambiae str. PEST
ANLAASMECCLSEEAKEQKRINQEIERQLRRDKRDARRELKLLLLGTGESGKSTFIKQMRIIHGSGYSDEDKRGFIKLVYQNIFMAMQSMIRAMDLLKILYSDPANIEHAELIRSVDFETVTTFEPPYVQAIKDLWADAGIQECYDRRREYQLTDSAKYYLMEIDRVAAPNYLPTEQDILRVRVPTTGIIEYPFDLEEIRFSYLSDLARIEAEDFLPTEQDILRARAPTTGILEYPFDLDSIIFRMVDVGGQRSERRKWIHCFENVTSIIFLVALSEYDQILFESENENRMEESKALFKTIITYPWFQHSSVILFLNKKDLLEEKIMYSHLVDYFPEYDDLNPDSEKIIYSHFTCATDTENIRFVFAAVKDTILQSNLKEYNLV

SEQ ID NO: 22729 - protein, 352 aa, Anopheles gambiae str. PEST
MECCLSEEAKEQKRINQEIERQLRRDKRDARRELKLLLLGTGESGKSTFIKQMRIIHGSGYSDEDKRGFIKLVYQNIFMAMQSMIRAMDLLKILYSDPANIEHAELIRSVDFETVTTFEPPYVQAIKDLWADAGIQECYDRRREYQLTDSAKYYLSDLARIEAEDFLPTEQDILRARAPTTGILEYPFDLDSIIFRMVDVGGQRSERRKWIHCFENVTSIIFLVALSEYDQILFESENENRMEESKALFKTIITYPWFQHSSVILFLNKKDLLEEKIMYSHLVDYFPEYDGPKHDDVKAREFILKVYLRENPDPDRMCYSHFTCATDTENIKLVFCAVKDTIMQTALKEFNL

SEQ ID NO: 22730 - protein, 174 aa, Anopheles gambiae str. PEST
VEQKYAIAVAEVRALLFRRCFPEFLCSVCEKFGVKTYCPTLQRQKINVVFSCVDCAPGTESTPSNMDIDEEEFEAPTSSSSRGERKRFEVKKWNAVALWAWDIVVDNCAICRNHIMDLCIECQANQASATSEECTVAWGVCNHAFHFHCISRWLKTRQVCPLDNREWEFQKYGH

SEQ ID NO: 22731 - protein, 236 aa, Anopheles gambiae str. PEST
ALLPRQQMDGIMSKGSLASLATVATVLQFLTGTVICNRYIRKKSTGDTSAFPFISGFLSCFMWLKYGVLTEESTLILVNFIGSALFFSYTVVFFIFCVNKREVIRQMMVISCIILSATLYTLFETDDEKSIRVIGLLCCCLAVLFFASPLTMLAHVIRTQNTDSLPFPIIMASFFVCLLWTAYGVLIGDRFIQIPNLLGGILAGIQLTLYVIYPKKKASFSGGPRYSPLVSENPIL

SEQ ID NO: 22732 - protein, 248 aa, Anopheles gambiae str. PEST
MSRLFGSSSGSVLGTAGSKMSSFRKVTHCIFDMDGLLLDTEKIYENILRDLLKSYNSPYPWPTRMKVMGTTEQRTCSILVNDLKLPCSVDEFLARFRRDQLLHLGRAPLMQGAERLVRHLHQHNVPIALATSSGADSVEVKTKNHRELFELFGHKVMGSSDPDVKEGKPAPDIFLVAADRFPDRPAPDQCLVFEDAPNGVTAAIAAGMQAVMVPDPHIEEDQRKHATVVLKSLEDFHPEQFGLPPFTS

SEQ ID NO: 22733 - protein, 310 aa, Anopheles gambiae str. PEST
CVVVVFSPWRKCVLYTENLYTQVTQSIAEPYGKTYTWEIKQTIMGLQRDEAAEAIVAALELPLTPAEYVEISTERINRVMEQCQLMPDTEKIYENILRDLLKSYNSPYPWPTRMKVMGTTEQRTCSILVNDLKLPCSVDEFLARFRRDQLLHLGRAPLMQGFPFFSSFVCDGIGAERLVRHLHQHNVPIALATSSGADSVEVKTKNHRELFELFGHKVMGSSDPDVKEGKPAPDIFLVAADRFPDRPAPDQCLVFEDAPNGVTAAIAAGMQAVMVPDPHIEEDQRKHATVVLKSLEDFHPEQFGLPPFTS

SEQ ID NO: 22734 - protein, 600 aa, Anopheles gambiae str. PEST
YPRSIFFIISNEFSERFNYYGMRTVLALYLTQKLAYSNDTATVIYHIFTSLAYFFPLMGAILADSWLGKFKTILYLSIVYCAGSTLIALGAIPPLNLPATSMTVLGLLFIAVGSGGIKPCVSAFGGDQFKLPEQAAQLAKFFSLFYFSINAGSLISTTLTPILREDVHCFGDNSCFSLAFGVPAVLMILAIVIFVCGRTMYTIKKPSGNMIESSTSPRAHWLDYAESKYGKGIVADIKALLKILILYIPLPVFWALFDQQGSRWTFQATRMDGELAGYTIKPDQMQVINPLLILAFIPVFESVIYPALSKIGIRRPLQKLSLGGLLAGAAFVLSGFVEIALDSTEAMLPAAHEAQLRVLQAGGAVSYFISRKGGRSSLLEYADTAAKDRNGLPRMRLLANVRTTKQISLRHNGNADVVYNVALNQYDQLTSVTEGEYGVYVGERPIATVKLSPGGVYTLILDEFLENEFVSNEYIKSIHLDQQSNSDPFPTPSRFLQTHTITPSNSVHMLWLIPQYVVITAGEVMFSITGLEFSYSQAPESMKSVIQAFWLLTVAIGNMLVVFIAEAKFVQSQSLEFFLFAALMFLDMGLFMVLAMRYRY

SEQ ID NO: 22735 - protein, 134 aa, Anopheles gambiae str. PEST
SNLTKLQLLIMSGRGKGGKVKGKAKSRSNRAGLQFPVGRIHRLLRKGNYAERVGAGAPVYLAAVMEYLAAEVLELAGNAARDNKKTRIIPRHLQLAIRNDEELNKLLSGVTIAQGGVLPNIQAVLLPKKTEKKA

SEQ ID NO: 22736 - protein, 413 aa, Anopheles gambiae str. PEST
KSEEKPANHCLPELITQFARLLRLVIWSLYEYGNATMASTTGQVIKCKAAVAWEPKQPLSIETIEVAPPKAGEVRIKVTASGVCHTDAYTLGGLDSEGVFPVILGHEGAGVVESVGEGVTKFQPGDHVIPLYIPQCFECRFCKSPKTNLCPKVRATQGKGVLPDGTTRFTCNGKQIYHFMGTSTFAEYTVVAEVSLAKIDPSAPLEKVCLLGCGIPTGYGAALNTAKVEPGSSCAIWGLGAVGLAVAMGCKAAGASRIIGVDINPAKFEIAKQFGCTEFVNPNDYKEPIQQVLVEKTDGGLDYTFECVGNVNTMRAALESCTRGWGVSVIVGVAEAGTEISTRPFQLVTGRTWKGTAFGGWKSVESVPKLVTSYLQKELKVDEFITHTMELEKINDAFTLMHEGKSIRSVVTL

SEQ ID NO: 22737 - protein, 347 aa, Anopheles gambiae str. PEST
ADSTFNRSINSIIINHNTPTTMTNVTVLDGGFATQLSVHVGKSIDGDPLWSARFNATDPNAVFRTHLDFLEAGAEAIMTNTYQASIEGYVEHLHLTEDTSLNLIKSTVRVAQMARNHFLAKGPTNEQRSVPLLVASIGPYGAHLHDGSEYTGRYAADVCADTIQKWHRPRIDACLEAGVDVLGIETIPCKMEAEALLDMLCDEYPTVRFWISFQCKDNQHLANGELFADTVNSLWAKARSRRAKNLLALGVNCVHPQIVTPLFRSVNENKLPAVRIPLIVYPNSGEVYTVEDGWQGREDCVPLEHYVPQWIDLGARFIGGCCRTYARDIQRIKQTVINHASNSNHCQ

SEQ ID NO: 22738 - protein, 656 aa, Anopheles gambiae str. PEST
AVVLLVLAQWCLLDAVVTAESTDIELDAKANKIHQIDSLNLLLYTFLLTLTVLTIWLFKHRRVSWLHETGLAVIYGLIVGAIIRYAGTTTPIIHVSVEAEPDAKFNQSLPPDTLWLKFPGNLPHGSDQPVKANKTYTYSFRGELGNVEENEIDLKATFDPEVFFNIILPPIIFHAGYSLKRKYFFRNLGAILMFAIIGTTLSAFLIGALMYGFVQLMPKLKSSFTFLDTLYFGALISPTDPLTILAIFSDMHVDVNLYALVFGESVLNDAVAIVLSGAIQNYGEHYSSNGEFEGHAFLRSLGDFFSVFAFSLLIGASMGCVTAMMTKFTRIRDFPLLESALFVLMSYSTFLIAEAAELTGVVAVLFCGICQAHYTYNNLSDDSRTRTKQIFELLNFLAENFIFSYIGVSMFTFPKHHFDPLFIFTGFMCAAIGRAVNIYPLSALLNIARKPKISWNFQHMLFFAGLRGAMSFALAIRNTVSDARQAMLTTTSLIVITTVIIQGGAANFLLNWLNIPVGVDDETEVLPYQGVRSVSKAKRCFNYRFFLSSIALYEGATTPGGTRRGHEKAVLARLWGNFDSRYMKPLLTHSRPTLLETLPVCLSPLARLLTTTEQLTQDGPTRRSDSDSDLCIDDDDRASRGGPADGTGRRNSINRV

SEQ ID NO: 22739 - protein, 177 aa, Anopheles gambiae str. PEST
SRPNTHTHTKTHTFKMPTIKLQSSDGEIFDTDVQIAKCSGTIKTMLEDLGMDEGDDEVVPLPNVNSAILRKVLQWATFHKDDPIPVEDDDSKEKRTDDISSWDADFLKVDQGTLFELILAANYLDIKGLLDVTCKTVANMIKGKTPEEIRKTFNIKNDFTPAEEEQVRKENEWCEEK

SEQ ID NO: 22740 - protein, 695 aa, Anopheles gambiae str. PEST
QVYTQTKQKKLRVLSWPNFSQQLGYRLEITYKTKMIVLRSHVLVLLGVLVVAYATRANAQSWLNTLLEQSNGTLDVSTFPGEQCLRECDNTQPRICHFSWTMEHYHVMGPACRDCAKGNHTDCYHPACITADGVERGVMSLNRKIPGPTISVCRHDLIVVDITNAMAGTSAAIHWHGLHQRATPYMDGVPFITQCPIGFGNTFRYAFLATEPGTQFYHSHSGHHKVNGHYGALIVREPKRVDPNGDLYHYDTPAHVILGSDWMHIDGEMFMPGLPSAGGIMPINLLINGKGTYHDPKKNETTQTPLEVYTVRRGARFRFRFINAASHVCPLQLQIEDHMMEVIASDSFHLQPRKVDTLVSTSGERYDFVLDANGVKDTYWVRLRSLGPCADLQLEQFAVLRYTTGPYINDAFPTRAPPTYEEPFRNVATANHPNATCGRPEFGDYCITDFQAYDTDEDVINGVPDHQLTFGFYNYPVSFESMFESNRYEHYMNIYGSVMMQGAINNISLAYPPFSLLTQPEKIRDDTFCDENNRPDSCSDRQLCTCTHRVKINLGDIVELYILDLTPSVNDLNHPFHLHGYQMFVMEMSQDRRVPITLEIAQNIARQRLLSRNTVALPPRKDTVSIPSRGYARVRFRANNPGFWLMHCHYEWHTAVGMALVLQVGETSEMVKAPADFPKCDSYTPAVGHLLQGSL

SEQ ID NO: 22741 - protein, 360 aa, Anopheles gambiae str. PEST
EFHDGAECDRICTEREAPRVCYFRWIAEHYAAMGSACGDCRWGNRSHCFHPQCITADGMERGVLALNRRIPGPTIHVCRHDLIVVDVVNHMEGLESTIHWHGAHQYDTPWMDGVPMITQCPIPNGAAFRYAFNASEPGTQLYHSHSGHQKANGHYGLFVIRSPTDINRHLYDYDLTEHHIIISDWTLDLVEKFVPGLQSSTVRMDSILINGRGRHFDEEEHELQTQAPLTVYRVKKGYRYRFRLVSSGSQFCPFQLQIEKHRMQLIATDGGAVQPTMVDTLISTSGERYDFVLSANQKPGTYWVRVRAIGFCNIERREEFAVLSYEDEAHHVPEEVLAYPKRTPPSWDDRFPSGTVSKRL

SEQ ID NO: 22742 - protein, 496 aa, Anopheles gambiae str. PEST
DRHCVPGDPPLTCHFRWKLENYATMGSACWDCRLGNRAHCFHPQCITANGLERGVFAINRRVPGPPIHVCKHDSIVVDVENQLEGLGSTIHWHGFHQKATPWMDGVPMVTQCPIPQDTTFRYQFTAVEAGTQFYHSHAGFQKANGHYGMVVVRDPSDLNQAHYDYDLSEHRIIIADWTLDMVEKWVPGIQTDSMRVDSILINGRGRYFNETTGTRADAPLTVYQVEYGKRYRFRLISSGSQYCPFQMQIQNHSMLIISTDGGTVQPQHTVDTLVSISGERYDFVLTANQPPGNYWVRVRGIGFCDQMRVEDFAILSYRTPETAIPAAGLTVEQTLAYPTEPMPTYDEPYPDGIVFNHQTAPCYTPNDTYICAADLEAYEVFRDTGLIDAVPDRTFFLGFHVIEANNSLLFSDRGTSHYATVREGFNTIGATNMISFVPPSFPLLIQPELIVDENAQFCNVSHRPAYCTDDHLCFCTHRMKVKHNDVIEIVLYDTAE

SEQ ID NO: 22743 - protein, 139 aa, Anopheles gambiae str. PEST
PSSSVRAVPVSLFYLESNPITMSKLYHGVINVADKFVPNALRPLWNHAAGPKTVFFWAPVFKWGLVVAGLSDLRRPADQLSVSQSASLAATGIIWSRYSLVIIPKNWGLFSVNVFVAGTQVLQLYRAWDFSRKAPKTAA

SEQ ID NO: 22744 - protein, 517 aa, Anopheles gambiae str. PEST
NSCVYFCSAFLCRVVCATFTSLIVEETSLNLLKMSRIMRIDENQVAGNLHEGGMKKVVAARRPVLGELGNKVLRNASQDLLGKGVEKGAALKNANPTLKNIKPRVDTRWRKADTAAAAVVVPKKVVTRSDSQKVAVEPKPSANADAVKVHVQLNKGNEVKHVALKREDSQLSLRTLAKQNRKAQPKSAPSSGTSSSDEHEIVSISKKPEKVEAHSQKLLENIENIDANDGWNPMLVAEYVNDIYNYLNELESRPGYALCENFLDGHKEITHKMRTILIDWINEVHYQFKLDIDTYHMTVSLIDRYLQTMKTVPKKKLQLVGVTAMFIASKYEELFPPEIQDFVYITDDTYQKYQILEMEKEMVRTLDFNLGKPLPTHFLRRFSKAAKASDVNHVLAKYLIELASVDYSTAHYKPSEIAAAALYISLYLFPLTCNGGNGTSAIIWTKTLEHYTHYNVKYLAPIVQRLANVIKAVPKMMDKKVKYPWLKYSSSKFQCISTHPKLKGSEIEELLNNELRC

SEQ ID NO: 22745 - protein, 515 aa, Anopheles gambiae str. PEST
NSCVYFCSAFLCRVVCATFTSLIVEETSLNLLKMSRIMRIDENQVAGNLHEGGMKKVVAARRPVLGELGNKVLRNASQDLLGKGVEKGAALKNANPTLKNIKPRVDTRWRKADTAAAAVVVPKKVVTRSDSQKVAVEPKPSANADAVKVHVQLNKGNEVKHVALKREDSQLSLRTLAKQNRKAQPKSAPSSGTSSSDEHEIVSISKKPEKVEAHSQKLLENIENIDANDGWNPMLVAEYVNDIYNYLNELESRPGYALCENFLDGHKEITHKMRTILIDWINEVHYQFKLDIDTYHMTVSLIDRYLQTMKTVPKKKLQLVGVTAMFIASKYEELFPPEIQDFVYITDDTYQKYQILEMEKEMVRTLDFNLGKPLPTHFLRRFSKAAKASDVNHVLAKYLIELASVDYSTAHYKPSEIAAAALYISLYLFPLTSNGGNGTSAIIWTKTLEHYTHYNVKYLAPIVQRLANVIKAVPKMMEKKQKSCWLKYSSSKFLKISTHSKLKGTEMDTLAEGKL

SEQ ID NO: 22746 - protein, 113 aa, Anopheles gambiae str. PEST
PFTSLISFFIMTGRGKGGKGLGKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 22747 - protein, 212 aa, Anopheles gambiae str. PEST
IETLARYMPLLLILLAKLCYDHLDGIMHFLLLLMTFYHANWVVRQEISKQKQRRVMVLLRELIIIILALLIFGFVIEWKSICLVILFMSDNLQPESLKGLLFAVCITDLILKLITIVIKIIVTLMPPRVVDYKSRSYGTVPTKEQLQACGGQCSICHDNFNSPVLLECNHIFCELCVGTWFDREQTCPLCRAKIVDDPSYRDGATTFFLQLY

SEQ ID NO: 22748 - protein, 186 aa, Anopheles gambiae str. PEST
MSDNLQPESLKGLLFAVCITDLILKLITIVIKIIVTLMPPRVVDYKSRGKVYLMIESLSQLYRAAAPIQPWLIFLFESYSGSEKMVGVILSAVYIVAKSTDLLDRVKFCRRSFVKLLQKTSYGTVPTKEQLQACGGQCSICHDNFNSPVLLECNHIFCELCVGTWFDREQTCPLCRAKIVDDPSYR

SEQ ID NO: 22749 - protein, 772 aa, Anopheles gambiae str. PEST
IVKKGRKNRLTKSWNLNVSRTNMDYANFPNLTSVYSPNREACLVLNKTKILINLYEGIPETLLLNVIAWFFLILLFTLLRQQAWDYGRLALVNSHGENKRWTQLFYAHGNVPGGGGAMNGSTETSDTLNSLSIDRGCFSWIVATFRLTKEQILTHSGPDAVHYLSFQRHLIVVMGIMTVISIAIILPINFSGTLSGDKNSFGHTTISNLEPDSPSMWAHVVFAIAYVPMVVLIMRRASGRNAFKTAPTRTIMATNISQGDCSKTIIRTYLQQLFPDVTIEDIQLAYNISSLIKAAEEYERTVEARIYCEAHRNRDAIQAQPSCFSCEKVDALEYYKDHEVQLAGEVARMRASALNEPLGIAFVTLNSAHEAQHVMLHFKPGTYREWNLSFAPAPSDIFWENLNIDTAQWYCKWATVNFALFLFLFFLTTPVIIVNQLDTLSLTKNTTTQISKISPLVSEFLPTLLLWSLSALMPVIVAYSDTWLSHWTRSRQNYLIMTKTFGYLLFMILILPSLGLTSAQALLQWTIESNDTYRWECIFLPDKGAFFVNYIITAAFIGTALELIRFPDLICYLWKLATAKSRAETPYIRKSILITFPFGIHYAWMVMVFTTSTVYSLACPLIMPFAMVYITLKHFVDKHNLFFAFAPSNMISQGSGGKIHSTAVTMTKFSVVLLLIIMAALAVVRTGQVELRAVVLILALCATLVMFACMSPIKRCTTKPLRIVELDGPAPIYVADVLINRRMVSDSPSHLSYGSDTTMNIVMNDADVSVTA

SEQ ID NO: 22750 - protein, 483 aa, Anopheles gambiae str. PEST
RMSQKVQPFLLLSLLIASTSGLFINPYEKLWHRDARFASSPNKGNNGDPLLLTPYIEQGRIAEGQKAARVEHSRIRGFESYAGFLTVDKRFNSNLYFWYFPAKANRTTAPLVLWLQGGPGASSLFGLFEENGPFRITADLQAEERPHSWYENHNLLYIDNPVGTGFSFTDSEAGYARNQVQIGEELYSAVVQFLKLFPDLQTRPFYITGESYAGKYVPALGYTIHQKNSNSSNPWVKLAGMAIGNGYSDPVNQLNYGEYLYQLGLIDGNALERFEQDEQAVAACIAKGNYRCAFEIMDDLLDGDANGGGSFFRNVSGFETYYNYLHTAEDPSDAVPLVAFLNLDETRRALHVGDQPFHDLDEANLVERYLEQDVFESVAPWIAELLQHYRIMFYNGQLDIICAYPMMVNYLQMLQFDGANYYRGVARGTLEFDGEIAAYFKLAFGLVEVLVRDAGHMVPRDQPKWAHRLITAFTHPGSVVGFV

SEQ ID NO: 22751 - protein, 441 aa, Anopheles gambiae str. PEST
TVRFSDHTLDKATKAKVTLENYYSNLITQHGERKQRQAKLEASLKDETLSESQRQEKRMQHAQKETEFLRLKRSRLGVEDFEALKVIGRGAFGEVRLVQKKDTGHVYAMKVLRKADMLEKEQVAHVRAERDVLVEADHQWVVKMYYSFQDSVNLYLIMEFLPGGDMMTLLMKKDTLSEECTQFYIVETALAIDSIHRLGFIHRDIKPDNLLLDARGHLKLSDFGLCTGLKKSHRTDFYRDLSQAKPSDFIGTCASPMDSKRRAESWKRNRRALAYSTVGTPDYIAPEVFLQTGYGPACDWWSLGVIMYEMLMGYPPFCSDNPQDTYRKVMNWRETLIFPPETPISEEARDTIVKFCCEAERRLGSQRGIEDLKLVQFFRGVDWEHIRERPAAIPVEVRSIDDTSNFDEFPDVALEIPAHPQPEGEVLKDWVFINYTFRRFE

SEQ ID NO: 22752 - protein, 223 aa, Anopheles gambiae str. PEST
KISHILLYCLIQCNIDGLTMQGDQQQFFSSGTSYPQQQPGYGIGFAPQQAGMQPGFHPSAFAPSAGSPDGYSPYDAESATVKGFDFNDQTIRRGFIKKVYSILTVLLAFGITAAVCLGLTLFAFQTKWDFTMMGGILFTAVVVLFLFGLIAMFFPGKTMQIVYSSCGALLFSFYLVYDTQIMMGGSHKFSISPEEYVFAALCLYLDVINIFLHILSIIGASRN

SEQ ID NO: 22753 - protein, 351 aa, Anopheles gambiae str. PEST
MVNIKYERVKQTTDQEGAGGGLEEEIELETNRRSDHGQYHQSNNSLHASYGHHNQYIVTTTAGGSKSYADGGGGDTRKKHAFTNRIVVTLVLIVCYFSLSIGLTFYQRHLLQHFKLPLFVVLYHLVIKLLLAAAVRAVLRCVTRKPRILLDWRTSVRKILPTGLASGIDISFSNWGLELVKISLYTMTKSTTIVFILIFAILLKLEKKSWSLGAIVVMISGGLFMFTYKSTQFDALGFSFLLFASLSSGIRWTFAQLIMQKSKLGLHNPIDMIFHMQPWMILSVLPFTIGFEGRKLLEGYDLVQQLPSAVVVDMWAKISIGAFIAFAMEVSEFMVLTNTSSLTLSVAGIFK

SEQ ID NO: 22754 - protein, 109 aa, Anopheles gambiae str. PEST
MADENENSCDKFDDVKPDKMFTLKKWNAVAMWSWDVECDTCAICRVQVMDACLRCQAESKKDTLGRQDCVVVWGECNHSFHHCCMSLWIKQNNRCPLCQQEWSIQRMGK

SEQ ID NO: 22755 - protein, 450 aa, Anopheles gambiae str. PEST
MVVGFSSAYTSPALVSMKDRNITSFEVTDQSGSWVGGIMPLAGLAGGILGGPMIEYLGRKNTILATATPFIISWLLIGCATHVAMVLVGRALSGLCVGIASLSLPVYLGETVQPEVRGTLGLLPTAFGNIGILLCFVAGKYLDWSGLAFLGAALPIPFLLLMFLIPETPRWYVSRNREDRARKALQWLRGRKADVEPELKGISKSHQDAERHASSSAMLDLLNKANLKPLLISLGLMFFQQLSGINAVIFYTVQIFQSAGSTIDEKLCTIIVGVVNFIATFIATVLIDRLGRKILLYISDVAMIITLMTLGTFFYMKNNGDDVSEIGWLPLAAFVVFVVGFSLGFGPIPWLMMGEILPGKIRGSAASVATAFNWSCTFVVTKTFADITASIGNHGAFWMFGSICIVGLLFVIVYVPETQGKSLEDIERKMMGRVRRMSSVANIKPLSFNM

SEQ ID NO: 22756 - protein, 497 aa, Anopheles gambiae str. PEST
RVSNGSKMVKILMRADTHVSFSVPIEEPVAKCTFSQVLAALSVSLGSMVVGFSSAYTSPALVSMKDRNITSFEVTDQSGSWVGGIMPLAGLAGGILGGPMIEYLGRKNTILATATPFIISWLLIGCATHVAMVLVGRALSGLCVGIASLSLPVYLGETVQPEVRGTLGLLPTAFGNIGILLCFVAGKYLDWSGLAFLGAALPIPFLLLMFLIPETPRWYVSRNREDRARKALQWLRGRKADVEPELKGISKSHQDAERHASSSAMLDLLNKANLKPLLISLGLMFFQQLSGINAVIFYTVQIFQSAGSTIDEKLCTIIVGVVNFIATFIATVLIDRLGRKILLYISDVAMIITLMTLGTFFYMKNNGDDVSEIGWLPLAAFVVFVVGFSLGFGPIPWLMMGEILPGKIRGSAASVATAFNWSCTFVVTKTFADITASIGNHGAFWMFGSICIVGLLFVIVYVPETQGKSLEDIERKMMGRVRRMSSVANIKPLSFNM

SEQ ID NO: 22757 - protein, 359 aa, Anopheles gambiae str. PEST
TETPPVPTFATTATSRMTLPSSARVYADVNSHKPREYWDYENYIVDWVNQDDYQLVRKLGRGKYSEVFEAIKMTSNEKCVVKILKPVKKKKIKREIKILENLRGGTNIITLLAVVKDPVSRTPALIFEHVNNTDFKQLYQTLSDYDIRYYLYELLKALDYCHSLGIMHRDVKPHNVMIDHENRKLRLIDWGLAEFYHPGQEYNVRVASRYFKGPELLVDYQMYDYSLDMWSLGCMLASMIFRKEPFFHGHDNYDQLVRIAKVLGTEDLFAYLDKYNIELDPRFNDILSRHSRKRWERFVHSENQHLVSPEGLDFLDKLLRYDHFERLTAREAMEHPYFAIIVNGQMPPPPTSSAKGGTN

SEQ ID NO: 22758 - protein, 294 aa, Anopheles gambiae str. PEST
IMTRHARNCTAGAVYTYHEKKKDAANSGFGTTSRRIGKDSVKSFDCCSLTLQPCRNPVITKDGYLFDKEAILTYIISKKNEYSRKMKEYEKQMKQDEEEDAAKANAELQKKLDKFISTEKNIVSNKAVTLNAEQPSTSGAISNVSLGKRKELPSFWVPSQTPAAKVSRIEKPDSKIYCPVSNKPLKAKDLIEVKFTLVKDPADKKSLIAKENRYMCAVTHDILSNSVPCAVLKPTGDVVTIECVEKIIKKDMIHPLTNEKLSESDIIPLQRGGTGFATTNEKLEAKEQKPCLQV

SEQ ID NO: 22759 - protein, 446 aa, Anopheles gambiae str. PEST
AISREESDDSTQQNNHHHLPHHHHHHHGHGHNRGGKVPFNGYTSEEYLDRLEPNGNIPADKSYSKHWNRVSDHERVHRQLSVSSDSKLLDDDIREETRVIMRPKKPPRPKSEVFLNKHDPHPRRKRFSAFGGDSPFGKSDAYIKLEQLGEGSYATVFKGYSNLTNQVVALKEIRLQEEEGAPFTAIREASLLKELKHSNIVTLHDIVHTRETLTFVFEFVNTDLSQYMERHPGGLDHRNVRLFLFQLLRGLSYCHKRRVLHRDVKPQNLLISETGELKLADFGLARAKSVPSHTYSHEVVTLWYRPPDVLLGSTEYSTSLDIWGVGCIFVEMITGMPTFPGIRDTYDQLDKIFKILGTPTEDTWPGVTHLPGYKLQMLGFFKSRKLGLSFPRLYDINEGETMATAFLQLNPDNRISADEALRHRYFASLPKKLYELPDELSIFTVE

SEQ ID NO: 22760 - protein, 323 aa, Anopheles gambiae str. PEST
LRKKKIQVIIFRLKHISPPPIQPLHYHRPQQPLTMQKYEKLEKIGEGTYGTVFKGKNRDTLEIVALKRVRLDEDDEGVPSSALREICLLKELKHKNIVRLYDVLHSDKKLTLVFEHCDQDLKKYFDSLNGEIDPDVVKSFMYQLLRGLAFCHSHNVLHRDLKPQNLLINKNGELKLADFGLARAFGIPVKCYSAEVVTLWYRPPDVLFGAKLYTTSIDMWSAGCIFAELANAGRPLFPGSDVDDQLKRIFKLLGTPEEENWPGITQLSDYKPFPLYPPTTSWSQVVPRLNSKGRDLLQKLLVCRPLLRLSAEQAMSHPYFTEN

SEQ ID NO: 22761 - protein, 326 aa, Anopheles gambiae str. PEST
MGCAQSAEERAAAARSRLIERNLKEDGIQAAKDIKLLLLGAGESGKSTIVKQMNSMLMLMYSFLLLSFSPPPQCDAKMVFDVVQRMHDTEPFSEDLLLAMKRLWSDSGVQECFCRSNEYQLNDSAKYFLDDLDRLGAKDYQPTEQDILRTRVKTTGIVEVHFSFKNLNFKLFDVGGQRSERKKWIHCFEDVTAIIFCVAMSEYDQVLHEDETTNRMQESLKLFDSICNNKWFTDTSIILFLNKKDLFEEKIRKSPLTICFPEYTGGQEYGEAAAYIQAQFEAKNKSTSKEIYCHMTCATDTNNIQFVFDAVTDVIIANNLRGCGLY

SEQ ID NO: 22762 - protein, 258 aa, Anopheles gambiae str. PEST
NSSAIETSCFQCYFPPVMATSFANFSFERLSQQMGAKLDPRLRQHLSKVYGCLAATCSTATVGSLIHLSGIWEAGLLSAFASLGLILGMVFTPDNGKNFVQRFSMLMGIGLFTGHSLGLLLEQVIYMNPAIVVTALVGTTTIFACLTASAFFAKRGKYLYLGGILMSALSTMALINLGNLFFRSYIVQDISLYLGLIVMAGFVLFDTHMIMEKHRLGSNDFIGHSLDLFYDVISIFRRLLVILAQREDNNERRKRKSN

SEQ ID NO: 22763 - protein, 428 aa, Anopheles gambiae str. PEST
MVNPKVDIVLLGALFVCTALVVHALDNGLAHRPPMGWMSWERYRCITDCSKYPDECISEALFKRMADLMVSEGYRDAGYEYVNIDDCWMADERDEDGVLQPNKERFPNGIKHLADYIHERGLKFGIYQDIGTKTCAGYPGMVGYFKLDAETFADWGVDFIKIDGCYADVELMVNDYIKFGEYMNRTGRPILYSCSWPAYQEYDGIIPDYDQLKETCNMWRNWGDIEDSHQSVVEITKYFSDHQNRIVPHHGPGHWNDPDTLILGNYGLSYDQSKSQLAVWTVMGAPLLISNDLAKVRPEIKELLLNKAIIRVNQDPLGIQGRLVKTVNKIEIWKRPIMPRVGHELTQAIAFVSRRADGAPYPLRVKLQEDVGLSNSTNIKGYKVYDLFDAKAVPLLVRAGSTFETRINPTGANLYRFVPQFGTNFISF

SEQ ID NO: 22764 - protein, 427 aa, Anopheles gambiae str. PEST
MSVSMSLVQGGAAGAPQGAILAAAAPYFQPPAVPQDVQPDRPIGYGAFGVVWAVTDPRDGRRVALKKLPNVFQSLVSSKRVFRELKMLCFFKHENVLSALDILQPPHLDFFQEIYVITELLQSDLHKIIVSPQHLSADHIKVFLYQILRGLKYLHSARILHRDIKPGNLLVNSNCVLKICDFGLARVEEPDQSKHMTQEVVTQYYRAPEILMGARHYSAAVDVWSVGCIFGELLGRRILFQAQSPVQQLELITELLGTPSLEDMRHACEGARSHMLRRAPKPRSLTALYTLSTHATHEAVHLLCQMLVFDPDKRISVIDALAHPYVDEGRLRYHSCMCKCCYTTSAGMRQYTGEFEPSATQAFDDLWERKLTSVQQVKEEMHKFIAEQLQTGRVPLCINPQSAAFKSFASSTVAHPSELPPSPHQWE

SEQ ID NO: 22765 - protein, 357 aa, Anopheles gambiae str. PEST
NQIKMGCAVSRDKEAIERSKNIDRALRADGERAASEVKLLLLGAGESGKSTIVKQMKIIHETGYSQEECEQYRPVVYSNTIQSLMAIIRAMGQLRIDFADPSKTDIARQFFTYASATEEGELTPELVALMKKLWTDPGVQQCFARSREYQLNDSAAYYLNSLDRISQPAYIPTQQDVLRTRVKTTGIVETHFSFKSIHFKMFDVGGQRSERKKWIHCFEGVTAIIFCVALSGYDLVLAEDEEMNRMIESMKLFDSICNSKWFVETSIILFLNKKDLFEEKIVRSPLTICFPEYTGSNTYEEASSYIRMKFENLNRRKDQKEIYTHLTCATDTSNIQFVFDAVSDVIIKNNLKDCGLF

SEQ ID NO: 22766 - protein, 339 aa, Anopheles gambiae str. PEST
MEYLQEAVLLGIDLLVLVVCSNQYYKLRKNCRALKDAPQLQIDDQLADRLRKEPDQKLKYAVIRGSVTPIGTALRSAMSPSVTGVLQTMTLTEHRVARAMFGFWQEEKQIIHVSANETPFRLVNGKQGVEIVSGLSAELLDMDTVYENYEPSSLTVFDHLFGLFSGVRQKGLQTTEEMLRDGSFITAVGELELDDTGVRLHPPSNGWPMFLTTATKSTLLKRLEEAKSSTLLKVILSGTISAVLIVLITRKLYKRKKQEWEEDKLRKQLEQSRATRRARMRTTGLAEEQLCVVCIVNPKEVICLPCGHVCLCENCAQKISLHCPVCRTVIETKAAAFIS

SEQ ID NO: 22767 - protein, 282 aa, Anopheles gambiae str. PEST
MASTTDIPPAVGNAPTAPLLEDLNEDTPSSSSSSTATTTTDSGKPSTSYSFSMLGADTAIPGSSSSTSYSIKRPQSGDDSIQSAAAGGSKTKTQLENDTAGGDGAGEGASTGAPSTEAGEEEKKDDSMFECNICLDTAKDAVVSMCGHLFCWPCIHQWMNGYRNTCPVCKSSISKEKVIPLYGRGGSKEDPRKTVPPRPAGQRTEPEQPHGFQSFTGDGSFHMSFGIGAFPFGFFTSTLNFGDFRGAGNVTRENTRESEEDQFLSQVFLYVALIFLAWLAMA

SEQ ID NO: 22768 - protein, 311 aa, Anopheles gambiae str. PEST
HPSHTETAEQTAETTAATTTTTTTTTTMSNKLNNPKRREVTGSSSSNSSISSVGAGDSGISADLASLFECPVCFDYVLPPILQCQSGHLVCTSCRSKLTCCPTCRGSLGNIRNLAMEKVASNVKFPCKHSNHGCTVSLVYTEKAEHEEACEFRPYLCPCPGASCKWQGSLDYVMPHLMMSHKSITTLQGEDIVFLATDINLPGAVDWVMMQSCFGHHFMLVLEKQEKYDGHQQFYAIVQLIGSRKEAENFAYRLELNGNRRRLTWEAMPRSIHEGVASAILNSDCLVFDTSIAQLFADNGNLGINVTISVV

SEQ ID NO: 22769 - protein, 717 aa, Anopheles gambiae str. PEST
ESFGHDQTPAGSWWNSHLTEPPSKNFYQATHGLLQTHPSVPSLKPVAGAPAAPGPSALPLSSRKAPTVSSAAALNSGFPSIANPNPRSPFRHLDFSTSATAELRRNPSLSAPDECARACREGEPPRICYYHFTVEYYTVLGAACQVCTPNATNTVWSHCQCVLADGVERGILTVNRMIPGPSIQVCENDRVVIDVENHMEGMELTIHWHGIWQRGTQYYDGVPFVTQCPIQQGNTFRYQWTGNAGTHFWHAHTGLQKLDGLYGSIVVRQPPSRDPNSHLYDFDLTTHIMLVSDWLHEDAAERYPGRLAVNTGQDPESLLINGKGQFRDPNTGFMTNTPLEIFTITPGRRYRFRMINAFASVCPAQVTIEGHALTVIATDGEPVHPVQVNTIISFSGERYDFVITADQPVGAYWIQLRGLGECGIKRAQQLAILRYARGPYQPASPPPTYDVGLPQGVVMNPLDAQCNVQRDDAICVSQLKNAKEIDRALLQEKPDVKIFLPFRFYLYRPEELFQPNTYNRFLVAPTGDHVISLIDEISYLSAPAPLLSQYDDINPEQFCNGDNRPADCGANCMCTHKVDIPLNAIVEVVLVDEVQQPNLSHPFHLHGYAYNVIGIGRSPDSNVKKINLKHALDLDRRGLLHRQYNLPPLKDTIAVPNNGYVVLRFRADNPGFWLFHCHFLFHIVIGMNLILQVGTHADLPPVPPNFPTCGDHLPPIN

SEQ ID NO: 22770 - protein, 244 aa, Anopheles gambiae str. PEST
SAERAVSCDRVCNRADWPRICRYELVVEKRTFRPGSTPSTDNVTLTGGSKSTEQPITVSYYTVNGRYVGPTLTVCENDFLVVDVENRIPGESITLHWTGQSQRRTPFMDGVPMITQCPIASFTRFQYKFQADRAGTHLYHGFAGSERTQGLLGAFVVRSAYEQRQSPVLSALHNDPVWLVTELNGMLGVNGQRDWTQALNGTLNLRVRLIYAVAHCQHWLELEDHRLQVLALDGNVLDHNSTPS

SEQ ID NO: 22771 - protein, 246 aa, Anopheles gambiae str. PEST
FVVSRVTQNTHAFPGHWTMESIAVALQPYKDTVGLTAAIVTVVQFFSGVLALNAIRRQGNTRGFSALPFLGGTVFCLLNIQFGQMLRDDGMIRVNFIGLALNLLYVCGFYLYTEGPAKTAVWGQIGLAGALTAGVLSYVQYEDPQLVEFRFGLILTGLLWTLVGMPLLGLGDILKKKSTEGLPFPIIFLGAVVSFAWLLYGIILRSNFLVVQNLMALALSAVQLSLFIIFPSGAAKPPPTPAKKRN

SEQ ID NO: 22772 - protein, 378 aa, Pisum sativum
ATQGQVITCKAAVAWEPNKPLTIEDVEVAPPQANEVRIQILFTALCHTDAYTLGGKDPEGLFPCILGHEAAGIVESVGEGVTDVKPGDHVIPSYQAECGECKFCKSPKTNLCGKVRAATGVGVMMADRKSRFSVKGKPIYHFMGTSTFSQYTVVHDVSVAKIHPDAPLDKVCLLGCGVPTGLGAVWNTAKVEPGSIVAIFGLGTVGLAVAEGAKSAGASRIIGIDIDSNKYDTAKNFGVTEFINPKDHEKPIQQVIIDLTDGGVDYSFECLGNVSVMRSALECCHKGWGTSVIVGVAASGQEISTRPFQLVTGRVWKGTAFGGFKSRSQVPWLVEKYLKKEIKVDEYITHNLTLLEINKAFDLLHEGQCLRCVLAVHD

SEQ ID NO: 22773 - protein, 640 aa, Anopheles gambiae str. PEST
MSIEKLVRVGYYELEKTIGKGNFAVVKLASNVITNSKVAIKIIDKTCLDEENLAKTFREISILKVLHHPHITRLYEVMESRNKIYLVTEHAAQGEIFDHLVANGRMREEEAARIFSQIVAAVDYCHRKGIVHRDLKAENVLLDTDMNVKLADFGFSNTFVEGQPLRTWCGSPPYAAPEVFQGVEYDGPKSDIWSLGVVLYVLVCGALPFDGTTLHDLRSVVVAGKFRIPFFMSQECEQLIRHMLVVEPERRYTLKQIAHHRWLAQYNSIPMLEAGDYGLGSAGGSVVRETENLDTVVMTHMLQLPGLTADMIAQSVHESRFDHIYAIYNLLVDKLRQKRKEKGRLQHHASLAYSRSRKTSITTGVVDRTEVIKNDSLERLSPLTSVGSTILNISSGLAGSEELEKYDQDTATTPTGGAPARHCHGANGAGGGGGNTRRHTVGPGDVAHEQVLVNPNVVPISFKIGPHEPPVPPTPNVPINIPSLQNQPIHNLTIKDQHLLKPPTVMGATSSFGRRASDGGANLQIYYPSSGPTSALGPISGAVNNSTLMMDHVMMLQTPNSEGTDDSNDEIQRYMHGRGCTKRHTVGCTDDLSAGNASPMEPPQAHSPAPSAGGTSGTGAGGGGRTRRTGLLTVMERPPG

SEQ ID NO: 22774 - protein, 503 aa, Gadus callarias
AQLVDSMPSASTGSVVVTDDLNYWGGRRIKSKDGATTEPVFEPATGRVLCQMVPCGAEEVDQAVQSAQAAYLKWSKMAGIERSRVMLEAARIIRERRDNIAKLEVINNGKTITEAEYDIDAAWQCIEYYAGLAPTLSGQHIQLPGGAFAYTRREPLGVCAGILAWNYPFMIAAWKCAPALACGNAVVFKPSPMTPVTGVILAEIFHEAGVPVGLVNVVQGGAETGSLLCHHPNVAKVSFTGSVPTGKKVMEMSAKTVKHVTLELGGKSPLLIFKDCELENAVRGALMANFLTQGQVCTNGTRVFVQREIMPQFLEEVVKRTKAIVVGDPLLTETRMGGLISKPQLDKVLGFVAQAKKEGARVLCGGEPLTPSDPKLKNGYFMSPCVLDNCRDDMTCVKEEIFGPVMSVLPFDTEEEVLQRANNTTFGLASGVFTRDISRAHRVAANLEAGTCYINTYSISPVEVPFGGYKMSGFGRENGQATVDYYSQLKTVIVEMGDVDSLF

SEQ ID NO: 22775 - protein, 170 aa, Anopheles gambiae str. PEST
MTNVTVLDGGFATQLSVHVGKSIDGDPLWSARFNATDPNAVFRTHLDFLEAGAEAIMTNTYQASIEGYVEHLHLTEDTSLNLIKSTVRVAQMARNHFLAKGPTNEQRSVPLLVASIGPYGAHLHDGSEYTGRYAADVCADTIQKWHRPRIDACLEAGVDVLGIETIPCKV

SEQ ID NO: 22776 - protein, 261 aa, Anopheles gambiae str. PEST
SGNSSVRWVRFCCVGDYCVMECSVKDKTIVVTGAGQGIGNELCRTLDQLGAKVIAVSRSSGPLEALKADCPRIETVQVDLSDWSATRTALAPLGKVDGLVNNAGVAVIKPFLELTEEDYDRTFAVNVKAAFNVAQILVPKMEAGASIVNVSSLAGLKAIHGHCAYSMSKAAIDGLTQNLALELGPRKIRVNSVNPTVILTRMGRDNWSDPAKADPLKAKIPLGRFGEVSEVVEPIVYLLSDRSGFVNGHMLPIEGGFLAGN

SEQ ID NO: 22777 - protein, 138 aa, Anopheles gambiae str. PEST
DGTHSEDSSCEQLLKAGTPLREQDRFLPIANITKIMKKSVPNNGKIAKEARECIQECVSEFISFITSEASDRCHMEKRKTINGEDILCAMYALGFDNYIEPLKLYLSKYKEQNIMSERQASEERGEPVQTGESSRQGN

SEQ ID NO: 22778 - protein, 91 aa, Anopheles gambiae str. PEST
PNAVAVRMKVTVKSWMGVAVWKWLANDDNCGICRMAFEGCCPDCALPGDDCPLVWGACSHCFHMHCIVKWLNSQANQQCPMCRQAWKFNDK

SEQ ID NO: 22779 - protein, 2811 aa, Anopheles gambiae str. PEST
MGTECSYDYIFIYDGDSFRSPLLGSFSGNTEPQHVIASSGSMLILLYSDTNYVLEGFRAEFSVTNCPNNCTGNGRCVDHVCVCDRGWIGSDCSLDACPERCGVGENRGTCAGDRCECSKDYLGQSCGLHRTNPAPKEWHWLSNSKNGLPPRAAHTAIYYEPADALYVFGGYNLNEVFDSMYVFRFERNQWEDEWGIRVDQNHTEPSSEEEKLLRRAQFLEEESERLSREPNFLSNVIYTLSDNRTGIGYGEGLSNGSRPTGRYGHAAAAVTDGFVVFGGKLASGELANDLWLYNVSHNGGSWFERATDSSIRPPALTRHTLTLAGEFLYVFGGAMEDGEFSSKLFRIRLVPDAPEEDAWEEVIPRGGKSLDVRMVAHTTSYQRATHSLIVYGGLVANVARFSRLSERMFAFQLDHKHWAELQYPRTALHDGYAPRERAFHTTNIIGNYLLVFGGYSHKHNKEEICYDNQMYLYHLGCHSWINPEVLGPGPGSKFRYPKKQGVFAHAAAVRRGNTLLVVGGYHGNVNGDLLAYTLPLMLVVHDDVAFAPEAACPRHTSFNECLADLECGWCSADSVCYGRTIGANCTTNLQTTRCKGICSVLGDCHSCLVHGTSTLDEGGERVRKGGQHLLHMQSIAHKLGLDRCTWCVQNARCHHKDDNYGVCGEDTPSQKPGWWGSKGTEVTKPSECTSQDKRPGLTFLKYLHPMNVSMPDAVMIVNATMADFTSPPTNTPTEQQLGGQVVARLLGFIRFPPMTDQSMALLQACVSHADAVLRTVQVLSQTRRKADHSANAPLTTLALDTMVSTNITANESVCGMVKWTDRANILVDFQAQRNSRTAGGYYGGSGGHHHHHHGHHPDLSKMSLQHFYGGVLQAFTFEFLEPYANGTACGAYSNCLECLSDSSCGWCELTGSCLSRKANESESCRRGLNWRYLTIQPAHCSNCSNFVSCEQCIGHSGNQCEWWTEDATCARKGRSEAAVRTLDQCPVPCYLRTDCSSCLNDRDRCVWCEATSQCFSFSVYTSEYQFGMCREWLDQTLPLGGPPTVEQDGTSVPMVQQCKSCASYQNCSYCLRSLSCGWCYDTDNPINGVCMQGDFNRSAQGMCERGQLLLPGATNTTEEQPVRTSWAYAQCPDVDECELRLHDCHEQAECSNTHGSYSCKCRKGFVGDGVRYCRQTCYETCVHGHCSGAPDFRCVCDLGWTGVGCSVNCACNNHSTCLQGVGRCDRCLNWTEGEFCERCSPGSFGNATTEAGCQRCDCNGHGNVALGICDAKTGECYCQDYTEGLRCEMCNRNFYGDPKDGGQCYHQCASRGVLTQVGTQGLGSFQSYRSSWSGQETRECLWIVSPQGRGGGGGGAAGGAGGTSALSTELRNAIIQIEIEPERMNVTCGENAVYVYDGLPDLTGVAQQKQLIAVFCSEDRGSWIAEARSGHLTVHFKKGPSPEQGFNAIYSVLSCAAASCQRPYLCSDDGRCVCPKGFTGPRCMMRICPSDCNEESKRGTCDNGYGRCICAPGYGGDDCSLAVKSSSVVFTELFNSYLVSDSFEHLRKTLPRFGHSLVADRRGSLWMFGGYSLSHGPLNDIRQFDTKNNTWMQVTVDSSPEDRMPQGRYYHAADIIGSRQAIYVYGGLSRNGTLDDLWQFALQTQRWSLVVPQNATRPPALAGHTLTAVGREELLLLIGGYSISDRGGGLQSSVWLFNLATGTWSVVTTHGSSPRGIYGHTAVYHAQSSAVYVYGGVRIGDSGNLAVSKRLYAFSIPTRRWTELPSFIHHGPDYVPPARYLHSAVATEHYMLVFGGRVAGNGTVSLAREEVMVAYVYRCNQWIRLAKDAEKVGGSYGHTYAQAMAQDPDGGSIYVVAGWDGSNHCRVTRIDLPADMCELWSGSKYFCRQYSGCSFCSVKGMPGEPASHCYSAGGSYHACEGYNGTISFNSGTSCDSEWIGRRTCASFITCSSCLATYPWHGEQESPCKWCPDCHPTFSCVDRTADCGMYNGCIANQTAILQDECPVGTAGGRSCLADDCEACLALSGCSWEREEQGGAAARYRCQERQDEAEPRNDTKVERCPLPCNAFRNCSTCVKHDSRSSECLWSTQLNECISQTFQPLYCSGGICGLVVSPNDPQHCPEPCASFTQCSSCLRHAYCGWCSRNGTDGDGVCTEGSVDGPANHPAGATCAAIYQTRSKAPANTTEPFGWNYFKCPPENECFNGHHNCNAKSQRCVDHLHGYECVCAPGYNSSSLGGGGSGGVCVPVCSQGCVRGTCTEPDVCRCDFGYVGANCSIQCQCNGHSNCSGADQLDRCGQCHNNTMGAQCDKCLPFYVGDPRNGGTCVPCVQYCNGQTDLCIAREQEATMRNMSRQELKRLVTEGPMADAICLGCGNYTDGDQCETCVPGYFRKSATPGKACSPCECNGHGDMCDPMTGEKCNCGNNTESDNTCSSKGKNHAFNCWSLQCTKCRDSYSGHPNNGHQCYKHITVESRMCFDAKTIDECKIKPQPLKPGQTVFFVIQPRYMNVDIRFIVDVTQGELDFYMSPTDESFIVHTNASTGDHDILLDSRYVSFPQRVAGPTLWSPLSSSTSQPDEMYPLNIKYSEEPLAGDKSSPVCGGLLNEGFHVTDRTAHDLITYVTLRQCKSILRVFGLKNRLVVTLPHTVHALGQTKFYIALRARPGSTASYGLVFFRQDQLHIHLFVFFSVFFSCFFLFLAICVLAWKAKQAADMRRARRRQVVEMLHMAKRPFGRVNLSLECPSEGGGTTPAPQRRRGRSSKHSTGGSAGSNVGPIALEPTADNYAAVGTVFVRLPGKQKAQITLALASALI

SEQ ID NO: 22780 - protein, 607 aa, Pseudomonas putida
MSDRSARLQALQNALKERILILDGGMGTMIQSYRLEEHDYRGTRFADWPSDVKGNNDLLLLSRPDVIAAIEKAYLDAGADILETNTFNATQISQADYGMESLVYELNVEGARIARQVADAKTLETPDKPRFVAGVLGPTSRTCSISPDVNDPGYRNVTFDELVENYIEATRGLIEGGADLILIETIFDTLNAKAAIFAVQQVFEEDAVELPIMISGTITDASGRTLSGQTTEAFWNSVRHAKPISVGLNCALGAKDLRPYLEELSTKADTHVSAHPNAGLPNAFGEYDETPAEMAAVVEEFAASGFLNIIGGCSGTTPGHIQAIAEAVAKYKPREIPEIAKACRLSGLEPFTIDGQSLFVNVGERTNITGSAKFARLIREENYTEALEVALQQVEAGAQVIDINMDEGMLDSQAAMVRFLNMIAGEPDISRVPIMIDSSKGEVIEAGLKCIQGKGIVNSISMKEGVEQFKHHARLCKRYGAAVVVMAFDEVGQADTAARKKEICKRSYDILVNEVGFPPEDIIFDPNIFAVATGIEEHNNYAVDFIEACAYIRDHLPHALTSGGVSNVSFSFRGNNPVREAIHSVFLFHAISNGLTMGIVNAGLLEI

SEQ ID NO: 22781 - protein, 279 aa, Anopheles gambiae str. PEST
QKSRANPLVVLHAMAELLIDPNIRGWVFLPIVVITFLVGIIRHYFSILISSQKKAELTQIQDSQAMIRARLLRENGKYLSQQSFAMRRHYFNNEDTGYFKTQKRAPPSPNSTAMLSDLVKGNFINVLPMIVIGGWINWMFSGFVTTKVPFPLTLRFKPMLQRGIELASLDAAWVSSASWYFLNVFGLRSIYTLVLGENNAADQTQSMQDQMSGAAVAMPQDPKAAFKAEWEALQITEYQNVLANVESELLASSGLAGDQTGAPSLLQSSRGEDSSALRN

SEQ ID NO: 22782 - protein, 2383 aa, Anopheles gambiae str. PEST
LKSRNKDVQNKAIKDLSLYVKTELRETPDDMFFEDFNHHIFEMLTSTDNNEKKGGILAIDCLINGDVVNTTNKISRYSNNLRNLLPMSDVCVMQLAANVLVKLALLPGSNGASSFEFDIKRAFEWLSEDRVENKRHAAVLVLRELAVAMPTFFYQQVGSFFDHIFVAIKDPKAAIREGAGQALRAVLIVTSQREGTKQNNNTQWHMNCYDQAFDSRYYDVVTDMKFFRQNSSVQESALYRALVKEKYDTICQAVLDQRSSKSPYVIQTLLAIFPRLAAFNREEFVRLHLRTVANYLLTLLRSKEKERNAAFVSLGYIAVAVEKEIEPYTKRIMELIGSALPLKDTPSKRKAPVDPSVFMCVMLLGHALKGGITHEIKEIIAPMLSTGLSPALIVCLRELCETVPQAQQEITAGLLKILSYVLMNRPLPQFIVPKSHSVVSPAFLSSLEQQPQSQPPQQQVHDTATIVLALQTLGKFSFEGCSLLQFVQRCADHFLNSEQQEIRIEAVHTCTFLLKLALQAAESNGNDVSETLTQTLSSVLEKILVVGITDVDPAVRLRVLKSLDESFDTQLAQPWFLSSLLVTIHDEVFEIRELAIIIIGRLSTINPAYVMPSLRKTMVQLLTELEHSGVSRNKEQSARMLDHLIVSTPRLVASYMRPILTILVPKLKEPDQNPSVVLNVLRAIGDLAEVIGGHHVLQKWSDELLQLLLDMLSDAGSTEKRAVALWTFGQLVSATGQVVVPYNKYPNLIDILINFLKTEQQLYVRRETIRVLGLLGALDPYKHKMNRGLIDSQTSANILISVDTKTDEHTDLSTSEMLINMSTQLDEYYPAVVISTLMKILRDPTLSNHHLSVVQAITFTFTSLGIKGVPYLSQVLPCLLRNIVTAEMSLKEYLFQQLSTLISIVKQHIIGFMDDIFELIKTFWTTGGAGVPGGGGSSSSTASAASLQPTIINLVEKIAIALGCEFKVYLPQLMPQILRVLLHDTSKDRAVTVKLLGAMRNFGNNLDDYLHLIIPAIVKLFEPLDIPLNVSITALQTINYLAEVLDFTDFSSRIVHPLVRVLDFYPELRPVALTTLCSIMIQLGRKYLVFVPLVNRVMIKHKIPSVEYTKLLTKLQNNSTLAMDDEFRIRQARNRNREISLPSDSTIKKFPVSMSDLEAMFKANRRVSKDDWLEWLRRLSIILLKESKNPALRSCATLAQNYPQLLKDLFNAAFVSCWSDLSEKLKQDLAHSLTQALTVQDLPEITQTVLNLAEFMEHCESYPLKIDSKILGERAMECRAYAKALHYKEDEFHRTDDPPQSLFESLILINNKLQQKEAAEGLLEYAGRHRSSAEEMKVQVRWYEKLHSWEQARSLYSEKLKSNPNDLESRLGEMRCLEALGEWSALNAVTTQNWDALGSEGQSKAGRLAAAAAWGLQDWDGMHRFVRCIPEDTQDGAFYRAVLAVHNEQYALAQSLIDSTRDLLDTELTAMAGESYERAYGAMVCVQMLAELEEVIQYKLIPERRETIKSMWWDRLLGGQRLVEDWQRVIQVHSLVLSPKEDIRTWLKFASLCRKNGSLKLSEKTLTMLLEYDPMENLSEPLPIDKPHVTFAYTKHLHMAGYTKEAYDHLNRFVASFSPQAFTASSGAGGQDDLKDENRRLLARCFLKLGMWQSSSTGGNLVKDHLINGILVCYSRATKHDPNWYKAWHNWAYMNFEVVQAKKQQEEYTKNPGSAAERNLIKHYAVPAVRGFFQSINLSQGNSLQDTLRLLTLWFDHAQYEEVYEALVEGMRVIDKNTWLQVIPQLIARIDTPRNLVGQLINYLLTEIGKTHPQALVYPLTVASKSAPGTRKQAAHKILNNMCEHSNTLVNQVLLISEELIRVAILWHEQWHEGLEEASRLYFGEQNVEGMFATLEPLHAMLQRGPQTLKESSFNQAYGRDLTEAQEWCKHYKNSKNTRDLNQAWDLYYHVFRRISRQLVQLTSLELQYVSPKLLACRNLELAVPGSYTPGQQLICIASIETNLTIISSKQRPRKLCIRGSNGKNYMFLLKGHEDLRQDERVMQLFGLVNTLLLNDRDTFRRNLTIQRYAVIPLSTNSGLIGWVPHCDTLHKLIRDYRDSKKTMLNIEHRIMLRMAPDYDHLTVMQKVEVFEHALDQTKGDDLAKLLWLKSPSSEQWFDRRTNYIRSLAVMSMVGYILGLGDRHPSNLMLDRLSGKILHIDFGDCFEVAMTREKFPEKIPFRLTRMLINAMEVTGIEGTYRRTCESVMNVLRRNKDSLMAVLEAFVYDPLLNWRLLDSDRLRRSKNAGDMDSVSGSMHEDSLLSYNARRDARLNELNATTGPAAGGQPSATVNVPSGVKDKLTGKDFGKAEPVAVNRQIDLLIQQATSNENLCQCYIGWCPFW

SEQ ID NO: 22783 - protein, 606 aa, Chlamydomonas reinhardtii
MAAAGLDTLRLEDSDDDFKYEEVDVMSDGEDDASEDLDAALRKLQQFTSKQEAATGPARTTEVKPGQVVKKPEVIDDFLRNFFIKMGLSRTCECFEAEWYELKATGRLDNSTTVPDVYLRNAELEDDVAGLRRELAEAKSIAGRASATWDKFRKERDFHRMHHKRVAQEKNKLLTDLRRLKEHYAKYEPTILELKKKYETLMKEKMMMSLERDKLAARVDALEQVASSPLPGAERSLGGQSTAAAGGGASGRALGATNRALTGDVPPAAGAAAAAATGRSGAVSAGPRSGWASLNAPPRRNPYADLEFPAAPVKMLSLNKTFKGHLLSVANLALHPTKPILVTASDDKTWKMWHMPGGDLIMCGEGHKDWVAGVDFHPAGTCLASGGGDSAVKIWDFEKQRCVTTFTDHKQAIWSVRFHHLGEVVASGSLDHTVRLWDLPAGKCRMALRGHVDSVNDLAWQPFSSSLATASSDKTVSVWDARAGLCTQTYYGHQNSCNGVSFNILGTQLASTDADGVVKLWDTRMTAEVATINTGKHPANKSCFDRSGQVLAVACDDGKVKAYSTTDGVLQAELAGHEDAVQAVLFDPAGQYLVSCGSDNTFRLWS

SEQ ID NO: 22784 - protein, 574 aa, Anopheles gambiae str. PEST
VHQHTAWKMDYENEKVIKFIFPDDYEELSAQDTTDVVDYLLKLGTYKAEDLKKEKVRLQDEHRQNVEQTQDLAISHYPTFIRTAESSREIYREFVATERKLDCLSDKWPKFIAACQTFQQGSADINAARRLNSLTLLRNAELLEVLEIPQLMDSCIREGKYEEALELSSYVQRLMTKHGNIPVIASINEAVEAAWHTMLMQLLTQLRTDLQLPKCLQVVGYLRRMQAFTGSELKLKFLQTRTSWLKDVLATIPSDDAQLHLTKTIEATRVHLFNIITQYRALFPDDEDTFSPVGPTMGNERMAAGDEGKIFHSWLHDQIMDFVRTLERDLASNDLVSYDTILGQCMYFGLSFSRVGIDFRALVAPVFVRVIGNRFRATMARATAQFERDIERYTLINKVPSMIRRNRQEDRTNPVDDAGSVQPPETLLDFEPLALYCNALLTMFNDLRLCAPVALATMVTEQLEGSLEQVCRGILGFYRQEQQAFAPTERECFIRLCSCFAYDLLPYLQRCVHVLFPPTTLASQLGINVLTLQKHGVTYLRQGKILEPIAYLLPDRIETVVKQVAELSVTGKEV

SEQ ID NO: 22785 - protein, 230 aa, Anopheles gambiae str. PEST
PQWLKKLSVACQGIKRKMSSSEEVSWISWFCGLRGNEFFCEVDEDYIQDKFNLTGLNEQVPNYRHALDMILDLEPEDEIDDNPNQSDLIEQAAEMLYGLIHARYILTNRGIAQMIEKYQSGDFGHCPRVYCESQPMLPLGLSDVPGEAMVKSYCPKCIDVYTPKSSRHHHTDGAYFGTGFPHMLFMVHPEYRPKRPANQFIPRLYGFKIHSLAYQIQLQAAANFKAPLRG

SEQ ID NO: 22786 - protein, 318 aa, Anopheles gambiae str. PEST
KKKRQKAPKDANAPKHPLTGYVRYMNEHREGVRQKHPNLTPIEVTKIMAEEWSKLSEERKKPYLEAAEVDKERYNKEISEYKLNNEAKAKALQNESQVAKKEDDLKQELKPTDAGKNEGKAPETSNASPSGSGTKGKQSAPKTTKKKRQKAPKDANAPKHPLTVVISSIPYVNGKVEQKVARQGDYDIPIFTEDFLDHNKTIDSELRTLRKSNIDYEQQNSVLEKHVENMENGIQKLDGEKNSLEAQNVVLENYLKKLRAALANALQGLPLASEYSGATIDNIDQYLEKLHQMADSSTQGHTLNKAKDIIRKLDLHNL

SEQ ID NO: 22787 - protein, 1396 aa, Anopheles gambiae str. PEST
LRWKRVTNPSGPQPRPRHGHRSVNIKELMVVFGGGNEGIVDELHVYNTATNQWYVPATKGDVPPGCAAYGFVVDGTRILVFGGMVEYGKYSNELYELQATKWEWKKLRPKPPESGPPPCRRLGHSFTLVGDKIYLFGGLANESDDPKNNIPKYLNDLYILEIKNNQLQWEIPTTFGESPPPRESHTAVSWYDKKQKKFWLVIYGGMSGCRLGDLWLLDTDTMSWTRPRTSGPLPLPRSLHSSTLIGNRMYVFGGWVPLVLDDVKVEKHEKEWKCTNTLACLNLETMTWEELDLDTDEENMPRARAGHCAVGIHTRLYIWSGRDGYRKAWNNQVCCKDLWYLEVERPATASRVQLVRASTHSLEVCWQAVPSASYYILEVQKIPQAPPPPPPAPVATNTTPAIVASPSGATISSPASNAGSMSPAQIVSGSIGTTTGEPALQQPRVATSPAHTVTSPVQRIVTKVQPAKPLQTAQKVLTTGSQILQQQPAQIVASSQGQSSAQTIQTAIVQTSQAQLAQLQHQPQTIRVVATGGTAISNAQQLTTGTGTPIRVLSSTGQQLRIGTAGTGTMQQAGQTAVLRTAGPGIVSGAQLQTVQQRIVSAASGNTSTTATIGGKQIILQKPVTIVSGASGAGSTGSINTVNANQAQILTLVKTSQGVTMQTVPKMSVVQKTTGTVAGSIHQPQQQIITSNLLAGTGGTVVQQATVAGTTSGQKTTVIGGNVVKLMSGSGTIGGKQILMKNSNIVQVGKVGTNATGKPTIVLTNKAGQTIRGNQQVIVVTTPQGIRTVSGTVTSSASNFVTLSSSQVLNTITTTRATNIGGATVLQAASVPTASGTVSTLNAGTGEYRSSVVGGLQAGGQKITGTQIINMPQKLVSGKSVTVQLTPSVGGQKTVTIVPSGASGTTATSGTVTGQVGGGQKILMLPNNSVSGGDDSDSQNDNLVSDNQEEQQQEVNEMEQSEEQQAHESEMLEGMDDAAVQEEQEEAHVDNASTSATAEGAEAQASAEGPVMISGEDFATEEEDGNFVGEDSQEHEEMTGVSDGIVPTGEPGDNDNANASVDEDMEDAPTASETEAANILTTIKSGEILSLHNAELLAGGSSGVGNENIIPGNINLVGAVVKTEDSNNASSTTGHLDALAEAAASATSVLPSELMGDILSSPTSNVSQASQQGASIKFLDPGTKQFTLVMQQAGADGTDESEIWHTVGIFKTVNHTVSNYVDASEWDSSIDGEMLSADNIPDLSELKRINLEPGCAYRFRVAAINSCGRGEWSDATPFKTCLPGFPGAPSAIKISKSPEGAHLSWEPPPSTTGDILEYSVYLAIKSQNATKDKVSTTAAQLAFVRVYCGSNNQCTVANQSLQTAHVDFTSKPAIIFRIAARNDKGYGPATQVRWLQ

SEQ ID NO: 22788 - protein, 124 aa, Anopheles gambiae str. PEST
MSGRGKGGKVKGKAKSRSNRAGLQFPVGRIHRLLRKGNYAERVGAGAPVYLAAVMEYLAAEVLELAGNAARDNKKTRIIPRHLQLAIRNDEELNKLLSGVTIAQGGVLPNIQAVLLPKKSEKKA

SEQ ID NO: 22789 - protein, 124 aa, Anopheles gambiae str. PEST
MSGRGKGGKVKGKAKSRSNRAGLQFPVGRIHRLLRKGNYAERVGAGAPVYLAAVMEYLAAEVLELAGNAARDNKKTRIIPRHLQLAIRNDEELNKLLSGVTIAQGGVLPNIQAVLLPKKTEKNA

SEQ ID NO: 22790 - protein, 515 aa, Anopheles gambiae str. PEST
MSEQMARMQGCSVLVLDDSDKLVNKYDHKVTVVCSYDPQGMAVRLLQEGATPPKQLEEYLVSGAGTTHLSRGHTSHMLVVGGELVLFRFASRGDCQQFRSLLHKLSGKVNSVFNLRTEDSSASQYFQFYGYLSQQQNMMQDFVRTSTYQRAIYNNAQDFQNKIVLDVGAGSGILSFFAVQAGAAKVYAVEASNMAQYAQQLVSSNNLTDRIIVIAGKIEEIDLPERVDVIISEPMGYMLYNERMLETYLHGKKWLKPDGKMYPSRGDLHVAPFTDEALYMEQYNKANFWMQTEFHGVNLVALRDAAMKEYFRQPIVDTFDIRICMAKSIRHTTNFLTADEKDLHRIQIDVEFHMLETGTCHGLAFWFDVEFAGTCSQIWLSTSPTEPLTHWYQVRCLLQTPIFVKQGQVLSGKVVLAANQRQSYDVEIDLKLEGTMISSSNTLDLKNPYFRYTGAPVAAPPGSNTTSPSEAFWSQLDAQGARNAVNLVNGITVNGLGEVDMSSTIINTNLMAIGG

SEQ ID NO: 22791 - protein, 385 aa, Caenorhabditis elegans
MTHALEWPSLSVQWLPDVAKDNSDHTIHRLILGTHTSDEQNHLLISKICMPTDDAQFDASRYDTERSEYGGFGAVNGKVEPDIRINHEGEVNRARYMPQKSNIIATKSPHADVYIFDYLKHSAVPRDNTFNPLIRLKGHTKEGYGLSWNPNKEGLILSASDDQTVCHWDINANQNVAGELQAKDVFKGHESVVEDVAWHVLHDGVFGSVGDDKKLLIWDVRTSTPGHCIDAHSAEVNCLAFNPYSEFILATGSADKTVALWDLRNLRMKLHSFESHRDEIFQVQWSPHNETILASSGTDKRLHVWDLSKIGEDQSAEDAEDGPPELLFIHGGHTAKISDFSWNPNEPWVVCSVSEDNILQVWQMADNIYNEVDEETPADVVERQQ

SEQ ID NO: 22792 - protein, 432 aa, Anopheles gambiae str. PEST
MKRATMLLATVLCIGVLPACIYSLENGLARTPPMGWLSWERFRCNTDCEGDPENCISEHLFRTMADLVVSEGYAAVGYEYINVDDCWLEKSRGPRGELVADRRRFPSGMKALANYVHAKGLKFGIYEDYGNYTCAGYPGILGFSANDAAQFASWDVDYVKLDGCYSLPIDMDHGYPEFGRNLNATGRPMIYSCSWPVYQIYAGMNPNYSSIIQHCNLWRNYDDIQDSWASLESIIDYYGNNQDAIIPNAGPGHWNDPDMLIIGNFGLSYEQSKTQMALWAIMAAPLMMSVDLRTIRPEFKAILQNRKIIAVDQDPLGIQGRRIYKHKGIEIWSRPITPIYQTYYSYAIAFVNRRTDGTPSDVAVTLRELGLISPTGYRVEDLYEEVDYGVLSPQTKIKVKVNPSGVVILRADVQPERFSKRPYNPIFYRYPN

SEQ ID NO: 22793 - protein, 531 aa, Aspergillus niger
MLFRSLLSTAVLAVSLCTDNASAAKHGRFGQKARDAMNIAKRSANAVKHSLKIPVEDYQFLNNKTKPYRVESLPDVHFDLGEMYSGLVPIEKGNVSRSLFFVFQPTIGEPVDEITIWLNGGPGCSSLEAFLQENGRFVWQPGTYQPVENPYSWVNLTNVLWVDQPVGTGFSLGVPTATSEEEIAEDFVKFFKNWQQIFGIKNFKIYVTGESYAGRYVPYISAAFLDQNDTEHFNLKGALAYDPCIGQFDYVQEEAPVVPFVQKNNALFNFNASFLAELESIHEQCGYKDFIDQYLVFPASGVQPPKAMNWSDPTCDVYDIVNNAVLDPNPCFNPYEINEMCPILWDVLGFPTEVDYLPAGASIYFDRADVKRAMHAPNITWSECSVESVFVGGDGGPEQEGDYSANPIEHVLPQVIEGTNRVLIGNGDYDMVILTNGTLLSIQNMTWNGKLGFDTAPSTPINIDIPDLMYNEVFIENGYDPQGGQGVMGIQHYERGLMWAETFQSGHMQPQFQPRVSYRHLEWLLGRRDTL

SEQ ID NO: 22794 - protein, 359 aa, Anopheles gambiae str. PEST
LRASKNCRLCFEKKAPKMLSRLACGRPFVSSALIKSALQTVPKRPQLQPVFRQYARDVKGGSSPGTSSWTSRAERMTLRERAMAPPGPNAYAIGKGAVAGGAALGLGALCFYGLGLGSGTSTLENSHLWPEFVKQRIQDTYLYFGGSLAISAASAVAVFRSPRLLSLVSRNGWMSVLATFALMIGSGMVAQSIPYSPGLGAKQLAWATHSAILGAVIAPMCFVGGAILTRAAWYTAGIVGGLSTVAVCAPSDKFLYMGGPLAIGLGVVFASSLASMWLPPTTALGAGIASLSLYGGLLLFSGFLLYDTQKIVKRAEMYPLYAPRPFDPVNSAISIYMDTLNIFIRIVTILAGGGGNRRK

SEQ ID NO: 22795 - protein, 414 aa, Anopheles gambiae str. PEST
HCTIYILGQIDVGTISRIRNTVKTAPVILANMTNENDDLSITSCDRCPRMVAFGNILLDISVELKDGKILHDFDLKPDDQREVPADKLAALVSVAVETCGNPIYNPGGSALNTCRILRALGEKNIIFCGAVGVDENGQILQQILKDCALNTCIQTLPDEMTGTCMCLISGDKRSLNANIGASLHFKKEFVSSRWCQSKIGVCKSAAHTNIDEDVRIFYIEGYFVPEKFHICTYIYEQYCKGTANLLVTNLNASYILQEFTTEMRFLVEHADLVFGNLAEFIALAQIYNCDDVDALARLLIKPYRKHNRNKILIATDGCRSVRLYYGAGSKFVAECYPVPVIQGNLVIDTTGAGDSFVAGFLYKFMNDESPTLVDCIRYGCKVAGKVIRQVGCNLPSSVPSSPSIAPSAKEGMIP

SEQ ID NO: 22796 - protein, 275 aa, Anopheles gambiae str. PEST
MGRKKKKASKPWCWYCNREFDDEKILVQHQKAKHFKCHICHKKLYTGPGLSIHCMQVHKESIDKVPNSLPNRSNIVIEIYGMEGIPPEDIREHEKQKNGNRSESEEEEPAHKKMKQAEASVSQGMMQMQNMMPPHLQAAYSINPMMSAMGGINPYMVPPGMPMMPAMMAGAQRPLFPAAAAASAATVTSASKPTFPAYSSATISAPPTTNSAISAAASGNSNNGLGGGDATKGASSSIMPNSGTATSKIVHPPEDLSLEELRARKPQYQKQIQQA

SEQ ID NO: 22797 - protein, 329 aa, Anopheles gambiae str. PEST
KTCTSRCNYQLLNRYCNREFDDEKILVQHQKAKHFKCHICHKKLYTGPGLSIHCMQVHKESIDKVPNSLPNRSNIVIEIYGMEGIPPEDIREHEKQKNGNRSESEEEEPAHKKMKQAEASVSQGMMQMQNMMPPHLQAAYSINPMMSAMGGINPYMVPPGMPMMPAMMAGAQRPLFPAAAAASAATVTSASKPTFPAYSSATISAPPTTNSAISAAASGNSNNGLGGGDATKGASSSIMPNSGTATSKIVPVSLGGPVPLMSPMMRQGLAIGPPGGGNLALLGGNMLRPGPPQMGLGPAMRIDSFGLWSDTGQIIENTFLNKPTLRKRI

SEQ ID NO: 22798 - protein, 316 aa, Anopheles gambiae str. PEST
IEPKMTETLQLRGQLLGHSGWVTQIATNPKYPDMILSSSRDKTLIVWKLTRDELSYGIPQKRLYGHSHFISDVVLSSDGNYALSGSWDKTLRLWDLAAGQSTRRFEDHTKDVLSVAFSVDNRQIVSGSRDKTIKLWNTLAECKYTIQEDGHSDWVSCVRFSPNHTNPIIVSAGWDRVVKVWNLANCKLKIDHLGHNGYLNSVSVSPDGSLCTSGGKDCRAFLWDLNDGKHLHTLEHNEIINALCFSPNRYWLCVAYGPSIKIWDLASKTMVEELKPAKNGDPPQCLSLAWSTDGQTLYAGYSDNIIRVWQVSVSAR

SEQ ID NO: 22799 - protein, 294 aa, Lycopersicon esculentum
MDQYEKVEKIGEGTYGVVYKARDRVTNETIALKKIRLEQEDEGVPSTAIREISLLKEMQHANIVRLQDVVHSEKRLYLVFEYLDLDLKKHMDSCPEFSKDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQPPLFPGDSEIDELFKIFRVLGTPNEDTWPGVTSLPDYKSAFPKWPPKDLAIIVPNVDGAGLDLLGKMLSLDPSKRITARNALEHEYFKDIGYVP

SEQ ID NO: 22800 - protein, 294 aa, Lycopersicon esculentum
MDQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSKDPRLVKMFLYQILRGIAYCHSHRVLHRDLKPQNLLIDRRTNVLKLADFGLARAFGIPVRTFTHEVVTLWYRAPEILLGSRHYSTPVDVWSVGCIFAEMVNQRPLFPGDSEIDELFKIFRVVGTPNEDTWPGVTSLPDFKSAFPKWPSKDLGTVVPNLGAAGLDLIGKMLTLDPSKRITARSALEHEYFKDIGFVP

SEQ ID NO: 22801 - protein, 354 aa, Anopheles gambiae str. PEST
MEFTDQIDPASYFDSYEDLKVHELMLTDQPRQEAYQKAILGNRALFEGKTVLDVGAGTGILSIFCAQAGASKVYAVEASNLARLARAVVEENQLQAVIEVSECKVEDFQLPEGERVDIIVSEWMGFFLLHEGMLDSVLYARDKFLKPNGLMFPDTATLYVAPCSVPSRFDRWESLSGVSMRCFGRALREQNSGNPEVLTVAPEHLLYDGHIIAWFDLMEVTTEELNSIEVKDVIVASRSGKLQGFCIWFECTFPGDGAEEQLQLSTSPSASETHWKQTVIPLPEDACEELEERDPVAFSLTMTRNKETNRRYDLQLTLLDAEKEEHHLPCECHMTKCILMKTHLEKMQVEEEQH

SEQ ID NO: 22802 - protein, 266 aa, Toxoplasma gondii
MAEEIKNLRDEYVYKAKLAEQAERYDEMAEAMKNLVENCLDEQQPKDELSVEERNLLSVAYKNAVGARRASWRIISSVEQKELSKQHMQNKALAAEYRQKVEEELNKICHDILQLLTDKLIPKTSDSESKVFYYKMKGDYYRYISEFSGEEGKKQAADQAQESYQKATETAEAELPSTHPIRLGLALNYSVFFYEILNLPQQACEMAKRAFDDAITEFDNVSEDSYKDSTLIMQLLRDNLTLWTSDLQADQQQQEGGEKPAEQADQ

SEQ ID NO: 22803 - protein, 214 aa, Anopheles gambiae str. PEST
ETASNDEVMSICRLQTRASSIFTTSIRLFSSAIAKSMEKHEVVPDVVPVAPAEVAKVTYPSGAVVSEGNVLTPTQVKDVPKVEWNADSGALYTLCMTDPDAPSRKEPTYREWHHWLVGNIPGADVAQGETLSAYVGSGPPQGTGLHRYVFLVYKQNGKLTFDEPRLTNTSADNRGGFAIRKFAEKYQLGNPVAGNFYQAEWDDYVPLLYKQLGA

SEQ ID NO: 22804 - protein, 331 aa, Anopheles gambiae str. PEST
TRRPKSIRPQSGFLRESCARKKRSKQKETVPLCGPPKPAYIPTMSKHMYSTANLSDVELKDQGNRLFSARKYDDAVNLYTKAIIKNSTNATYFTNRALCHIKMKRWETACVDCRRALDMDPNLVKGHFFLGLSLMELESFDEAIKHLQRAHDLAKEQKLNFGDDIASQLRLARKKRWNIQEEKRICQEIELQSYLNRLITEDMENRMAKLKVDDTINEETLKEKAMEIEREGENHMTELNNLFAKVDDRRRKREVPDYLCGKISFELLVDPVITPSGMTYERKDIEEHLQRVGHFDPVTRVKLTQDQLISNYSMKEVVDAFLQENEWALDY

SEQ ID NO: 22805 - protein, 324 aa, Anopheles gambiae str. PEST
QGFVKVVKNKQYFKRYQVRFRRRREGKTDYYARKRLIFQDKNKYNTPKFRLIVRLSNRDITCQIAYARIEGDRIVCAAYSHELPRYGVKVGLTNYAAAYCTGLLVARRILQKLRLDTLYAGCTDVTGEEYLVEPVDEGPAAFRCYLDVGLARTTTGARVFGAMKGAVDGGLNIPHSVKRFPGYSAENKSFNAEMHRDHIFGLHVANYMRTLEEEDEEAFKRQFSKYISLGIKADDIENIYKNAHASIRKPPSRRNPRRRSPRSGGRWPSCRSPPARRRSRSTRPTSWPRSRPTSKPKRPRRRRPFFFSSWWCIILVLPCSSPVR

SEQ ID NO: 22806 - protein, 292 aa, Anopheles gambiae str. PEST
MNVEEEVFRIQKKLGKMTSLSDGSGQEQALDLLRELQRLNIDLDILTKTRIGMTVNELRKCSKDDEVISLAKSLIKSWKRFLAGTPPSKDGSKDASKSSSKASSKSSSKSKSKAPPSSGMSSQSSNTTDAVRLKCREMLANALRVDGEPPEGCQTPEELGEELEEAIFVEFKNTDMRYKNRVRSRVANLKDPKNPSLRANFVSGAITAQRLAKMTSEEMASDEMKHLRDRFVKEAINDAQLATVQGTKTDLLKCGKCKKRNCTYNQLQTRSADEPMTTFVMCNECGHRWKFC

SEQ ID NO: 22807 - protein, 923 aa, Anopheles gambiae str. PEST
GEGEGGEHGGEHVVERYPVSQVDFSRVETPFVIGVWILSASIAKIGFHMTPKLSRIFPESCLLIVVGVIIGVLLRYATNLHVSPLTPNTFFFYMLPPIILDAGYFMPNRMFFDNIGTILLMAVIGTIFNIATIGGSLWACGQTGIFGVDLPFLHIFLFSSLIAAVDPVAVLAVFEEIHVNEVLYIVVFGESLLNDAVTVVMYHMFEVYNEIGASEIIAVDIVSGIASFFVVALGGTIIGVIWGFLTGLVTRFTDHVRVIEPIFIFVMAYLAYLNAEIFHMSGILAITFCGITMKNYVEQNVSHKSHTTIKYALKMLSSSAETIIFMFLGVATVNNKHVWNTWFVLLTIIFCSVYRILGVLILSALANRFRIHKLTKVDQFVMSYGGLRGAVAFALVLLVDVNHIPLQPMFLTTTIAVVYFTVFLQGITIKPLVKILNVKRSSKRKPTMNERIHERFMDHMMAGIEDIVGKTGNYNIRDKFKRFDNRFIRPLLIKNLQGPEPKILETYSKLTMRDAMDYMRRNPSTIGQMSGTESMSALFRNYTSYFGGSPSFTNLENSTRNLDMQELDYNPSKKDLTDAKIHHLLSEELKPYRRHRRLSYSRHAVDDRDLSTQVNYKMQMNIRRMISEKKHHKRSKRVKDGKQQNHVSFPEFVQNGSAKQFANDYINEVLHEDNEDEERQAAGPSEDWDGGGLTFTAKSSLDERGAAKEDKRFSRESRFLESEQRVATPTAIESVLPWKRVDESDDNGAIKQNEFPSWASNKEYLAYNSPSATFLGGLTQPKQAKSVIGLFRRESSGSGGVVIGGVTDSETSTPVAATTPVGRMAAVPKDKRSASIAGYITIDGGDTAGNPMLDPLGISRAGPHATAFPVTASHRRNNRRGSMLELSGEAIPEENYTKSLPERDKYGARRAPALIKASSTNTP

SEQ ID NO: 22808 - protein, 1217 aa, Anopheles gambiae str. PEST
TAVKLGVMDVPKALQDGEKFIKWDEDSCNGTPVTLRVDVKGFFLYWVDQNHEMDMLDIATIRDVRTGQYAKKPRDMKLRQIVTMGSQDTLEEKTVTVCYGADFVNVNFINFCCTRKEIARLWCDELIRMAYNLTQLNGPAIMFLQKAYTKLCLQVDKSGKIPVKNIIKTFATNKDDRRRVEKALDVSGLPSGKGDTLALTKFQFEDFFNLYKNLSQRTEVEKVYDELVGTSKRRLMSTSQLVDFLNKTQRDPRLNEILHPYANTARARDLIQEYEPNKFNAQKGKLSFDGFLRYLMSEDNPIMAASKLDLSDDMDQPMAHYFINSSHNTYLTGHQLTGKSSVEIYRQSLLAGCRCVELDFWNGRTEEPVIVHGYTFVPEICAKDVLEAIAETAFKTSEFPVILSFENHCNPRQQAKIANYCREIFGDMLLDRPLDSHPLESNVELPPPALLKRKIIIKNKKKHHHHHHHHHKKAATVVSSPQQPPPPAGTTVVANNVSNSNSTAANAHATAVNNSSANNEPNGTVVVSNNNGTAAPLQATGNGEIPHHAPPLQQIRQSSKESTGSSDTDSSSDDESMPGTVVGPIGASEADKVPQTKETEAGAEISALVNYVQPVHFSSFENSEKKARFYEMSSFDEKQATTLLKERPIEFVNYNKHQLSRVYPAGTRFDSSNFMPQLFWNAGCQLVALNYQTLDLAMQLNLGIFEYNHRCGYILKPEFMRRKDRRLDPFAESTVDGIIAGTVMVTVISGQFLTDKKVGTYVEVDMFGLPADTVRKKFRTKIVRDNGINPVYDEEPFVFKKVVLPELASIRIAAYEEGGKLIGHRVLPVIGLCPGYRHLTLRTEVGQPIPLATLFLCIVVKDYVPDGLSDFAEALANPIKYQSEQEKRSKQLAVLQEDMEPSDEDSCNDAEAPLEAITKMVALPVAQSSSLDHSNVPAAKISTTSREPTTTGGGGGGSGAPIITTTTNTPNVATGEGLNAANGGKIVADPLEKIFEDKQIRKKREALEKELKALKKSHDKEKLKIHAAQKSTDLGGGDAPVKKSKFGMGNKLVKRFSSKNMADMNVKVPPCASVSDAEGTGDAQAERLRQICRDHAGSYREVLEKYHDIIYTLAEDLLRQSQDAQMKQLKTQLERETSEVMRQLQLSRKSEVKQLAMVHKDKDELERMKREVDSTLVEKGVTERVRLTATYERKRDELQRQHDSVKQGLEDHKLKVR

SEQ ID NO: 22809 - protein, 340 aa, Anopheles gambiae str. PEST
SVAIMTQQGPAFDSNCMTLTRFVLQEQKKYKHATGDLSQLLNCIQTAIKAISSAVRKAGIAKLQGISGDTNVQGEQVKKLDVLSNEIFINMLKSSYATCLLVSEENDNVIEIETDKRGKYVVSFDPLDGSSNIDCLVSIGSIFAITKQVKENTTPSEQDALQPGNKIVAAGYALYGSATMIVISLGNGVHGFMYDPSIGEFVLTDYNMRIPERGNIYSINEGYASTWDESVLNYVKDKKDPAKGKPYGARYVGSMVADVHRTIKYGGIFIYPATAAAKNGKLRLLYECNPMAYLVTQAGGKAYATKGKEILDVMPTSIHQRSPIYLGSKLDVEEAISYIK

SEQ ID NO: 22810 - protein, 230 aa, Anopheles gambiae str. PEST
MANPSVAIMTQQGPAFDSNCMTLTRFVLQEQKKYKHATGDLSQLLNCIQTAIKAISSAVRKAGIAKLQGISGDTNVQGEQVKKLDVLSNEIFINMLKSSYATCLLVSEENDNVIEIETDKRGKYVVSFDPLDGSSNIDCLVSIGSIFAITKQVKENTTPSEQDALQPGNKIVAAGYALYGSATMIVISLGNGVHGFMYDPSIGEFVLTDYNMRIPERGNIYSINEGYAST

SEQ ID NO: 22811 - protein, 319 aa, Anopheles gambiae str. PEST
SAVDTVTKTKVAIKKISPFEHQTYCQRTLREIKILTRFKHENIIDIRDILRVPSIEQMKDVYIVQCLMETDLYKLLKTQRLSNDHICYFLYQILRGLKYIHSANVLHRDLKPSNLLLNTTCDLKICDFGLARVADPEHDHTGFLTEYVATRWYRAPEIMLNSKGYTKSIDIWSVGCILAEMLSNRPIFPGKHYLDQLNHILGVLGSPSQEDLECIINEKARSYLQSLPYKPKVPWSRLFPNADQNALDLLGKMLTFNPHNRISVEDALAHPYLEQYYDPADEPVAEEPFRIAMELDDLPKETLKQLIFEETLRFNHNDP

SEQ ID NO: 22812 - protein, 578 aa, Anopheles gambiae str. PEST
NCAFFSISTHTHKPKSQVRATLSRQVFHCCSGFFRYILCHLCDHHHQQQEPSQSSSPCRKRTMDEKKPIPTPPGGNGTATVAADQDGDEKRVGCAHYKRRAKFVTPCCNKFYMCRYCHDENETHFFNRKTVTELICTECDTRQRVQAECEKCGVRFGRYTCLVCNLFDDEDRNQYHCDGCGICRVGGRGRFFHCEVCNMCLPLQLKYDGHRCVENVSRSNCPVCLDDIHTSRIPCHIPDCGHLLHRTCFEELLSSGHYACPTCQTSMMDMNQLWEYLDAEVAATPMPKEYANYFVDILCKDCHKESTVKFHVVGLKCTHCGAYNTCRTKTKNMNGCNSTPPPGGSSSAGASSAAGGTAQSNPAAETTTPWIRMVPLSMVESDDNAIDDSAIDDSAIDDSEDERLVDRLDTYLQQVTPGGDDGASTSAASSSSSNSSSGSSSSSSSSVPSSSTMVSTVSVGQQQQQHRPAQRLNNGTSNGSRSDACSSSGLGISYPRHGGQPASGSSSSSSSSNGSSSINSSNVNGTLPAAVSSSNGRTDVAGSSSASSSSASSSPVRDDDRSTFDNSNSTSDGGAAQI

SEQ ID NO: 22813 - protein, 501 aa, Anopheles gambiae str. PEST
STIFLLRKVKKQRIVSWLTVRKVFRIVLKMAAFRIHEDLEKENRVLAPVGGKKNAILASNNGAGGLPAGKNVILHSIGIQHQQQRTMFSVLSNVQSNVANMEKTVKEGKVKNLRPGGAVLLPKSGKVSDENAVEAKQNIQVKAVKKSSVPNEPFKGFEIYDESKENVKEMCVPKKDDAILEKRAPLQELKHAELLETPMSVGENFSPMSIDKSTSIIVEEGPIPRNDRERFFEVEEYQEDILLYLKEAEKRNRPKPGYMLKQTDITHSMRTILVDWLVEVSEEYKLQGETLALAVSYIDRFLSFMSVVRAKLQLVGTAAMFIAAKYEEIYPPDVSEFVYITDDTYTKTQVLRMEQLILKVLSFDLTVPTSLYLCELSLLEADPFLTYMPSKIAAGALALARRTLDLPMWSKMLENNTGYKLVDMRDIILDLNKTHVDAVTMQQQAIQEKYKSKTYHEVASLPATEITKESFDKICATLCNSSAATLLLSNTDSELLKEMGR

SEQ ID NO: 22814 - protein, 390 aa, Anopheles gambiae str. PEST
LEEEISRIIEDEPREHPLHLLDLDDLVGKHLVWLRSMPRVTPFYAVKCNDDPAILATLAALGTGFDCASEAEMRTILALGVTPDRIIFAHPIKSVQALAFAKAHGIRRMTFDNECELEKVAREYPEAELVLRIRHDSDRVLIALGKKFGCDARGDGRVLLARAQALGVAVIGVSFHVGCGSLDADCFYHAIASARSVFDYAKDELGMRLWLLDVGGGFPGDNDKPIDQYAEAVSRALQEFFPPEQDEEVYVLGEPGRFYVGSAATLLTTVQGKKIVRDDAGQIQQMMYYINDGVFGTLFDWLSLREIKDLKRAVPLVRREREHEPAFPTTIWGPTCDSTDIVCEDVPYPEHHIGDYIVFENLGAYGMTFATNFNGFPKPTVQVYVKEHTW

SEQ ID NO: 22815 - protein, 696 aa, Anopheles gambiae str. PEST
QYVGPYRLERTLGKGQTGLVKLGVHCVLGKKVAIKIINREKLSESVLMKVEREIAIMKLIDHPHVLGLTDVYENRKYLYLVLEHVSGGELFDYLVKKGRLTPKEARKFFRQIISALDFCHSHSICHRDLKPENLLLDDKNNIKIADFGMASLQPAGSMLETSCGSPHYACPEVIRGEKYDGRRADVWSCGVILYALLVGALPFDDDNLRQLLEKVKRGVFHIPHFVPPDCQSLLKGMIEVNPEKRLTLAEINKHPWVTAGGKGELELELPMMEVVQTHVIPNASAVDTDVLNAICSLGCFKEKDKLIQELLSPHHNTEKVIYFLLLDRKRRRPAIEDEEDVLRPRNDIIEIADPPRKRLDTCRINGSSSLSYGQISEGSPLTSRRQTFNNGHRSHSGSTSGGSRRSPSSVPLSRSSYQSPTRGVVVNSSQPLSKFSDVPRRDFGRTLSVLFFLLDQLHPPSSPNAASNRHSNYSPRSSTKSQVIDSSSPVHHRANSGPAVTVGLFSETDSNNMTSSINAIPGSPILGSPQQLQAVTTGSQLWKTRLTNIKNSFLGSPKFHRRKMQISTEEVHLTPESSPELTKKSWFGNLMTTEKDETFTVLVKGKPLATVKAHLIHAFLSMTELSHSVLSPMSFRVEYKRGGTGPTMFQRHVRIQVDINTICKQGDVGDMLFAITFTLISGNIRRFRRICEHIQA

SEQ ID NO: 22816 - protein, 731 aa, Anopheles gambiae str. PEST
AAGCSTMVSTRFEVNSTPPVRYPRSIFFIISNEFSERFNYYGMRTVLALYLTQKLAYSNDTATVIYHIFTSLAYFFPLMGAILADSWLGKFKTILYLSIVYCAGSTLIALGAIPPLNLPATSMTVLGLLFIAVGSGGIKPCVSAFGGDQFKLPEQAAQLAKFFSLFYFSINAGSLISTTLTPILREDVHCFGDNSCFSLAFGVPAVLMILAIVIFVCGGAMYTIKKPSGNMIVLVFKCIGNALAVRSKESSTSPRAHWLDYAESKYGKGIVADIKALLKILILYIPLPVFWALFDQQGSRWTFQATRMDGELAGYTIKPDQMQVINPLLILAFIPVFESVIYPALAKIGIRRPLQKLSLGGLLAGAAFVLSGFVEIALDSTEAMLPAAHEAQLRVFNGLPCDYRFHTDIPNLAGFSVPSRGAYEALHVELPPGLANGTFQFRAETSEIGCVRENMTEFSGSFSLQAGGAVSYFISRKGGRSSLLEYADTAAKDRNGLPRMRLLANVRTTKQISLRHNGNADVVYNVALNQYDQLTSVTEGEYGVYVGERPIATVKLSPGGVYTLILDEFLENEFNLQTHTITPSNSVHMLWLIPQYVVITAGEVMFSITGLEFSYSQAPESMKSVIQAFWLLTVAIGNMLVVFIAEAKFVQSQSLEFFLFAALMFLDMGLFMVLAMRYRYSDTTGGASSVESIEVEQQGKKKQHDPLAISDTLSERSAKSTTYANEAYRED

SEQ ID NO: 22817 - protein, 379 aa, Anopheles gambiae str. PEST
AENTGKIILCGNATESGPKMPKFYRTEINKTEWEVPEKYQVLTPVGSGAYGQVCSAMDTEHNVKVAIKKLARPFQSAVHAKRTYRELRMLKHMNHENIIGLLDVFHPGANNTLESFQQVYLVTHLMGADLNNIIRTQRLSDEHVQFLVYQILRGLKYIHSAGIIHRDLKPSNIAVNEDCELKILDFGLARPTENEMTGYVATRWYRAPEIMLNWMHYNQTVDIWSVGCIMAELLTGRTLFPGTDHIHQLNLIMEILGTPNDEFMAKISSESARHYIKSLPKTEKRNFSDVFRGANPLAIDLLEKMLELDADKRITAEQALAHPYLEKYADPSDEPTSSLYDQSFEDMDLPVERWKELVFKEVLNFVPQQHAHIGGEPQA

SEQ ID NO: 22818 - protein, 855 aa, Anopheles gambiae str. PEST
MCEVATLTDSIQQQPPSAAPAVPLLVGIMGQTSSSGTAASNNNNNHLQHGGTARNGKKMYHRHSSVQPALASIRLLKKENSLTVGGSGAKRADTVLLQKARTESRNIDQYGLLLANGGATGTNGAAAATVPTVTAAPSCPSEATTASNDLTVLLSSGSAADVDRSVNSVTGNGGTSSREFFKSGDDTYHRTDCCYYRTMDNGYHKLPSDSYHKTTEGCYVKMTDGSFRRLDHTPGSVTDGEEDGSTVPAAAATTAAAPVQYRVRNPMMKFLKRSKSHTPATIVQLQKEKERKAAAAAPQHHRLSTIQSSEGAGGDGSPNMQMRGTPARWRSGEEHIGKYKLLKTIGKGNFAKVKLAKHVPTNKEVAIKIIDKTQLNPSSLQKLYREVRIMKMLDHPNIVKLFQVIETEKTLYLVMEYASGGEVFDYLVAHGKMKEKEARAKFRQIVSAVQYCHQKRIIHRDLKAENLLLDSEMNIKIADFGFSNEFTPGSKLDTFCGSPPYAAPELFQGRKYDGPEVDVWSLGVILYTLVSGSLPFDGATLKELRERVLRGKYRIPFYMSTDCEVLLKKFLVLNPSKRANLETIMKDKWMNMGYEDDELKPYVEPLPDLKDQKRIEALVAMGYNRQDIEDSLANTMYDDVFATYLLLGRKSTDSESDGSRSGSSLSLRNIAGNEGAAAGNSQVQSPTHRGVHRSISASSTKPSRRASSGGETLRVGPTTAVAAAAAAAAVASISSPAKARTTSSSTSTKYDPSNGSRTVGPSAGLMPRRSTTLYEKTSSTEKTNSTTDPTLTPAVNSSRQPVAFPRNVPSRSTFHSGQTRARNSTVYAGTGGNVGDSPHSGKTFLQRLTTRFSKR

SEQ ID NO: 22819 - protein, 704 aa, Anopheles gambiae str. PEST
MQMRGTPARWRSGEEHIGKYKLLKTIGKGNFAKVKLAKHVPTNKEVAIKIIDKTQLNPSSLQKLYREVRIMKMLDHPNIVKLFQVIETEKTLYLVMEYASGGEVFDYLVAHGKMKEKEARAKFRQIVSAVQYCHQKRIIHRDLKAENLLLDSEMNIKIADFGFSNEFTPGSKLDTFCGSPPYAAPELFQGRKYDGPEVDVWSLGVILYTLVSGSLPFDGATLKELRERVLRGKYRIPFYMSTDCEVLLKKFLVLNPSKRANLETIMKDKWMNMGYEDDELKPYVEPLPDLKDQKRIEALVAMGYNRQDIEDSLANTMYDDVFATYLLLGRKSTDSESDGSRSGSSLSLRNIAGNEGAAAGNSQVQSPTHRGVHRSISASSTKPSRRASSGGETLRKYCVLAGATNNHSSGTGGSGGGASERTSISSNFKRQNTIDSATIKENTARLAAQNQRPASSITKPITSVDNSSISSPAKARTTSSSTSTKYDPSNGSRTVGPSAGLMPRRSTTLYEKTSSTEKTNSTTDPTMVNRNSLTPAVNSSRQPVAFPRNVPSRSTFHSGQTRARNSTVYAGTGGNVGDSPHSGKTFLQRLTTRFSKRTNTEEPVKPRVLRFTWSMKTTSPRLPDEIMAEIRSVLDKNNCDYEQRERFVLLCVHGDPNTDSLVQWEIEVCKLPRLSLNGVRFKRISGTSIGFKNIASKIAYDLRL

SEQ ID NO: 22820 - protein, 231 aa, Anopheles gambiae str. PEST
GADVPSDAPAHCPGTQSDDAGKASACAGCPNQQLCATGPKGPDPAIALDNLSLMSIGFLLGSPDDAIIWRGPKKNGMIRQFLTEVDWGQLDYLVLDTPPGTSDEHLSATTFLKGTDGSWGAVLVTTPQEVALLDVRKEISFCKKLAIPVVGVIENMSAFVCPKCTTETRIFPARTDGGGAEQMCIEMEVPYLGQLPLDPRLTKCCDEGKDFITEFPTSPAVVALEEIVTKV

SEQ ID NO: 22821 - protein, 191 aa, Anopheles gambiae str. PEST
MKVKKNILVGCTGSVATIKLPLLVEKLLQLTEFEVEVHVIVTEHARHFFSPQDLPAAVTLHTDAEEWTSWQKRGDPVLHIELGKWADLLVIAPLDANSLAKMANGLCDNLLLCTTRAWDPTKPLLFCPAMNTRMWEHPITATQIGTLKSWGHREVPCIAKTLMCGDTGLGAMAEVDTIVSTIRDTLSMEQS

SEQ ID NO: 22822 - protein, 450 aa, Anopheles gambiae str. PEST
RQLMEAYIRQKRATPGMVQASDLQLVRPMSGVNRNGREVHAYDGPMQFMMSPTNPDQIMPTSPVGPVPTVAVGGTGPNVTATSITTTPTSPYSDSTMEKLTPSSQDSEDEESTPVDVLPLPASTKSPANGGAGGAILYDRPTVDGHHLLSHSAPISPALNNNNHTHHTNSSSGNVKSSEDSGTPPSGGGGGAPDTEGDVIGPIEQWVTQPAAQGVLYKCRITRDRKGMDRGLFPIYYLHLERDYGKKLFCLAGRKRKKSKTSNYIISCDPTDLSRQADGFVGKLRSNVFGTTFFVYDSGTKNDAAAPRLDLAVVIYDTNILGFKGPRNMTVLLPGMTEDDQRVQISSVDDQQGLLDCWKSKNMDNVVELHNKTPIWNDETQSYVLNFHGRVTQASVKNFQLVHDSDPEYIVMQFGRTADDIFTMDFRYPLCAFQAFAIALSSFDGKLACE

SEQ ID NO: 22823 - protein, 392 aa, Anopheles gambiae str. PEST
MDSCAAVEKEVEKVINKFSAINDHSQRIIGDVISLIEKLRSSIAEGNPDSKVTAGQVDVLNEALSKTKDKLHRLTTEHRDLHGTVSKVGKAIDRNFVADFTATSRTDVFQTERNVMLLNKIMAQHFYRQGMDDVADALIKESGLPAEDIVPEPYAELHRIWEAIHTGNLAPALDWAARYSAELDARNSTLEFKLHRLAFMQILNGGVQAQTDAIAYARSNFAKFVRRFEKDIQILMGTLIYLQIGIHNSPYKYLTAPEMWIETADVFLKDACQLLGINKDSPLSVIVNAGCTALPALLNLKQVMMSRQVTGIWNGRDELPIEIELEPDNRFHSIFACPILRQQSSEDNPPMKLLCGHVISRDALNKLSNGPILKCPYCPMEQCPSDAKLIYF

SEQ ID NO: 22824 - protein, 270 aa, Anopheles gambiae str. PEST
RTISYRTLVVGLGMDFTGKVVLITGASSGIGASTAKYLTNLGASCVLAARNEAKLAEVCKECAALGKATPLTVVTDVTKRADLERLLKLTIAKYGRLDVLVNNAGKGAGGSIEEADLDQFDDILDTNLRSVFALTKLALPHLLAAKGNIVNVSSVAGTNSFHNALSYCVSKAALDQFTRCTALDLAAKGVRVNSVNPAVIVTNFHKAIGMEDEAYAAYLKHCETTHPLGRVGTGEEVAASIAFLACDATASFTTGTCLRVDGGKHILTPR

SEQ ID NO: 22825 - protein, 560 aa, Anopheles gambiae str. PEST
DGGKTEPNEDTLMEEKLVEPAIESNITVSDPARDSADEPKAGEPKEATSEEVVAVESHLDEPVETPVGSTVEGAELTAEPKTVEKSVEKEVKETVDETKSTEEPEKASAPSKEPPATMEFVAPAPVGQAMDVEDQTAAPVPVAVVSIQEQIAEEQKLETEAVEKIANSSLSMLCQYSGSSDSEAEDTDASNVVGVGSKASSSSSSSSDDSDVEITKETPAMSAGGYRMQDDPILVSDAETMDTNAASSEDEEDEPIKGPIRTAGEILPHELPPIEELTITVPETECKPIGHIESIVAQIVLVQSVAGAELLNLDTVLFLDRGQRALGKIFDVIGQVNQPIYCVLFNSNQEILTKNITTGMEVFCAPRTEYTSFIILSELMRTKGSDASWMNDNEIPSYMAEHSDDEAERAAKRNRKKNAANRQQAGGAQNDDDAGSEMGDEQQQQQHNRNPRQPSPSTSRPQYQRGNGGRQFNPRYPSGTSWHHNYNPRYGQPQQFRPRFPPRNQQFQQQQQHYQHHQHQQYQQQYRQQHQQIPHMQPPPQGMVLPNPFANQGPPRQPPP

SEQ ID NO: 22826 - protein, 299 aa, Anopheles gambiae str. PEST
VLNLDDIVAKHRNWQAKLPTVAPFYAVKCNSHPTILRLLAALGCGFDCASRAELDSVLELGVTPDRIVYAHPNKSIGSIVHAKKLGVKRMTFDGSDELEKLARHYPEAELILRVRHDAAAAQLSLGRKFGCDQVRDARPLLERARELGLSVIGVSFHVGSGSMDAECFYGGIRKAIEIFRVGSTLGMKMELLDVGGGYPGANGALFDRCAYYINKALKELVPTPVAVIAEPGKYYVESAVTALVNVVSKSYEKDVDGAVVRVRYYVDDGLYDTFDWCDDQGSGPLLQEDKRGAPCVRSV

SEQ ID NO: 22827 - protein, 306 aa, Anopheles gambiae str. PEST
EEPLHVLDLDDVVRKHYGWCAQMPRVKPYYAVKCNDDPRILQTLMTLGTGFDCASKGEMERMLGYGVKPESIIFAQPAKSIPSLLYARSKQVSVMTFDGAVELEKIHQYYPEARLVHAPRLTEAKGLFEYAKTIGYEFSLLDIGGGFPGDNDKPIDRYVQAVNVAIDQFFPAESDIRIIAEPGRYYVSSAVTLVSFVDSKRVMKEKQPDGTEKTRMYYYLNDGIFGTFYCTALEGQQVVPIVRSKLTKRYDTTLWGPTCHVVDKIAEARLPELDVGDSVVFENVGAYGMVLANQFNGFPLPKVRAY

SEQ ID NO: 22828 - protein, 453 aa, Anopheles gambiae str. PEST
NSAYHIPKSHTQTVRSKAPCSKMKFLENESDKIEIVDGEVEVPAIIDQLAEQLPTDNPFYVMDIGDIVRKHQQWIEKMPRVVPHYAVKCNDTDLVCATLAALGASFDCASKGEIAKILSLGVAPERIIFANPMKPASHVRYAASNAVKTMTYDSDTELHKIKQYCPDAKLVIRIRCEAEKAQCPLGKKFGCDPVEEAPRLIKIARSLGLEVIGVSFHVGSGCADFPIYYKAISYARDLFDYAAQLGYSFSLLDIGGGFPGDTGTSIDEVAMIVNAALDTFFPDKAVRVISEPGRYYVSSAFTLVTNVQSKRVCLNARTGTIDRMMYYLNDGVYASFNSILYDHQVPQPKLIGGQAGKQYKSTLWGPTCDALDQLIETIALPELQIDDWVVFENMGAYTIPVASPFNGFELPKVYCYISRKHWEMLETLFPLQNECSLIAASRLPASYEPVACA

SEQ ID NO: 22829 - protein, 552 aa, Anopheles gambiae str. PEST
AFRLIASPSEAAGAVSNEHPNNPRLQREMRGQRKPKKITIESYRNRLLDGGPAPSDEYRGILPKSSREQTPMDEVPPPAATEILGEINFFSGNPFVEVTKGILHLFKRNERADISEGGVSKTLCLIAVPSSLNCHDILNFIAPCQKEIQHVRILRDGSPNQFMVLLEFRCVEGAIEFFKTFNGAPYNSLEPDTLCHAVWVSSVEWGLDDCCVTPQGHTELPSCPVCLERMDESVDGVLTILCNHVFHAGCLNKWGDSTCPVCRCVQTPELSEQSVCMECEGTEALWICLICGHIGCGRYQGGHAASHYRTTNHTYALQLGTNRVWDYAGDNFVHRLLQSKSDGKLVATQSPGGDDGEEKIDSMQLEFTYLLTSQLDAQRDYYEERLSRLESIICGERQKLQEDHEQAKQKTAQLEVKLHALTKEKNSLERKVSQLTSKLGTVLGELAEEKQFGKTLQANQVTWQTKFTTLEKQCTEKEQEIVELKEQVRDLMFYMEAQNTIAGSELKSELVDGTVVLPADAVAAASSISASGAFAAGTSAGGAKAKRRQRRK

SEQ ID NO: 22830 - protein, 191 aa, Anopheles gambiae str. PEST
MSDFVRDMRNHKIVPDVVPVPPESLLHVTYPGGLRVNLGNILTPTEVKHVPEVAWPEAEPDAYYALVLTDPDAPSRTAPKFREWHHWLVVNIPGMDLAKGDTLSDYIGAAPPRKTGLHRYVFLLYRQNERIYYKESRLSNRSTQGRGKFSTHKFSEKYELGLPVAGNFFQAQFDDYVPKLYRQLGHFQNAF

SEQ ID NO: 22831 - protein, 241 aa, Anopheles gambiae str. PEST
CEISVMAPASLPSARRRTATLALVSLWLCLVLDDISSASGDATTAATSNNMTTEVQQVFAQHEVIPDVIDAAPKEFAKITYPSGVTVSGGNELRPTQVKDQPRVEWTAKPDAYYTLFMVDPDAPNRQEPKFREIGHWLVGNIPGTKVEDGDHMYAFVGSGPPNGSGLHRYVFLVYEQPGGLIDFSKAPRVSNRSRNHRVNYRHREFVKQYGLGELVAGNFYQAQYDDYVPTLHAQLSSGTE

SEQ ID NO: 22832 - protein, 352 aa, Anopheles gambiae str. PEST
IIEEFRDLPATFGGEIPDSGLKVLADRADPPDGCTEMRPAPNITSKFAVVIARYNCSFEVKVRNAQQAGYAMVIVHNVGSNDLEHMSANHPQDLLIPSVFVGESAGRSIIEAYLYDHDYALVITDDIPFNISNNLIIPFAIVVGLCFIIMRVLQVLFMIIRCIRERRRRMRHRLPARVLRKIGIVKFAKGMRFDTCAICLEDFVENERLRVLPCRHAYHAICIDPWLTKNRRVCPICKRRVIVRGEARQRRYSSDSMSSTNADESTPLLNSTENSTSGSAAGVVTAPPATSSSSPVTAAVAPSGNSGAGAQTAAAAAPQRDQQQLQQNAAPDSHVMEVPPSDDDDEMLDDRN

SEQ ID NO: 22833 - protein, 1063 aa, Anopheles gambiae str. PEST
MTKKFEFNWQIPVPEPLLTGCVFDRWTEEKDNNELEPNCMFKVDEYGFFIYWKSEGREGDVIELCQVSDIRAGGMPKDMKLYNQLCNKHGENVEEKSLTICSGTDYININYQHVVCPDAATAKLWQQGLRDITHNIKMNNVCVWTNLMKHWMRLGFLVDPRGKVPVKVVARTFASGKTEKLVYQILSDLGLPSGKNDVIEKADFTFEKFYELYHKICPRNDIEELFRSITQGKANAINLDQFINFLNEKQRDPRLNEILYPLYDEKRALEIITTYEQNDEAREAKTLTKDGLIRYLMSDENAPVFLDRLDIYMDMDQPLSHYYINSSHNTYLSGRQFGGKSSVEMYRQTLLAGCRCVELDCWDGKGEDEEPIITHGMAMCTDILFKDVIYALRDTAFVTSDYPVILSFENHCCKSQQYKLAKYCDEILGDLLLKEPIPDYPLEPGAVLPPPSLLKRKILIKNKRLKPEVEKKELELFLQGEFVIEDEVKEDASAVDDGGEEAPPVQYTGSTTNVHPWLSSMVNYAQPVKFQSFDYADKKNVHHNMSSFAETTGMNLLKSQAIEFVNYNKRQMSRIYPKGTRADSSNYMPQVFWNAGCQMVSLNFQTSDLPMQLNQGKFEYNGNCGYLLKPDFMRRADRSFDPFADAPVDGVIAASCAVQVIAGQFLSDKKVGTYVEVDMYGLPSDTVRKEFRTRMVPANGLNPVYNEEPFLFRKVVLPDLAVLRFGVYDENGKLLGQRILPLDGLQGGYRHISLRTEANFPMSLPMLFCNIELKIYVPDGFEDFMDALSDPRAFMGAAKERSDNMKAMGIEETGKKDKEEAARKEEQRVTEPPLVFDPITVDSLRQEKGFQKTAKKQQKELDAVKKKHAKERAGVQKQQNAAIERLVKGKSKEEIKADPAVRKLIQEQNAQWTEMAERHKKEEWELLKQQLADQQDILRKLMETTQAAQMKQLEAKHEREIKELNSRQAKISVETSKEVANDKTLKTKGEKDRRLREKKQNNIKRFMDEKKTATIKQNREKEKLKVTHDKQLEELANDVQKLIEMYKVDEEEYKLASKYEFFA

SEQ ID NO: 22834 - protein, 502 aa, Anopheles gambiae str. PEST
KPFLNRCIRKSNPTDEVVTRTGLRNFFQEVSEDLEACHREMVWLAVTAFAFSLLTLVLLRVIPGLIVWLVLLAVVLACTAGTIWLWLRWQYEAEHLPPSAADSSRMRMNNWLYYAIAATVATLLVYLVILVMRKRIKLVVQLFKEAGKAIASMPFLLAEPILTFATIAAVIVLYVYFTVWIESAGMLVVESNNSAKYVKDSTMLFTRWYNLFAFLWFCQFVIGCQHMVIAGAVAGWFFTRNKSNLSNPIGRSYCNLLRYHLGTVALGSFVIALVQFLRAMLKLLMHSVRNPQNRVTSFLFDCCQCCLQCFERFLQYLTRNAYILTAMHGDPFCQAGRNAFRLLTNNALRVFAINSVGDFVLVLAKVFVVVATGLIGVELIQKKVGLHHPYVPLILVGIFAYLVAHCFMTVYEMTVDTIFLCFCEDCESNDGISRPYYMSRGLMEFVQNSKKALSIADKSSGGTRQSVRDGKAWMGASAKPNGGGGSPATAQQRATAISETVD

SEQ ID NO: 22835 - protein, 664 aa, Anopheles gambiae str. PEST
GVYDGKIAGLYDLEETLGSGHFAVVKLARHVFTGEKVAVKVIEKTKLDEISRAHLFQEVRCMKLVQHPNVVRLYEVIDTQTKLYLILELGDGGDLYDYIMRHEKGLSENVAREYFRQIVRAISYCHQLHVVHRDLKPENVVFFEKLGVVKLTDFGFSNKFCPGQKLETSCGSLAYSAPEILLGDSYDAPAVDVWSLGVILFMLVCGHPPFQEANDSETLTMIMDCKYTMPAHVSDGCRNLISKMLVREPEKRATLQQIALDVWLMEGSCEETPENQPLVSREQVSEEDHTLIIQKMINGKIATKEEILEALDRNEYNHITATYFLLAERKLRAHRQEEAQKRKPELTLPVSNSTRLLQNFKKNEANEDEDTQDGLLSTRLGMHLSVPRTPGTETGQTGRSRKCSIVQEEEDDEDDVHCAGHEELSTPLNRRGSRSEGRINVTVQDRIAESERLKLEAKKYQHSDSTSTTPRPVIRSQFVAARQQSQPAGNGTASGTAAAASTGNNVHRRTKFNNKSRTASCSSSDASDDDSENRKKRAHKIVDATVKPLSQRRDSHDDSSDSQDQGSNVAGGGGAGKPLIRGISGATTNGSGSTTSNGGTGGGGSGTRSGTGSSATDDKHGTSNRQKSSQPVDFRRHRGRRRPVETRLRESQSLNRITEVQESE

SEQ ID NO: 22836 - protein, 1469 aa, Anopheles gambiae str. PEST
LQEEGWKLNRTNYYQEGWLATGNVRGIVGVTFTTSHCKKNVDYPLRTNYNLRGHRSDVILVKWNEPYQKLASCDSSGIIFVWIKYEGRWSVELINDRNTPVTHFSWSHDGRMALICYQDGFVLVGSVAGQRYWSSMLNLDATITCGIWTPDDQQVYFGTTQGQIIVMDVHGAMVSQVPLGSDVGITAMAWSCEKFKMEEGEDTEPGVTNASKRSFVLAVSFQNGYIYLLKSYDDITPNQIHTGMNGELGIVMEWSNSRELLAVAGTELGSPHMTDIHGATVYNNLLKFYTESGNLLYTAKIPNSTVSVSALTWGHNDKRIFIATGTQVHIAWVSRRVASLQLFCRLKVQTSLASEALLPRLPLPGRIKALIGNLFAQTIRCCVPDLKSLREFVSRPPACSTRLHCTMIRHDDDSNQSSGTCYTLYLEFLGGLVPLLKGKRTSKIRPEFVIFDPQVDEVSTYCTYSSDSTTTTTTTKSASTSSHSTTGTNGRSDSSESDIDDDCRSPRLDRKRKTGTKKRNPSSNDRSPNQNSDSTENNEDLAYLDTLPEHVKLVEVTSNIWGTKFKIHGLAKTLPANLGQVTYKTSLLHLQPRQMKLVITELRDDFPTGPDPNFNPNIFSEDEEDQQHLLQQQQQQQQHQHHQAHQHQGQHHAQHHSNGTHHGPSLMSSARESCGASALSRKLLTESAPPIAPMSPRPNRFPSRPRRQQQHQPSALAGCSGSSSGGLARNGVPGLGPLARAESYEDDTDGGESTTVVVVSDLHSAAARTPPRQSIGYSLVSRPSSASSNQSRVAISPLYCEGSVPTLQSPKNAVAPSDIIFDRPPAGQTTLMSYSSNNDYIGSLVQVKNALVSSDHHHGRSTMSAGMPLNLNLNLDRSEAGGRSLCTNGSSSGRDSQPSSARSTPKKQNLKFIDEATDSTNGLETPTSETVGGGMHRTPTVASVMTFMPAAGSSSGTATTRIPDSITRSCSVGYLDNMTIVPGEEALSMMRRDAPYKRLVLVDKKRQKKYKRNLDELRQATRLRVDAKSKSLDSCSDILQEVPNLNRDLINLFRQMPKVSELNHYGDHSSGKDPSGAGSSSGKGGGFFDRKSNHQQQQQQQQVPGSGSECSASTSEPAPAAPSNSTPSRSVARIVTSFTDSPLFSRRNRQPKAPDADSSKPQSESNTPILLRWNANRHNRQSKADSLDSPKKHRRNGSCPGPSNESTDGGESMGTASTSSQTDEPRPGGSGGGHTGPAGLISRWRDMEEGGRQSTPPASPARLARSSPASPTPSKKSKRHQSASPIRHILNSPLLNRRQRKKQHTESSDDENGGSGGGSGSGAGVAGSAGPNHSSPSNHTDDSSGSTSAKQYRDLETFQKAQLRQKLKRGKIEPNGVASSSQSPAPVRREFVMHNKAPMWNENSQVYQLDFGGRVTQESAKNFQIEFRGKQVMQFGRIDGNAYTLDFQYPFSALQAFAVALANVTQRLK

SEQ ID NO: 22837 - protein, 2384 aa, Anopheles gambiae str. PEST
ACSPLLKAITKDELKTVVVPALQRSMLRSAEVILRAVGAIVNELELDVSDYALDLGKPLVQNLASKEETVRQEAVESLKQVALKCGTAGAIEALLKEVFAVLNGSGGKITVAELRINLLQGAGNLSYNKIPPQKVQSILPAVCDQFSKVIEAEIQEKVVCHALEMFGLWTVYHRGDIPNKIVQLFRKGMEAKAQTIRTSYLQWFLSCLHDGKLPSGADFTATLSKIVERAAQSPAQTPVVSEGVGAACILLLTNGSVCEKLKDFWNIVLDTGKSPFLSERFLSTTNAETRCYVMVICEQLLIKHRSELKGGDSAVDPLIRAATICAMSAQTKVRRYCLPLVTKIVNSEQGVPLAKCLLAELTRYAESSKIQCEGEPLEEGVPPAQALVDAIYTVCNVEGVANPDAQSLALGALLCSHHPAAVGYKAAAMYENTLATLSRISPEQILSVLVKNVTEQLNNSRMSNVTDEEYFTYLTPDGELYDKSVIPSADEQIQTAHLKRENKAYSYKEQLEELQLRRELEEKRRKEGTWKPPQLTPKQKEVIDKQREKENAIKARLKALHDTITTLISQIEGAAKGTPKQLPLFFPALLPSVLRVFSSPLAAPAMVKLYFRLKDICFGEERAELGRDIAIATIRLSKPHCDLEESWCTANLVELVSDILVALYDETIDMYNVHREEEGSKRYLLDAPAFSYTFEFLKRALTMPEAKKDESLLINGVQIIAYHAQLKGDTVDGKDLADVYHPAYMPRLEMVRLLLRLVQQHRGRVQTQAVAALLDVAESCSGREYTARADLREIDALLVALQEELDAVRDVSLRALAIMIDVLPSIADDYEFGLRLTRRLWVAKHDLSPDIKLLATGIWQDGGYEVPIVMADELMKDIIHPELCVQKAAAAALVSILVEDSSTIEGVVEQLLEIYREKVVMIPAKLDQFDREIEPAIDPWGPRRGVAIALGSISPFLTPELVKSVIQFMVRYGLRDRQEIVHKEMLAASLAIVDHHGKENVTYLLPTFEYFLDKAPSKGAYDNIRQAVVILMGSLARHLDREDERIQPIIDRLLAALETPSQQVQEAVANCIPHLIPAVKDRAPEIVKKLLQQLVKSEKYGVRRGAAYGIAGVVKGLGILSLKQLDIMSKLTQYIQDKKNFKYREGALFAFEMLCSTLGRLFEPYIVHVLPHLLQCFGDSSVYVRQAADECAKTVMAKLSAHGVKLVLPSLLNALDEDSWRTKTASVELLGSMAFCAPKQLSSCLPSIVPKLMEVLGDSHIKVQEAGANALRVIGSVIKNPEIQAIVPVLLTALEDPSSKTSACLQSLLETKFVHFIDAPSLALIMPVVQRAFMDRSTETRKMAAQIIGNMYSLTDQKDLTPYLPNIIPGLKTSLLDPVPEVRGVSARALGAMVRGMGESSFEDLLPWLMQTLTSESSSVDRSGAAQGLSEVVGGLGVEKLHKLMPEIIATAERTDIAPHVKDGYIMMFIYMPSAFPNDFTPYIGQIINPILKALADENEYVRDTALKAGQRIVNLYAESAITLLLPELEKGLFDDNWRIRYSSVQLLGDLLYKISGVSGKMTTQTASEDDNFGTEQSHKAIIRSLGADRRNRVLAGLYMGRSDVSLMVRQAALHVWKVVVTNTPRTLREILPTLFSLLLGCLASTSYDKRQVAARTLGDLVRKLGERVLPEIIPILERGLSSDQADQRQGVCIGLSEIMASTSRDMVLTFVNSLVPTVRKALADPLPEVRHAAAKTFDSLHTTVGARALEDILPSMLESLGDPDPDVAEWTLDGLRQVMAIKSRVVLPYLIPQLTAKPVNTKALSILASVAGEALTKYLPKILPALLAALAGAQGTPEEVQELEYCQAVILSVSDEVGIRTIMDTVMESTKSETPETRRAAATLLCAFCTHSPGDYSQYVPQLLRGLLWLLADSDRDVLQPSWDALNAVTKTLDSAQQIAHVTDVRQAVKFASSDLPKGGELPGFCLPKGITPLLPVFREAILNGLPEEKENAAQGLGEVIKLTSPASLQPSVVHITGPLIRILGDRFNAGVKAAVLETLAILLHKVGIMLKQFLPQLQTTFLKALHDPARLVRIKAGHALAELIVIHTRPDPLFVEMHNGIKNADDSAVRETMLQALRGIVTPAGDKMTEPLRKQIYTTLAGMLDYTEDVSRAAAAGCFGALCRWLTPDQVDDALTNHLLNEDYGDDATLRHGRTAALFVALKEYPAAIVLPKYETKICKVITGALVSDKIPVAMNGVRAGGYLLQYGMADDGAKLCTALIAPFVKSMNHSSNEVKQLLAKTCTYLARVVPAERIAPEYLKLAIPMLVNGTKEKNGYVRSNSEIALVHVLRLRDGEDFHQRCLTLLEPGARESLSEVVSKVLRKVAMQAAGKEEELDDTILT

SEQ ID NO: 22838 - protein, 7105 aa, Anopheles gambiae str. PEST
MDEKINQPSTPLRAIGEEGKAAIIVDFQESYSAVEDQTGYISVQVEGNPAPTWKFFKGITELVDGGRYKHHTDGESNTITLCIRKVKPNDEGKYKVVVSNAHGEDSADVQLYVSDASGMDFRAMLKKRKYAKWGNQEKDPDWGDLKEVEKPKPQLKKVERKQDTFSKPLVDITCKEGKDKKVVFEATFTKPNSKAKWMLRKDEIFNGSKYKFKTDGDNYTCTIFNPKVEDGGKYTLEIAGISCFAYLTVEEADPVYKFTKNLKKAEKGFLTHDCTLECAVDNSLAPISWYKGETKLENSDKYVIGKDLNGTVTLIIKNCTAEDADTYRCQIEKQTDKTETKLKILEYNYKFTKVLKSQQLFVKDTVTMACELDHVLGKVEWFKGDEKIVESDKVQIVKDGRKHKLVLKDVAKTDSGVYRCVSNADKTEAEIFVKRPNKFMKKLSDTVGNETEKLVLDIQVQDEEADVAFFLGETELKKDGRIDIINNGDGTHQLVFNKLELTDAGEIRCECGPLTSKCTLKINKKETKPKFEVPPKIETPAKVEKVVEVPFTTGESRQSKVVAKLYKDGKPVPPEDVDIVVENDKLVLKFKKTEFKDSGEYKIELANATGTEEHTTNVVFQDIPQPPQDLGCTGIYQTRCVVKWKAPENDGGAPLEKYVVERQDVFKRSGWDVIGESPGDQCKFNCNDLVSGRHYKFRVKAINKMGESEYCAMENDIIAKDPWTEPDPPRDLNIADWDKDFVDLRWKVPKSDGGAPITSYMVEYKPYTAANWKHYADVGAAELNLTIRGLTVGETFEFRVKAVNQGGASKPSNSTEPLKIRDRYVKPFIEGEGLQPITLKKGQTIRYYAQYGGEPEPEVVWEKDDILVICDSEKRKTIDVESGATTIQVRHAVRSDSGDYKLRLKNSSGEFVTVGKVLVLDVPTQPIGPIKIEKARANHVVISWQPPEDTGGCPLTGYLLEKMDVENGTWLQAGECSGDQLTFDFQHLQKGRKFEFRVKAYNKEGESTPLETLLAVKTVNPYDPPEAPGKPAVDDYGVDFVELKWEKPEKDGGRPITHYVIECKNKFLTDWTECAKTENDDCVGKVHGLKEKVVYQFRVRAVNKGGASKASEPSDNHTVKHKNLKPRIDRTNLKNITIKAGKSMIWSVDVKGEPEPEIIWSWRDDIPLTETQNIKIENGNYHTNFSIKEAKRVDTGKYKIVAQNVNGKDEETVELVVLGAPGRPQGKLEVSNVTKKGLKLKWKKPADDGGSPILEYKIEKLKNRNGKWVRCGTVTGGPEILEADITGLDEGATYKFRVIGVNAEGDGEPLESDEVVAKNPYDEPWKPGTPEIVDFDDKSVKLKWTAPKSDGGAPIQKYVIQKKDRFKDWEDVSEVDGGETSATVDGLKENTECQFRIVAVNKAGRSPESDATKSHIVKHRALKPRIDRTNLKPIVVRAGKMVHYDVNVKGEPEPEITWIFKEKPILGDDNYEIINKDYNTKFTLKDSLRKHSAVYKIQAKNEHGQDEAEVEITILSSPSRPKGPLEVKDVTKNGCKLKWKKPDDDGGKPITGYELQKYDQKVGRWVPIGKAPADAEEFDVTGLQEGQHYKFRVKAINDEGESEPLETEEYIVAKNPFDVPKAPTDVVIVDWDNQSATLEWKRPNSDGGAAITGYFIEKKEKGESKWEPAVTTSSPECRAKVVDLPEKRVYQFRVSAINKAGTGEASDPTNFHTVKHRYLRPRIDRTNLNPVTIKAGLSVQYDIDIEGEPAPTVKWFHGEKELATDADYKIDNVDYNTKFFIMRGRRNLTGKYTIVATNSQGEDRAEVEICILSKPGTPEGPLEASDIHKHGCKLKWKAPLDDGGMPIEGYEIEKLDPLTGQWIPCGQSATPEANISGLQEGKQYKFRVKAFNKEGDSEPLEMETVIIAKDPYSVPSKPGRPQPTNWSKDFVELEWAAPKSDGGAPVTEYIIQKRDKASRKWQDAATVKGDRTRGTVEDVEEGHEYEFRVVAVNRAGQSEPSDISDSVVAKMRFLAPKIDRKNLDKKILRSGQLLNVEADVTGEPAPKVTWEFKGKPVDGKEDERIKLDNEEYKTNLVIRNLKRSDAGIYKITAKNPSGTDTVDLELVVLAKPSKCMGPLKVTDVTAEGCKLAWLPPEDDGGEPIQAYIVERMDVDSGRWIQVCETRFPEADVTGLQEGKEYMLRVKAVNSEGESEPLETDTSIKAKNPYDAPSAPGKPKPTDWSRKFVMLEWKEPESDGNAPIQKYIIEKKDVNSTKWQKAMETDGPEPKAKVPDLFEGTTYQFRVKAVNKGGHSPYSPVSDPVTVKDRFAPPRIDRTTLKNITLKGGQSLRLDCKISGEPAPTKYWLLNKARVDKDSPDVRIEFEDYRAKLNISSVTRAHGGIYEIKAENASGYDEAQLTVTVLDKPTAPEGPLKVTNVHKEGCSLKWNPPLDDGGVPIEYYNVEKFDKETQRWLPVGRTHDTHMDVANLEPGQEYLFRVSAVNDEGVSEPLATDTYITAKNPFDEPGKPGTPEAYDWDKNFVELRWTPPMTDGGSPITKYIVEKRVHGTIKWIKCAEVLGNKCEAKVTELNEGEVYEFKVRAVNEAGPGIWSDHSKPITCKPRKLPPKIDRRNLKNLSVAIGEPFGFDVKISGEPAPDVDWTINDRMVTVTTTRTIDNVPYNSKFANQNPDRRDSGKYVIKATNKFGTDQVEITVTVRSKPAAPEGPLEVKDMTKDSCKLEWKKPKDDGGVPIDHYVIEKFDPDNGIWMNAGKTDGPITEFPVEGLVPGHRYKFRVKAVNPEGESEPLETAGTVVAKDSFSVPDTPSAPTVVDWSENHAVLKWPEPDDGGSPITGYIIEKKDKYSPIWEKAIETNSPNPTATVGGLVEGNEYQFRVIALNKAGPSDPSDSSRTFTAKPRFAPPKIDRRTIRDLSISAGSMLKFDVAISGEPAPKCEWRVNKAIVSGGDRRLEILNTDYNSKFILRPANRGDSGDYEITATNSSGRDHVLVQVTVTDKPGPPEGPLTASDITKETCKLKWKRPKDDGGCDIEYYQIERFDDDVKAWVPHARSVETNADINGLQDGKKYKFRVSAINAEGESKPLEMAGDFIAKNPFDEPSAPRDCKATDWGTDFVKLAWQPPVSDGGSPITGYVVEVKDKYGEWERKMTAPADATAATVPDLLEGQKYEFRVRAVNDAGPSDPSNATPPIVCKPRNQPPKIDRTNLVEVRIKAGNNVVFDVKVSGEPVPTTRWSISKREVKPTDRYKLQNYDYSTKLTIRSATREESGTYQLDAENENGKDTATVQVTVLDVPSPPGGPLKVVEITANTAVLEWRPPSDDGGLPIDNYIIEKLDEVKGTWVYAGDSGSARCRAEVDGLIEGHTYKFRVRAANKMGKSEPLSMANSVLAKNPYRAPDRPEQVTIKDYDRDYVELEWKAPENDGGSPITGYVVEKLGKYSSDWEKAVEVPEGDVTSVKVPDLIEGTAYQFRVRAINRAGEGDPSRPTESHIARSKNQPPKIDRNYLSNVKIRAGLTFEFDVPVSGEPVPAKEWSHKDNMIINTDRIKVVYENYRTKLRVIDVKRADSGVYTLTAKNKNGIDIANVNVTILDVPAPPEGPIRHENLSKTGVTLMWRPPKDDGGSEILHYVVEKLDTDALRWVPVGETISTKIRPDNLIEGHSYQFRVRAVNKQGESTPLVTSQPITAKDPYNKPDKPGKPVVVDWSDHHVDLEWSIPKKDGGAPITSYIVEKRPRYGDWKFAGEFTELYKPAAKVLELTKDEEYEFRVCAVNKAGVSDPSEPSEPVVCKSRFVSPHFNKNALKDLVVPVGKKIAYNISVEASPQVTAVWKRNGAVIPESQRVIREVYNNEVSLEIPFSVRDDSGMYTLIVKNECGEYSASANVTVLDKPAPPEGPLRITNITTEGCRLEWKLPKDDGGSPITHYVIEKMDMSRGTWTNAGMSTSLVNEISRLIHNKRYSFRVKAVNEIGESEPLDCSHPIVAKNDYEEPSQPPKPEVRDWDANSVTIGWNPPKSDGGATITEYIVQKKEKDSPYWSNAGRVPGIKRDLQIPDLATETEYEFRVIAVNAAGESEPSDATDAVLTRSRFIAPKIVTPMRDMVVKAGLIFHLDINFTGEPVPEVVWTLNGKPVQTDKRTTMTALGHHTIVHTVNCNRGDSGTYKLVVSNSSGTDEGSFNLTVLDRPDPPQGPTVYEEITEKSVTISWKPPLDNGGSELTGYVVEKKDLTHGGGWVPAVAYVSPKYTHTVVPRLNKGNKYEFRVMAENLQGRSDGLMSAHPVVAKDQFVVPGPPTKPDIIDSGYEQITLSWKPPISDGGSRISGYIIERRDLATGRWIQANKYPVPNIEYTDTGVIKGHQYEYRVSAVNQAGQGNPSDSSVKCWARPMQQAPALNMDSFSKRTIKVRAGEPIVITIPLVGAPLPTVEWSRAGTKIPETSRVSIDTNMEQTVFRVDNSNRNDSGTYKIKAANQYGEDVKEFEVIVVDRPQPPKYVSGLETTQDSVTLNWDAPSDDGGSEITGYSIEYKEFPSDNWKMVYGTVPRCSHTVKHLTENHEYVFRVRAENIYGASEPTESKPISPKSPDPPEAVDKPTVADYTPSSCTITWRPPRVQTRPVVGYYVEKRERGTGEWVQVNNYPTTNTTYTIPDLMEGFRYEFRVKTVNEVGVSKPSEPTDPITASHQRKRPNQPDPPSIDKITRNSVNLSWRTLRRDAKEKIRGYIVQYRVKDDEKWVDANAPTELIADQAYRVENLEEGKEYQFRLIAVNEIGQSEPSRPSITVTLAEQPNKPMMDLSNVRDITVRAGEDFNIHVPYTAFPKPVATWFVNEELLDDRDKRFHTQLTEEAASIVVVKSVRADTKQYRLMLKNPSGYDIATCNVKVLDRPSRPENIGVESYGGEHLVLCWNAPLDDGGSPVTNYVVEKKDKNSNAWTKVSSYCTTTYLKIRNLRLNQLYDFRVYAENKYGLSEPAQADSIVAKHPFDPPSQPGTPSRVETTEDTITITWTKPASNGGSPVTHYIVEKKLATEGHWSKVQQGTLKDLMCKVSGLSENHEYVFRVAAVNAAGTSPFSNPSDPIMVSAAFTAPKITSDIGMRDILVIARDPFKIIVPYTATPKPDAIWMVNGNEVSRNDRIELSINDTEAIFKNDNSKRIDSGSYTIHLVNCVGKDTASCRVLVVDKPSPPIGPLEVSEITPESCTLSWKTPLDDGGSPITNYIVERYEPLGYWTKASSFVRSTHYDNMGMEANKPYNFRVRAENQYGVSDPLILEEPIVARYPFTVPDPPNPPRVSDWDANYVTVTWERPLMDGGSRIQGYRFEYRDVLEGTWITNNFLIKDNSYQVYNLLPGREYEFRVRAQNAAGVSKPSASSKKFKIHGKITPPTAPGAPAVVKVGKSFVDLSWTPPASDGGSRILGYYVERRDIGGARWVKCNESNIPVTEMTVTNLIEGGVYEFRVYAVNNYGVSPPSAETRSVRIGEQLNTEKPEWVKRLKFNLVPLGKSVELTCEAHGKPEPTCRWLRNGKEITHGGQYALESKNGVFSLHISNVTYRDEGDYTCEALNFVGVIHTTGALKIGVPPKLVNIPSDVYLVKGDNAKIKLGFHGDQPMEVNISKDREKLVETEHIKYTVFDDYAVIYIRDVLDTDKGVYLVNFKNDSGSVSCNVNVHVTGLPGPPTGPLLVSHVTKNMCTVSWKPPAHDGGRKVTHYIVERRDIKSQHWLIVSNYVKESQLIIKGLIEGSEYLFRVSAVNENGIGPALEGVDPIKARGPYDLPSAPGVPIIHEVGGDFVNLEWEKPVSDGGARIQGYWIEKREQDTDTWQRVNTTLCVICTINCANLVEGRHYEFRVAAQNEIGVSEFSKASQLVKVEDPDVVKPPEVVKPLNTLTCVQNRGVEFVCKITGVPRPRITWHKGAREICSGSRYHMYSDGDTHHLAINDVFGEDADEYTCRAANRGGVRSTKASLIIKSPPKLNVPPRFRDTAFFDNGENIEIKIPFTGFPKPRCHWTLKGEQIESGSHYHIETRERHTVLTIRDGSQLDSGTYTITIENELGQDTADIKIQISDRPDKPRNLTIDQIGLDHVTLSWLPPSWDGGASITNYIVEKREVPLSTWIRAGTTRFNQLIIPHLSPGHQYEFRVFAENVYGRSEPSDQTELISLKDLGIKPAKRVKYELDEHGKPKRQGKKEAISDYDDYVFDVYSKYHPKPVEISNKCVYDQYEILEEIGTGAFGVVHRCRERKTGNVFAAKFIPVSTNAERELIRREIDIMNQLHHRKLIYLHDAFEDEDEMVLIYEFLSGGELFERITTEGYRMCEQEIIEYMKQICEAVKYMHERNIIHLDIKPENVMCQTRNTNQVKLIDFGLATKLNPNEMVKISTGTAEFAAPEIVEREPVGFYTDMWAVGVLAYVLVSGLSPFAGETDIDTLKNIKQGTWEFDEVAFRDVSEECKDFIRRLLIKNTEKRMTAHECLSHAWLSDTYNSSTSVISIERYKQIRDLIRRKYENWASFVLPLGRLSEYSALRKLLIQKYKIHETSVDRRQAAPRFVIRPQSAFCYEGQSCKFYCRVIGVATPVLTWYHNNQELKQSVKFMKRYAGDDYYFIINRVKLDDRGEYIIRAENHYGSREEVIFLNVHPMSKQVPIYKPETLTIRKREPSPRPFWQEEADSAPSFTFALRPRVMQLRDTCKLLCCVTGKPMPSVKWYKNGRELSKYEYTMTHTDGVVTMEIIDTKVEDSGEYKCVAVNPLGKAETSCVVIVEDHRIEQQMAAKPEVKKPSIKKPEPSKTSASGSRLGAPTNEARSRNSTRELMPLQSDSLMHPPEFTKQLKDVIAADGEPLQLNCHVNGDPLPQIVWTKDGKKLSSSDVIDIKYKSGIASLRINELFPEDSGVYLCTAKNSMGEASTQCKLDVKKGPTSTSRPEGKGIPIKPPVIKKHAESGYYKDGSEVFVSCSINCADPFSVIWLHDNREIKNSADFEYLSDGDIHTLHIAEIFPEDAGTYTCEAFNKGGESFSSCTITVLAQDDQKDKPTFAKFPASLSVLDGAKAVFSCETYEAPSKLQWYKDGEPINESSNRYRFVKKDNKYTFTVAKCSFEDIGQYQVRVVTRAGDALASFSLNVSA

SEQ ID NO: 22839 - protein, 444 aa, Anopheles gambiae str. PEST
IVAANSTCLLCCSCIARRAEVIRYPVLLPGVSPSDKPLKMLNIPNEKVRGHQRIPSDTKEFHEATKRDALMRLKKDLDHLLETVEESRKTGVQKEMCGFEALYHRFLQEDGPSVEWDRIEKLPEEAVKDYSTLKLPQEAHIRDMLDKLVVVKLNGGLGTSMGCHGPKSVIPVRNDLTFLDMTVQQIEFLNKKYNANVPLVLMNSFNTDVDTEKVIRKYKGFQVQIYTFNQSCYPRISRDSLLPIAKDFDIENDIEAWYPPGHGDFYQSFQNSGLLRKFLEEGREYCFLSNIDNLGATVDIKILNRLIGDDRQGDKPIEFVMEVTDKTRADVKGGTLIHYENKLRLLEIAQVPKEHVDDFKSVKTFKFFNTNNIWARLESIERVLNAKTMNMEIIVNNKTLDNGIRVIQLETAVGAAMKCFDGGIGINVPRSRFLPVKKTSDLLL

SEQ ID NO: 22840 - protein, 538 aa, Anopheles gambiae str. PEST
YRAGKINEQLIVKQCDTFNPRYRMTGAIDLLLSVSVRGHQRIPSDTKEFHEATKRDALMRLKKDLDHLLETVEESRKTGVQKEMCGFEALYHRFLQEDGPSVEWDRIEKLPEEAVKDYSTLKLPQEAHIRDMLDKLVVVKLNGGLGTSMGCHGPKSVIPVRNDLTFLDMTVQQIEFLNKKYNANVPLVLMNSFNTDVDTEKVIRKYKGFQVQIYTFNQSCYPRISRDSLLPIAKDFDIENDIEAWYPPGHGDFYQSFQNSGLLRKFLEEGREYCFLSNIDNLGATVDIKILNRLIGDDRQGDKPIEFVMEVTDKTRADVKGGTLIHYENKLRLLEIAQVPKEHVDDFKSVKTFKFFNTNNIWARLESIERVLNAKTMNMEIIVNNKTLDNGIRVIQLETAVGAAMKCFDGGIGINVPRSRFLPVKKTSDLLLVMSNLYSLKYGSLVMSPQRMFPTTPLVKLGDNHFSKVKEFLSRFANIPDLIELDHLTVSGDVTFGRGVSLRGTVIIIANHGDRIDIPAGAILENKIVSGNMRILDH

SEQ ID NO: 22841 - protein, 425 aa, Anopheles gambiae str. PEST
GFRRRQGHFFTDMVRVLFVHPDLGIGGAERLVVDAALALQSKGHTVSFLTNHHDPNHCFDETKDGRLPVMTVGDWLPRDIFGKFYAVCAYIRMLYAAFYYSLFLSKKEPVDVVFCDLISLGIPIFRLARPNPKILFYCHYPDQLLSKPGNLLKQCYRMPLNYLEEVTTAQADGILVNSKFTSRVFKETFKRIATDPDVLYPSLNTRFFDETAIEESDQVVKLPNDAFVFLSINRYERKKNLALALHAFKALQDMVSSSEWHKVCLIMAGGYDDRVMENVEHYDELEELAEDMQIRAKVRLLRSPTDRQKLFLLHRAQALIYTPEFEHFGIVPLEGMYLSKPVIAANSGGPMETIIHEQTGFLCEPVPKEFAAAMAKLVRDDKHCERMGAMGRKRVQQRFSFEAFSTKLDNVVTDLIQRDGEKKFK

SEQ ID NO: 22842 - protein, 830 aa, Anopheles gambiae str. PEST
FGTKVLHLYTLSSPVSAQCKGITMNRRRAYEDDGDFYGERNKKRRRVSENQEMEERLETLILRVGENSTSSLESNLEGLVSVLESDLGNFRSKILRILSDCPIKMPEKCTIYSTMVGLMNAKNYNFGGEFVEYMVKTFKDSLKQCQWDAARYALRFLADLVNCHVISTNSLLQLLDSMVDAANEDNVPQVRRDWYVFAVLSTLPWVGRELYEKKESALENLLVRIEVFLNKRTKKHHNALRVWSVDAPHPQEEYLDCLWAQIRKLRQDNWTEKHIPRPYLAFDSVLCEALQHNIPVIHPPPHQDSFEYPMPWVVYRMFDYTDCPPGPILPGAHSIERFLIEEHLHSIIEMHRWERKDCAIHLLMLPYKDKIPLEYCIVEVIFAELFHMPTPRYLEICYGSILIELCKQQPSKMPQVLAQATEILFMRIDSMNTSCFDRFVNWFSYHLSNFQFRWSWDDWDSCLLLENEHPRPKFIQEVLLKCLRFSYHDRFKEMMPEGYAKLIPKPPVPHYKYSMEGAASLPGTATAHKLVVAIRQKCNAEDVLNELNDLPNSRDASDTDMAEAPFNPLKIDVFVQTLLNLGSKSFSHSFAAISKFHAVFKALAETEEAQICILHNMFELWVDHQQMMVVIVDKLLKVQIVECSAVATWVFSKEMVGEFTKMYLWEILHLTIKKMNQHVTKLSREMNEAKEKLARTVESSSSESEDEAASPNAQKRRKNTEGSGEKPTEEQVERMEEKLEAAYVDQKRLFLIIFQRFIMILSEHLVKCDTDGRDYDTDWYRWTIGRLQQVFMMHHEQVQKYSSTLESLLFTSDLDPHILDVFHQFTALRA

SEQ ID NO: 22843 - protein, 273 aa, Anopheles gambiae str. PEST
GRPTELQHRTSYSRTATMSERENNIYKAKLAEQAERYDEMVEAMKKVASMDVELTVEERNLLSVAYKNVIGARRASWRIISSIEQKEENKGVEEKLEMIKNYRSQVEKELRDICSDILEVLDKHLIPCATTGESKVFYYKMKGDYHRYLAEFATGGDRKDAAENSLVAYKAASDIAMTDLPPTHPIRLGLALNFSVFYYEILNSPDRACRLAKAAFDDAIAELDTLSEESYKDSTLIMQLLRDNLTLWTSDMQADGEGEQKEQIQDVEDQDVS

SEQ ID NO: 22844 - protein, 499 aa, Caenorhabditis elegans
MVFTVPSDLSGGLYFLNGKRTTIESTETFDVIEPRIGQVVAKCPKATADIVDQYVKAAADAQSAWGETTALDRGKVLHKVADLIREHAEEIAIWEVKTNGKPIYEARCDIASSADTFDFFGGIATAVLQGDSLELPGGPSQRIAYTRREPYGVVGCIGAWNYPFQTCVWKVAPALAAGNAVVYKPSPFAPASPVLLGEILTAAGVPKGVYNVIQGEQEAGVALCEHNLVAKVSFTGSVASGEAVQRQAATKNVKPVTLELGGKSEIIIFDDSDVKSAVASAMLANFLNQGQVCTNATRVFVQKGILASFTEAIVQEANDKLKVGDPLLEDTRVGANINEGHLQRILGYVESAKQEGGVVLRGGVRVHPTGVEGGAYFEPAIITGLSDEARAVREEIFGAVMLILPFETEEEVIARANNTTYGLAAGVFSGNLARGHRVAARLQAGTVFINTYNDTEVNVPFGGFKNSGHGRENCIDTLRAHTQTKAIYVNVQDTTEHCF

SEQ ID NO: 22845 - protein, 430 aa, Caenorhabditis elegans
MVFTVPSDLSGGLYFLNGKRTTIESTETFDVIEPRIGQVVAKCPKATADIVDQYVKAAADAQSAWGETTALDRGKVLHKVADLIREHAEEIAIWEVKTNGKPIYEARCDIASSADTFDFFGGIATAVLQGDSLELPGGPSQRIAYTRREPYGVVGCIGAWNYPFQTCVWKVAPALAAGNAVVYKPSPFAPASPVLLGEILTAAGVPKGVYNVIQGEQEAGVALCEHNLVAKVSFTGSVASGEAVQRQAATKNVKPVTLELGGKSEIIIFDDSDVKSAVASAMLANFLNQGQVCTNATRVFVQKGILASFTEAIVQEANDKLKVGDPLLEDTRVGANINEGHLQRILGYVESAKQEGGVVLRGGVRVHPTGVEGGAYFEPAIITGLSDEARAVREEIFGAVMLILPFETEEEVIARANNTTYGLAAGVFSG

SEQ ID NO: 22846 - protein, 298 aa, Homo sapiens
  unsure (1)..(298): unsure at all Xaa locations
MENFQKVEKIGEGTYGVVYKARNKLTGEVVALKKIRXDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 22847 - protein, 518 aa, Pycnoporus cinnabarinus
MSRFQSLLSFVLVSLAAVANAAIGPVADLTLTNAAVSPDGFSREAVVVNGITPAPLIAGQKGDRFQLNVIDNLTNHTMLKTTSIHWHGFFQHGTNWADGVSFVNQCPIASGHSFLYDFQVPDQAGTFWYHSHLSTQYCDGLRGPFVVYDPNDPQASLYDIDNDDTVITLADWYHVAAKLGPRFPLGADATLINGLGRSPGTTTADLAVIKVTQGKRYRFRLVSLSCDPNHTFSIDGHTMTVIEADSVNTQPLEVDSIQIFAAQRYSFVLDASQPVDNYWIRANPAFGNVGFAGGINSAILRYDGAPEVEPTTTQTTSTKPLNEADLHPLTPMPVPGRPEAGGVDKPLNMVFNFNGTNFFINNHSFVPPSVPVLLQILSGAQAAQDLVPDGSVYVLPSNSSIEISFPATANAPGTPHPFHLHGHTFAVVRSAGSSEYNYDNPIFRDVVSTGQPGDNVTIRFQTNNPGPWFLHCHIDFHLEAGFAVVLAEDTPDTAAVNPVPQSWSDLCPIYDALDPSDL

SEQ ID NO: 22848 - protein, 220 aa, Populus tremuloides
MVRGKTQMRRIENATSRQVTFSKRRNGLLKKAFELSVLCDAEVALIVFSPRGKLYEFASSSMQETIERYRRHVKENNTNKQPVEQNMLQLKEEAASMIKKIEHLEVSKRKLLGECLGSCTIEELQQIEQQLERSVSTIRARKNQVFKEQIELLKQKEKLLAAENARLSDECGAQSWPVSWEQRDDLPREEQRESSSISDVETELFIGPPETRTKRIPPRN

SEQ ID NO: 22849 - protein, 490 aa, Hordeum vulgare
MVVTVAATGPDTAETLHSTTFASRYVRDQLPRYRMPENSIPKEAAYQIISDELMLDGNPRLNLASFVTTWMEPECGKLIMDSVNKNYVDMDEYPVTTELQDRCVNMIAHLFNAPIGEDETAIGVSTVGSSEAIMLAGLAFKRKWANKMKEQGKPCDKPNIVTGANVQVCWEKFARYFEVELKEVKLTEGYYVMDPKKAVEMVDENTICVAAILGSTLTGEYEDVKLLNDLLVEKNKETGWNVPIHVDAASGGFIAPFLQPELEWDFRLPLVKSINVSGHKYGLVYPGVGWVIWRSKDDLPEELIFHINYLGADQPTFTLNFSKGQQIIAQYYQLIRLGFEGYKHIMENCKLNAAVLKEGIDATGRFDVLSKADGVPLVAIRLKDSTNFSVFDISENLRRFGWIVPAYTMPADAEHVAVLRIVIREDFNRSLAQRLLADINKIIGELDAHAVHAIKLSTAAAGGDGASKSAVDAATEAFKDLAGKKKAGVC

SEQ ID NO: 22850 - protein, 312 aa, Magnaporthe grisea
MADKDFTLNTGAKIPAFGLGTWQGDKGVIKEAVLTAIKSGYRLIDGAYVYGNEEEVGQGIREAISSGIVKREDLFVVSKCWATYTTRCELGLDQSLKLLGLDYVDLYLVHWPILMNPEGNDEKFPKHADGSRDIIHTHNHVDTWKLMEKLPATGKTKAVGVSNYSKAWLEQLLPHATTVPAVNQVENHPQLPQQELVDFCKEKGIHIMAYSPLGSTGGPLLTAEPVVKIAEKHSISPAAVLLGYQIARGITVIPKSVNPDRIKANAQLKDLDAEDMKLLNDYSEQLAKDGKLNRYVFPPFGTDFGFPDKVGQ

SEQ ID NO: 22851 - protein, 708 aa, Sus scrofa
MGMSVPQSCFGYPLSIFFIVVNEFCERFSYYGMRALLILYFRLFIGWNDNLSTAIYHTFVALCYLTPILGALIADSWLGKFKTIVSLSIVYTIGQVVMAVSSINDLTDFDHNGTPNSMSVHVALSMIGLALIALGTGGIKPCVSAFGGDQFEEGQEKQRNRFFSIFYLAINAGSLLSTIITPMLRVQQCGIHSTQACYPLAFGVPAALMAVSLIVFVMGSRMYKKLKPQGNVMAKVVKCIGFAIKNRFRHRSKKFPKREHWLDWAKEKYDERLICQIKMVTRVMFLYIPLPMFWALFDQQGSRWTLQATTMNGQIGLLKIQPDQMQTVNAILIVIMVPIMDAVVYPLIAKCGLNFTSLRKMTVGMFLASMAFVAAAIVQVEIDKTLPVFPKGNEVQVKVLNIGNNSMSVSFPGTTVTLDQMSQTHEFLTFDVNKLTSINISSAGSPATPVTYNFEQGHRHTLLVWGPSHYRVVKDGLNQKPEKGENGVRFVNTFDESFNVTMDGKVYIDVTSHNASAYQFFPSGAKSFIVHSPEISPQCKNNFTSSSLEFGSAFTYVITRKEDSCPDLKIFEDISPNTINMALQIPQYFLITCGEVVFSVTGLEFSYSQAPSNMKSVLQAGWLLTVAVGNIIVLIVAGAGQFSEQWAEYVLFAGLLLAVCIIFAIMARFYTYINPAEVEAQFDMDEKKKYLGKDSLYPKLDTDVQTQM

SEQ ID NO: 22852 - protein, 356 aa, Verticillium fungicola
MSRANPPNNASASRKISFNVSEQYDIQDVVGEGAYGVVCSAIHKPSGQKVAIKKITPFDHSMFCLRTLREMKLLRYFNHENIISILDIQKPRGYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 22853 - protein, 947 aa, Miscanthus x giganteus
MAASVSGATICLQKPGSKGRRARDATSFARRSVAAPRSPHAAKASVIRSDAGAGRGQHCSPLRAVVDAAPIATKKRVFYFGKGKSEGDKSMKELLGGKGANLAEMSSIGLSVPPGFTVSTEACKQYQDAGSILPAGLWAEILDGLQFVEEYMGATLGDPQRPLLLSVRSGAAVSMPGMMDTVLNLGLNDEVAAGLAAKSGERFAYDSFRRFLDMFGNVVMDIPRSLFEEKLEHMKESKGVKNDTDLTAADLKELVGQYKEVYLTAKGEPFPSDPKKQLELAVRAVFNSWESPRAKKYRSINQITGLVGTAVNVQSMVFGNMGNTSGTGVLFTRNPNTGEKKLYGEFLINAQGEDVVAGIRTPEDLDAMKDVMPQAYEELVENCNILESHYKEMQDIEFTVQENRLWMLQCRTGKRTGTGAVKIAVDMVSEGLVERRQAIKMVEPGHLDQLLHPQFENPAAYKDQVIATGLPASPGAAVGQIVFTAEDAEAWHAQGKAAILVRAETSPEDVGGMHAAAGILTERGGMTSHAAVVARGWGKCCVSGCSAIRVNDAEKTVAIGDHVLSEGEWISLNGSTGEVILGKQPLSPPALSGDLGTFMSWVDEVRKLKVLANADTPEDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGTPQELGHQVNVIKQVAEKVFTSMGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKAGLDYVSCSPFRVPIARLAAAQVLV

SEQ ID NO: 22854 - protein, 947 aa, Miscanthus x giganteus
MAASVSGATICLQKPGSKGRRARDATSFPRRSVAAPRSPHAAKASVIRSDAGAGRGQHCSPLRAVVDAAPIATKKRVFYFGKGKSEGDKSMKELLGGKGANLAEMSSIGLSVPPGFTVSTEACKQYQDAGSILPAGLWAEILDGLQFVEEYMGATLGDPQRPLLLSVRSGAAVSMPGMMDTVLNLGLNDEVAAGLAAKSGERFAYDSFRRFLDMFGNVVLDIPRSLFEEKLEHMKESKGVKNDTDLTAADLKELVGQYKEVYLTAKGEPFPSDPKKQLELAVRAVFNSWESPRAKKYRSINQIIGLVGTAVNVQSMVFGNMGNTSGTGVLFTRNPNTGEKKLYGEFLINAQGEDVVAGIRTPEDLDAMKDVMPQAYEELVENCNILESHYKEMQDIEFTVQENRLWMLQCRTGKRTGAGAVKIAVDMVSEGLVERRQAIKMVEPGHLDQLLHPQFENPAAYKDQVIATGLPASPGAAVGQIVFTAEDAEAWHAQGKAAILVRAETSPEDVGGMHAAAGILTERGGMTSHAAVVARGWGKCCVSGCSAIRVNDAEKTVAIGDHVLSEGEWISLNGSTGEVILGKQPLSPPALSGDLGTFMSWVDEVRKLKVLANADTPEDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGTPQELGHQVNVIKQVAEKVFTSMGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKAGLDYVSCSPFRVPIARLAAAQVLV

SEQ ID NO: 22855 - protein, 187 aa, Miscanthus x giganteus
MAASVSGATICLQKPGSKGRRARDATSFARRSVAAPRSPHAAKASVIRSDAGAGRGQHCSPLRAVVDAAPIATKKLGGKGANLAEMSSIGLSVPPGFTVSTEACKQYQDAGSILPAGLWAEILDGLQFVEEYMGATLGDPQRPLLLSVRSGAAVSMPGMMDTVLNLGLNDEVAAGLAAKSGERFDYD

SEQ ID NO: 22856 - protein, 241 aa, Escherichia coli B
ITGSAQGIGFLLATGLGKYGAQIIINDITAERAELAVEKLHQEGIQAVAAPFNVTHKHEIDAAVEHIEKDIGPIDVLVNNAGIQRRHPFTEFPEQEWNDVIAVNQTAVFLVSQAVTRHMVERKAGKVINICSMQSELGRDTITPYAASKGAVKMLTRGMCVELARHNIQVNGIAPGYFKTEMTKALVEDEAFTAWLCKRTPAARWGDPQELIGAAVFLSSKASDFVNGHLLFVDGGMLVAV

SEQ ID NO: 22857 - protein, 302 aa, Danio rerio
MDDYLKIEKIGEGTYGVVYKGRNKTTGQVVAMKKIRLESEEEGVPSTAVREISLLKELQHPNVVRLLDVLMQESKLYLVFEFLSMDLKKYLDSIPSGEFMDPMLVKSYLYQILEGILFCHCRRVLHRDLKPQNLLIDNKGVIKLADFGLARAFGVPVRVYTHEVVTLWYRAPEVLLGASRYSTPVDLWSIGTIFAELATKKPLFHGDSEIDQLFRIFRTLGTPNNEVWPDVESLPDYKNTFPKWKSGNLANTVKNLDKNGIDLLMKMLIYDPPKRISARQAMTHPYFDDLDKSSLPASNLKI

SEQ ID NO: 22858 - protein, 390 aa, Danio rerio
MSSRSFAPLSSRQENILGRAEGLRQLKPGQRVVLGVLTENDQHNRIFGQVASKYEPTHQEVSTRDVSTFRASIGDRVIETATVQSVKSTFLLPSELLVLNDAVQDIGSGSFMDSSMHSLADEEAASSEDVLCVSEYAEDIHRYLRECEVKYRPKPGYMRKQPDITNCMRVILVDWLVEVGEEYKLCSETLYLAVNYLDRFLSCMSVLRGKLQLVGTAAILLAAKYEEVYPPEVDEFVYITDDTYTKKQLLRMEQHLLRVLAFDMTAPTIHQFLMQYSLEEHVCARTLNLALYLSELSLLEVDPFVQYLPSKTAAAAYCLANYTLNGALWPENLYAFTGYSLAVIGPCLKELHKLHLGAGSRPQQAIQEKYKSSKYHGVSQLEPVETLPLP

SEQ ID NO: 22859 - protein, 538 aa, Mus musculus
MDSRELALASLMCDTGGPGELSVGHQQRRTKKWSFSLVVAALVGAFGSSFLYGYNLSVVNAPTPYIKAFYNGTWYRRHGQPIDPDTLTLLWSVTVSIFAIGGLVGTLMVKMIGKFLGRKSTLLVNNGFAISAALLMACSLRAGTFEMLIVGRFIMGVDGGIALSALPMYLNEISPKEIRGSLGQVTAIFICIGVFSGQLLGLPELLGRESTWPYLFGVIIVPALVQLASLPFLPESPRYLLFEKHDEAGAMKAFQTFLGKADVSQELEEALAESRVQRNLRLVSVLELLRAPFVRWQVITVIITMASYQLCGLNAIWFYTNSIFGKAGIPQDKIPYITLSTGGIETLAAIFSGLVIERLGRGPLLIGGFGLMALFFGTLTATLTLQDQAPWVPYLSIVCILAIIASFCSGPGGIPFILTGEFFQQSERPAAFMIAGTVNWLSNFAVGLLFPFIQKSLDSYCFLVFATICIAGATYFYFVLPETKNRTHAEISQAFAKRNKAQPPEVKADSAMTEEKANSQTEPDSSSTLDSYGQNKIV

SEQ ID NO: 22860 - protein, 836 aa, Emericella nidulans
MANRDINDFGGFDDRQLPAIRSPDYIESNEESHIAHMATYTSSVPVGDYAYTMHNSMLAYDTANEGNSVSVSLGSESAFAYDVSTYPSSTTALNYDLNQFASLHSHAPGSDNASTYSSAQRHYWTQPHTSGGMVSSTQTLLSHPAQPSRAAEPSAAQKIPPGQLQDINPFPQASVSATSHRPIQPKSLAGKGARSEASRSSTPYPNVYSRSGYDMMGILAEVVSRDNPRIDLGPVDLSCAFVLCDLTMEDSPIVYVSHAFERLTGYNEKEIVGRNCRFLQSPDAKVEKGEPRKFVDSHTVSRLRSAVDRRSEIQVSIINYRKGGQPFLNLVTMIPVRWNAKDYYVGFQVDLVERPEAVTRRNSDGTYMIDYHRSQLPAYVVPAADMYRDGHVPTAMLSPRQVSVILNDFVKGQSVAVNLFHHMLVENTDDLIFVLSFEGEFLYLSPSCQTVLEYKPNDLCGKTLSAICHPSDIGPVTRDMRTCTTGDPISILYRIRRKESGYTWFENHGGWHITQRGRQFMVLVGRLIPMYSPIQLANVESGGLAENDIWAKLSLSGIILFMSSKSRAVLGQPSDDLIGKRLQDFLVTDNFHSEPAVQQALETSRHNQQATFTHRIRHRKGHIISAQITLYPGDIVYGASKPAFLIAHLRFPRELQLQASTTEDQSNSQSQSQTSSDTGPGDYKTPQNQQQTAESHQKPHPNFPQPPTSSATLAVPSSASPNSAEPPTELGMHLFEELNPTRGSNWHFDVRELEKQNRHLTDEAQRLLARRRKRKRKQSAAAMEKSCAMCGTRTTPEWRRGPSGNRDLCNSCGLRWAKQVRSAAAVHSQAKSGGEG

SEQ ID NO: 22861 - protein, 316 aa, Crithidia fasciculata
MNYGGSLKATAGEVTSLACPQQAGSYIKVVSTSRDGTAISWKANPDRHSAEDNYGIPDHRMEGHSGFVSCVSLAHATDYALTASWDHAIRMWDLRTGQSQRKFLKHTKDVLAVAFSPDDRLIVSAGRDNVIRVWNVAGECMHEFLRDGHEDWVSSICFSPSLDLPIVVSGSWDNTIKVWNVNEGKCVHTLRGHKNYVSTVTVSPDGSLCASGGKDGSALLWDLSNGEQQFSIPVESPINQIAFSPNRFWMCVATEKSLSVYDLETKEVIADLSVGSSKPSECISVAWSADGNTLYSGHKDNQFRAWDFKNLISDAE

SEQ ID NO: 22862 - protein, 144 aa, Schizosaccharomyces pombe
DPYVEWVISLEQNVMEGAFDKVASMIRSCNFPEFSYFMKIVMSMVRNEIATCAEKVYSEIPLSNATSLLYLENTKETEKLAEERGWDIRDGVIYFPKEANALETEDGMLIDEEDELELPPTASKHTISSIRQLLSYTSELEQIV

SEQ ID NO: 22863 - protein, 354 aa, Roseobacter denitrificans
MTDTKTPTLDRVAGPADLRSMSDTELRNVADELRAEVVEAVSQTGGHLGSSLGVVELSVAIHAVFDTPRDKLVWDVGHQCYPHKILTGRRKQMPTLRQGGGISGFTKRSESEYDPFGAAHSSTSISAALGFTISRDMGQPTGDAVAVIGDGSISAGMAYEALNHAGHGKSRMFVILNDNEMSIAPPVGAMSSYLSSLSELSRAGPFGGLVAIAEGRSMHLPEPVRDGARRAREVVTGLENRGTLFEELGFDYIGPIDGHDMAQLLSVLRGAKARATGPVLIHCCTVKGKGYAPAEGSADKYHGVSKFDVGTGVQAKAKANAPSYTAVFGDALTTLAEEDPSVVAVTAAMPSGTG

SEQ ID NO: 22864 - protein, 292 aa, Mus musculus
EFRPKRYYLSNQERPQYEHSVVVGRGSSHQVENEKKEKKPKKEKGLGCSDWKPEAGLSPPRKKGGGEPKTRRDSVDSRSSTTSSPKRPSLERSNSSKSKVETPTTPSSPSTPTFAPAVCLLAPCYLTGDSVRDKCVEMLSAALKAEDNFKDYGVNCDKLASEIEDHIYQELKSTDMKYRNRVRSRISNLKDPRNPGLRRNVLSGAISPELIAKMTAEEMASDELRELRNAMTQEAIREHQMAKTGGTTTDLLRCSKCKKKNCTYNQVQTRSADAPMTTFVLCNECGNRWKFC

SEQ ID NO: 22865 - protein, 341 aa, Oryza sativa (japonica cultivar-group)
MDHRELWPYGLRVLVIDDDCSYLSVMEDLLLKCSYKVTTYKNVREAVPFILDNPQIVDLVISDAFFPTEDGLLILQEVTSKFGIPTVIMASSGDTNTVMKYVANGAFDFLLKPVRIEELSNIWQHIFRKQMQDHKNNNMVGNLEKPGHPPSILAMARATPATTRSTATEASLAPLENEVRDDMVNYNGEITDIRDLGKSRLTWTTQLHRQFIAAVNHLGEDKAVPKKILGIMKVKHLTREQVASHLQKYRMQLKKSIPTTSKHGATLSSTALDKTQDHPSRSQYFNQDGCKEIMDYSLPRDDLSSGSECMLEELNDYSSEGFQDFRWDSDKQEYGPCFWNF

SEQ ID NO: 22866 - protein, 341 aa, Oryza sativa (japonica cultivar-group)
MDHRELWPYGLRVLVIDDDCSYLSVMEDLLLKCSYKVTTYKNVREAVPFILDNPQIVDLVISDAFFPTEDGLLILQEVTSKFGIPTVIMASSGDTNTVMKYVANGAFDFLLKPVRIEELSNIWQHIFRKQMQDHKNNNMVGNLEKPGHPPSILAMARATPATTRSTATEASLAPLENEVRDDMVNYNGEITDIRDLGKSRLTWTTQLHRQFIAAVNHLREDKAVPKKILGIMKVKHLTREQVASHLQKYRMQLKKSIPTTSKHGATLSSTALDKTQDHPSRSQYFNQDGCKEIMDYSLPRDDLSSGSECMLEELNDYSSEGFQDFRWDSDKQEYGPCFWNF

SEQ ID NO: 22867 - protein, 341 aa, Oryza sativa (indica cultivar-group)
MDHRELWPYGLRVLVIDDDCSYLSVMEDLLLKCSYKVTTYKNVREAVPFILDNPQIVDLVISDAFFPTEDGLLILQEVTSKFGIPTVIMASSGDTNTVMKYVANGAFDFLLKPVRIEELSNIWQHIFRKQMQDHKNNNMVGNLEKPGHPPSILAMARATPATTRSTATEASLAPLENEVRDDMVNYNGEITDIRDLGKSRLTWTTQLHRQFIAAVNHLGEDKAVPKKILGIMKVKHLTREQVASHLQKYRMQLKKSIPTTSKHGATLSSTALDKTQDHPSRSQYFNQDGCMEIMDYSLPRDDLSSGSECMLEELNDYSSEGFQDFRWDSDKQEYGPCFWNF

SEQ ID NO: 22868 - protein, 341 aa, Oryza glaberrima
MDHRELWPYGLRVLVIDDDCSYLSVMEDLLLKCSYKVTTYKNVREAVPFILDNPQIVDLVISDAFFPTEDGLLILQEVTSKFGIPTVIMASSGDTNTVMKYVANGASDFLLKPVRIEELSNIWQHIFRKQMQDHKNNNMVGNLEKPGHPPSILAMARATPATTKSTATEALLAPLENEVRDDMVNYNGEITDIRDLRKSRLTWTTQLHRQFIAAVNHLGEDKAVPKKILGIMKVKHLTREQVASHLQKYRMQLKKSIPTTSKHGATLSSTALDKTQDHPSRSQYFNQDGCMEIMDYSLPRDDLSSGSECMLEEQNDYSSEGFQDFRWDSDKQEYGPCFWNF

SEQ ID NO: 22869 - protein, 176 aa, Perilla frutescens var. crispa
MAADEEPNTSLNKGAWTADEDGILAQYVAQHGPKRWKSLAIDAGLNRCGKSCRLRWLNYLRPDIKRGNFSDAEDDLILRFHRLLGNRWSLIAKRIPGRTDNEIKNYWNTHLRKKARLMEKLPAISVTAAMELNIWHDESSSSGTEIRDDDESFDFTAQGTSGLDWVKTFLELEEDA

SEQ ID NO: 22870 - protein, 492 aa, Drosophila melanogaster
MAKMPETTFADLSLADKTAVKKSSIEARRFSDVSTCSFSSTCFTGSSDEEDVSPKDNHQRNSAGGTDFCVKSISKSAFGRREIEIAESEMPGIMTLRKRAKDEKPLKGANIVGCTHVNAQSAVLIETLVQLGATVRWAACNIYSTQNAVAAALAEAGIPIFAWRGETEEEFWWCLDRAIYSDGWQPNLILDDGGDATHLMLKKYPDYFKAIRGIVEESVTGVHRLYMLSKGGKLTVPAINVNDSVTKNKFDTFYTCRDSILDSLKRTTDIMFGGKQVVICGYGDVGKGCAQSLKGQGCIVYVTEVDPICALQAAMDGFRVVRLNEVIRTVDVVVTATGNKNVITRDHMNRMKNGCILCNMGHSCSEIDVNGLHTPELTWERVRSQVDHIRWPDGRMIILLAEGRLVNLSCSTISSFVVSVASSTQALALIELFSAPGRYKSDVYLLPKKMDEYVASLHLATFDAHLTELTDEQSKFMGLNKAGPFKANYYRY

SEQ ID NO: 22871 - protein, 471 aa, Haematobia irritans irritans
HPNTTHYRARAAAQAGIRLYFMQNSFLILCRMNKEVDPVAPVTLKGYLISIKTGEPIEIRERDVGRSRIQRPRLYFMQNSFLILCRMNKEVDPVAPVTRKGYLISIKTGEPIEIRERDVHGRCRAVTEFEKLNRIGEGTYGIVYRARDTRTNEIVALKKVRMDQEKDGLPVSGLREITILKKCKHENIVHLREVVVGKSLESMFLVMEYCEQDLASLLDNMTQPFAESEVKCIVLQVLQGLKYMHSHYIIHRDLKVSNLLMTDKGCVKIADFGLARLFGLPSGPMTPQVVTLWYRSPELLLGSTTQTTAVDMWAVGCILGELLSHKPLLPGNTEIAQLELIIDLLGTPSEAIWPDYPKMPAIQNFTLKKQPYNNLKPKFQYLSAAGLRLLNFLFMYDPKKRATADECLHSTYFKEPPLPCDPKLMPSFPQHRNMHQHNSTKTARGSSHTSMPELPAISDLLGSLIKRKKNE

SEQ ID NO: 22872 - protein, 295 aa, Rattus norvegicus
MEHQLLCCEVETIRRAYPDTNLLNRPGLRAMLKTEETCAPSVSYFKCVQREIVPSMRKIVATWMLEVCEEQKCEEEVFPLAMNYLDRFLSLEPLKKSRLQLLGATCMFVASKMKETIPLTAEKLCIYTDNSIRPEELLQMELLLVNKLKWNLAAMTPHDFIEHFLSKMPEADENKQIIRKHAQTFVALCATDVKFISNPPSMVAAGSVVAAMQGLNLGSPNNFLSCYRTTHFLSRVIKCDPDCLRACQEQIEALLESSLRQAQQNIDPKATEEEGEVEEEAGLACTPTDVRDVDI

SEQ ID NO: 22873 - protein, 706 aa, Homo sapiens
MGDERPHYYGKHGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPTPQICVEKCPDRYLTYLNARSSRDFEYYKQFCVPGFKNNKGVAEVLRDGDCPAVLIPSKPLARRCFPAIHAYKGVLMVGNETTYEDGHGSRKNITDLVEGAKKANGVLEARQLAMRIFEDYTVSWYWIIIGLVIAMAMSLLFIILLRFLAGIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKPLNKTNKKAAES

SEQ ID NO: 22874 - protein, 464 aa, Mus musculus
MAMTAGATTTFPMSNHTRERVTVAKLTLENFYSNLILQHEERETRQKKLEVAMEEEGLADEEKKLRRSQHARKETEFLRLKRTRLGLDDFESLKVIARGAFGEVRLVQKKDTGHIYAMKILRKADMLEKEQVAHIRAERDILVEADGAWVVKMFYSFQDKRNLYLIMEFLPGGDMMTLLMKKDTLTEEETQFYISETVLAIDAIHQLGFIHRDVKPDNLLLDAKGHVKLSDFGLCTGLKKAHRTEFYRNLTHNPPSDFSFQNMNSKRKAETWKKNRRQLAYSTVGTPDYIAPEVFMQTGYNKLCDWWSLGVIMYEMLIGFPPFCSETPQETYRKVMSWKETLAFPPEVPVSEKAKDLILRFCTDSENRIGNGGVEEIKGHPFFEGVDWGHIRERPAAIPIEIRSIDDTSNFDDFPESDILQPVPNTTEPDYKSKDWVFLNYTYKRFEGLTQRGSIPTYMKAGKL

SEQ ID NO: 22875 - protein, 457 aa, Homo sapiens
MAFASIYKLDNLVAILDINRLGQSDPAPLQHQMDIYQKRCEAFGWHAIIVDGHSVEELCKAFGQAKHQPTAIIAKTFKGRGITGVEDKESWHGKPLPKNMAEQIIQEIYSQIQSKKKILATPPQEDAPSVDIANIRMPSLPSYKVGDKIATRKAYGQALAKLGHASDRIIALDGDTKNSTFSEIFKKEHPDRFIECYIAEQNMVSIAVGCATRNRTVPFCSTFAAFFTRAFDQIRMAAISESNINLCGSHCGVSIGEDGPSQMALEDLAMFRSVPTSTVFYPSDGVATEKAVELAANTKGICFIRTSRPENAIIYNNNEDFQVGQAKVVLKSKDDQVTVIGAGVTLHEALAAAELLKKEKINIRVLDPFTIKPLDRKLILDSARATKGRILTVEDHYYEGGIGEAVSSAVVGEPGITVTHLAVNRVPRSGKPAELLKMFGIDRDAIAQAVRGLITKA

SEQ ID NO: 22876 - protein, 514 aa, Mus musculus
MADYLISGGTGYVPEDGLTAQQLFANADGLTYNDFLILPGFIDFIADEVDLTSALTRKITLKTPLISSPMDTVTEADMAIAMALMGGIGFIHHNCTPEFQANEVRKVKKFEQGFITDPVVLSPSHTVGDVLEAKIQHGFSGIPITATGTMGSKLVGIVTSRDIDFLAEKDHTTLLSEVMTPRVELVVAPAGVTLKEANEILQRSKKGKLPIVNDQDELVAIIARTDLKKNRDYPLASKDSHKQLLCGAAVGTREDDKYRLDLLTQAGADVIVLDSSQGNSVYQIAMVHYIKQKYPHLQVIGGNVVTAAQAKNLIDAGVDGLRVGMGCGSICITQEVMACGRPQGTAVYKVAEYARRFGVPVIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGAQSLSVLRSMMYSGELKFEKRTMSAQIEGGVHGLHSYEKRLY

SEQ ID NO: 22877 - protein, 427 aa, Mus musculus
MSRSKRDNNFYSVEIGDSTFTVLKRYQNLKPIGSGAQGIVCAAYDAILERNVAIKKLSRPFQNQTHAKRAYRELVLMKCVNHKNIIGLLNVFTPQKSLEEFQDVYIVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDLWSVGCIMGEMVCHKILFPGRDYIDQWNKVIEQLGTPCPEFMKKLQPTVRTYVENRPKYAGYSFEKLFPDVLFPADSEHNKLKASQARDLLSKMLVIDASKRISVDEALQHPYINVWYDPSEAEAPPPKIPDKQLDEREHTIEEWKELIYKEVMDLEERTKNGVIRGQPSPLGAAMINGSQHPSSSPSVNDMSSMSTDPTLASDTDSSLEASAGPLGCCR

SEQ ID NO: 22878 - protein, 1042 aa, Mus musculus
MRPKTFPATTYSGNSRQRLQEIREGLKQPSKASTQGLLVGPNSDTSLDAKVLGSKDASRQQQMRATPKFGPYQKALREIRYSLLPFANESGTSAAAEVNRQMLQELVNAGCDQEMAGRALKQTGSRSIEAALEYISKMGYLDPRNEQIVRVIKQTSPGKGLAPTPVTRRPSFEGTGEALPSYHQLGGANYEGPAALEEMPRQYLDFLFPGAGAGTHGAQAHQHPPKGYSTAVEPSAHFPGTHYGRGHLLSEQPGYGVQRSSSFQNKTPPDAYSSMAKAQGGPPASLTFPAHAGLYTASHHKPAATPPGAHPLHVLGTRGPTFTGESSAQAVLAPSRNSLNADLYELGSTVPWSAAPLARRDSLQKQGLEASRPHVAFRAGPSRTNSFNNPQPEPSLPAPNTVTAVTAAHILHPVKSVRVLRPEPQTAVGPSHPAWVAAPTAPATESLETKEGSAGPHPLDVDYGGSERRCPPPPYPKHLLLPSKSEQYSVDLDSLCTSVQQSLRGGTEQDRSDKSHKGAKGDKAGRDKKQIQTSPVPVRKNSRDEEKRESRIKSYSPYAFKFFMEQHVENVIKTYQQKVSRRLQLEQEMAKAGLCEAEQEQMRKILYQKESNYNRLKRAKMDKSMFVKIKTLGIGAFGEVCLACKLDTHALYAMKTLRKKDVLNRNQVAHVKAERDILAEADNEWVVKLYYSFQDKDSLYFVMDYIPGGDMMSLLIRMEVFPEHLARFYIAELTLAIESVHKMGFIHRDIKPDNILIDLDGHIKLTDFGLCTGFRWTHNSKYYQKGNHMRQDSMEPGDLWDDVSNCRCGDRLKTLEQRAQKQHQRCLAHSLVGTPNYIAPEVLLRKGYTQLCDWWSVGVILFEMLVGQPPFLAPTPTETQLKVINWESTLHIPTQVRLSAEARDLITKLCCAADCRLGRDGADDLKAHPFFNTIDFSRDIRKQPAPYVPTISHPMDTSNFDPVDEESPWHEASGESAKAWDTLASPSSKHPEHAFYEFTFRRFFDDNGYPFRCPKPSEPAESADPGDADLEGAAEGCQPVYV

SEQ ID NO: 22879 - protein, 163 aa, Danio rerio
MHRDCPLDCKVYVGNLGNNGNKSELERAFGYYGPLRSVWVARNPPGFAFVEFEDPRDATDAVRELDGRTLCGCRVRVELSNGEKRTRSRGPPPSWNRRPRDDYRRRSPPQRRRSPRRRSFSRSRSRSFSRERRRERSLSRERNHKPSRSFSRSRSRSRSNDRK

SEQ ID NO: 22880 - protein, 354 aa, Danio rerio
MGCTLSTEDKAAVERSKMIDRNLRDDGEKAAREVKLLLLGAGESGKSTIVKQMKIIHEAGYSEEECKQYKAVVYSNTIQSIIAIIRAMGRLKIDFGDAARADDARQLFVLAGSAEEGFMTAELAGVIKRLWKDGGVQACFSRSREYQLNDSAAYYLNDLDRISQATYIPTQQDVLRTRVKTTGIVETHFTFKDLHFKMFDVGGQRSERKKWIHCFEGVTAIIFCVALSDYDLVLAEDEEMNRMHESMKLFDSICNNKWFTDTSIILFLNKKDLFEEKIRKSTLTICYPEYAGSNTYEEAAAYIQCQFEDLNKRKDTKEIYTHFTCATDTKNVQFVFDAVTDVIIKNNLKDCGLF

SEQ ID NO: 22881 - protein, 309 aa, Danio rerio
MGKKEEEEIIRIAKKMDKMAQKKNGVGALDLLKELKNIPMTLELLQSTRIGMSVNAIRKQSTDDEVTSLAKSLIKSWKKLLDEPAADKNSEEKKKERTTPVVSPSETSPEPREESSSSNSSSKSESVDVTPNTLIATFPRAPGTSDSVRIKCREMLSNALQTGDDYITIGSDCDELGAQIEECIFLEFKNTDMKYKNRVRSRISNLKDAKNPNLRRNVLCGNVSPDRIAKMTAEEMASDELKEMRKNLTKEAIRDHQVATSGGTQTDLFTCGKCKKKKCTYTQVQTRSADEPMTTFVFCNECGNRWKFC

SEQ ID NO: 22882 - protein, 359 aa, Danio rerio
MASLRCFLRSGKSAVSAVLRREFHRTPPAAVQVTVRDALNQAMDEELERDERVFLLGEEVAQYDGAYKVSRGLWKKYGDKRIIDTPITEMGFAGIAVGAAMAGLRPICEFMTFNFSMQAIDQVINSAAKTYYMSAGLQAVPIVFRGPNGASAGVAAQHSQCFAAWYGHCPGLKVLSPWNSEDARGLLKAAIRDDNPVVFLENELMYGVPFEMSEEVQSKDFVIPIGKAKIERQGNHITLVSHSRMVGLCLDAAAVLAKEGIECEVINLRSIRPLDADTIETSITKTNHLVTVEGGWPQFGVGAEILARIMEGPAFNYLDAPAVRVTGVDIPMPYAKILEDNSIPQIKDIIFSVKKTLNV

SEQ ID NO: 22883 - protein, 242 aa, Danio rerio
MDKSDLVQKAKLAEQAERYDDMAAAMKAVTEGGVELSNEERNLLSVAYKNVVGARRSSWRVISSIEQKTEGNEKKQQMAREYREKIETELQDICSDVLGLLEKYLIANASQAESKVFYLKMKGDYYRYLSEVASGDSKATTVENSQKAYQDAFDISKKDMQPTHPIRLGLALNFSVFYYEILNSPENACQLAKTAFDEAIAELDTLNEDSYKDSTLIMQLLRDNLTLWTSENQGEEAGENEN

SEQ ID NO: 22884 - protein, 342 aa, Danio rerio
MSLHGKRKEIYKYEAPWTVYAMNWSVRPDKRFRLALGSFVEEYNNKVQLVGLEEESSEFVCRNTFDHPYPTTKIMWIPDTKGVYPDLLATSGDYLRIWRVNDTETRLECLLNNNKNSDFCAPLTSFDWNEVDPNLLGTSSIDTTCTIWGLETGQVLGRVNLVSGHVKTQLIAHDKEVYDIAFSRAGGGRDMFASVGADGSVRMFDLRHLEHSTIIYEDPQHHPLLRLCWNKQDPNYLATMAMDGMEVVILDVRVPCTPVARLNNHRACVNGIAWAPHSSCHICTAADDHQALIWDIQQMPRAIEDPILAYTAEGEINNVQWASTQPDWIAICYNNCLEILRV

SEQ ID NO: 22885 - protein, 246 aa, Danio rerio
MADREQLIQRARLAEQAERYDDMASAMKLVTELNEPLSNEDRNLLSVAYKNVVGARRSSWRVISSIEQKTAADGNEKKLELVRVYRETVEKELESVCQDVLTLLDQYLIKNCDETQVESKVFYLKMKGDYYRYLAEVATGEKRASAVESSEGAYKEAFDISKGMPATHPIRLGLALNFSVFYYEIQNAPEQACQLAKEAFDDAIGHLDNLNEDSYKDSTLIMQLLRDNLTLWTSDQQDSEGGDANN

SEQ ID NO: 22886 - protein, 337 aa, Danio rerio
MSDRGAFDTNVVTLTRFVLEEGRKAKGTGELTTLLNSMCTAIKAISTAVRKAGIANLYGIAGSTNVTGDQVKKLDVLSNDLVINMIKSSFTSCVLVSEEDEKAVIIEPEKRGKYVVCFDPLDGSSNIDCLASIGTIFAIYRKETDDEPSEKDALRSGRHIVAAGYALYGSATMLVLSTGQGVNCFMLDPAIGEFILVDRDVRIKKKGKIYSLNEGYAQQFYPDVTEYLQKKKFPEDGSSPYGGRYVGSMVADVHRTLVYGGIFLYPANVKSPKGKLRLLYECNPMAFIMEQAGGMATTGAMNVLDIQPESIHQRVPVVLGSPDDVKEYISIYKKHAK

SEQ ID NO: 22887 - protein, 619 aa, Danio rerio
MELEEGGAELKAEHSMAELPEEVLEYILSFLSPYQEHKTAALVCKQWYRLIKGVAHQCYHGFLRAIQEGNIQWESRTYPYPGTPITQRFSHSACYYDSNQSMYVFGGCTQSSCNAAFNDLWRLDLNSKEWIRPLASGSYPSPKAGATLVMYGDLLVLFGGWTRPSPYPLHQPERFFDEIHTYSPSKNWWNCIVTTHGPPPMAGHSSSVIRSTMVVFGGSLGARQMSNEVWVLDLEQWTWSKPTISGPSPHPRGGQSQIVMDEETLLILGGCGGPNALLKDAWLLHMSDPCWTWQQLRVENEDHGAPELWCHPACKVGQCVVVFSQAPSGRAPLSPSLNSRPSPISSTPAPLGPDPPSLRSQSPVRSGAAGAVLGAVEEAPCVNGRWGTLRPRASARASSSSSPSRGPDSPPLLNGASPSPRTSPVQQASPPARPPGPADLSWDGSPPSANGLHTPPGSPRTPPGAVSPAALRRGLEAVKASSSLPSPPPAPQPGPSAPSGTPPAPPSPPPIARRLGHHPPQSLNVGKPLYQALSCKPMQMYLLDVSRARTQGVVAWRVYGSGGAPSAVTGPPETSLHTVVQGRGELIIFGGLMDKKQNVKYYPKTNTSMCVCVRVRVRV

SEQ ID NO: 22888 - protein, 442 aa, Oryza sativa (japonica cultivar-group)
MDSAARASQSAAPPPPGAGVRVRAPLVESVSCYCRLDTGLKTVVDARKFVPGAKMCMQPDVKPNKCKSRGSRKERSRTQAPLLPGLPDDLAIACLIRVPRVEHPNLRIVCKRWNRLLSGNYYYSLRKRNGMAEEWVYVFKRDREGKISWHAFDPLHQLWKSLPPVPAEYSEALGFGCAVLSGCYLYLFGGKDPLRGSMRRVVFYNARTNKWHRAPDMLRKRHFFGSCVINNCLYVAGGECEGIQRTLPSAEVYDPNRNRWACVAEMNNGMVPFIGVVYDGKWFLKGLDSHRQVTSEVYLPSSNLWSTIDDEMVTGWRNPSITFNGKLYSSDCRDGCKLRVYDPNTGTWAKFMDSKHHLGSSRAFEAAALVTLNGKLCIVRNNMSITLVDISDPTMSIETDSARMWETVARKGQHRSFVANLWSTIAGRNLKSHIIHCQVLQV

SEQ ID NO: 22889 - protein, 358 aa, Oryza sativa (japonica cultivar-group)
MDPAAAGIVKEEMLESQQQQRQEDGGAAPRPMEGLHEVGPPPFLTKTYDLVEDPATDGVVSWSRAGNSFVVWDPHVFADLLLPRLFKHNNFSSFVRQLNTYGFRKVDPDRWEFANEGFLRGQRHLLKTIKRRKPPSNAPPSQQQSLTSCLEVGEFGFEEEIDRLKRDKNILITEVVKLRQEQQATKDHVKAMEDRLRAAEQKQVQMMGFLARAMRNPEFFQQLAQQKEKRKELEDAISKKRRRPIDNVPFYDPGETSQTEQLDSPYLFDSGVLNELSEPGIPELENLAVNIQDLGKGKVDEERQNQTNGQAELGDDFWAELLVEDFTGKEEQSELDGKIDGIDELAQQLGYLSSTSPK

SEQ ID NO: 22890 - protein, 335 aa, Oryza sativa (japonica cultivar-group)
MSQQGEYHADMMAEFLRGSGGAAVIDGGLATELEANGADLKDALWSARCLFTCPDLIRKVHLDYLEAGASVLITGSYQATIQGFLSKGFSQEESESFLRRSVELACEARAIYLEKCSNGSDEAKDVTKYRKRPILIAASVGSYGAYLADGSEYSGDYGNEGTLEFLKNFHLRRLQVLAEAGPDVIVFETIPNKIETQAYVELLEECKLRIPAWFGFTSKDGVNVVSGDSLIECASIADSCKEVAAVGINCTPPRFIHELVLSIRKVTSKPILIYPNSGESYDPIRKEWVECSGISNEDFVSYVKKWHEAGASLIGGCCRTSPDTIRGISKALHGV

SEQ ID NO: 22891 - protein, 220 aa, Oryza sativa (japonica cultivar-group)
MASTTAAAEDHKGKRPLPPEEADEAAAAPPPAAAEEEGEKLVLVSDDGVEVLASVAAARVSKTLRGMIEDECATGAIPIAGVHSDVLALLVEYCERHAPHYDPEASDRDRYPFPPFPVELPPTASSIKPVTFVDPDADPHGLKAFDKKFLDVDNSTLFEIIMAANYLNIEELLDDACTAVADKMRGKKPEEIRDIFEIENDYTPEQEAEVRRENAWAFED

SEQ ID NO: 22892 - protein, 124 aa, Oryza sativa (japonica cultivar-group)
MEDNRSKDTATKYRGVRRRPWGKFAAEIRDPERGGARVWLGTFDTAEEAARAYDRAAYAQRGAAAVLNFPAAAAAGRGGGAGGAASGSSSSSSAQRGRGDKIEFEYLDDKVLDDLLDDEKYRGK

SEQ ID NO: 22893 - protein, 268 aa, Oryza sativa (japonica cultivar-group)
MWDPHVLVPPVSGVLGLSASAAAAAEEEEESAMRRRFQDSVKALEADIEHANELASEFLRDYDGAVIQMRMAYSAVAHFLVQWIDCKLAGALGLLKIMIYKVYADGTTALPEWEREASIRQFYGVIFPSLLQLPSGITELDDRKQRRLCLQKFRKVEERVSEVDLERELECGICLEVNAKIVLPDCAHSLCMRCFEDWNTKSKSCPFCRACLKKVNPSSLWLYTDDRDVVDMDTLTRENIRRLFMFISKLPLVVLHVVDLDIYEYRIK

SEQ ID NO: 22894 - protein, 266 aa, Oryza sativa (japonica cultivar-group)
MELESEQHGCEHYTRGCRIRAPCCGEVFGCRHCHNEAKNSLEIHLNDRHEIPRHEIKKVICSLCDKEQDVQQYCSGCGACMGKYFCEKCNFFDDDVSKNQYHCDGCGICRTGGVDKFFHCDKCGCCYSNVLRDSHHCVEGAMHHNCPVCFEYLFDSTKDISVLHCGHTIHLECLNVMRAHHHFACPVCSRSACDMSDAWKKLDEEVAATPMPEFYQKKMIWILCNDCGATSNVNFHVLAQKCPGCSSYNTRETRGCGRPAAARSTV

SEQ ID NO: 22895 - protein, 982 aa, Oryza sativa (japonica cultivar-group)
MGNRKKLQVVTSSLEARQSSCRTPTSGSLDKKNQSLDKRSQSSEVLLKRKKLRVATDMESPLSNDGVRSPPKSCKRYAENTLSSTPRLLKADSPRNHDVFSRENSFKSSNKGSIKSPDNAPMRSQAVNSSVTLPRSYSLGNLANVKTPGPSPRGLLSKQPSFNNSSNEPKVKQLAEPVLSKLKPSKHSPRDPRESIRKVMKSGPLKHEASICKGSSSSKQKQSVHSSQNEQPRILKPVKPTILLERGASFNLQKPNISSSPRPDSSIKSGDPRNDQDSPRPGPSILKSSKKPGIVENKHSSILSKSDEQGITSTGVVCSKDTCVVKASDPLIPMDKIKNDSTDGACESPLILVNNDNEMSTKPEVLSIPRASKTCGSDFQDIAPTSSSEDLPPEEVQYEQKVVESDGNISCKSAAAIQASEDLLPESPQGCLVAQNPYSPDTKSNDLNLKQQALVDQSSTVGSSLGALVIPEQSYIWQGTFEVSRPGSSPEMYDGFQAHLSTCASLKVLEIVKQLPQRIQLVEVPRHSSWPLQFKEVKPNEDNIALYFFAKDVESYERAYGKLLENMLAGDLSLTANICGIELLIFTSDKLPERTQRWNGLLFFWGVLYARKASSSTELLVKGMNHSPLEQINGPVNQLVCSPKMPQSLGIDLNECPVDELYDPAVSVQTEMENRGASVNHETLLRSNHEAERLNLCEIHFPETAGTGKILLGTPTAVPYGVHVHTSSKRECLNIKPEYPSDIIGSEGTAGRDNMEEEESFTKNGVPCFTKQHTGATTRSVSDEILANTQARVSFQEVSPQHSVRPKLSDDPSDSVLKDFVLPDSSSIYKRQKTSEGKYSTCSFGDGQLTSKCLSKIPLPADQHTSLDDVQYIGRVPADPCSPTKPILDHVIHVLSSDDEDSPEPRNNLNKTSLKEEEGPSPLLSLSLSMASKKHNLTGSDTGDDGPLSLSLGLPGVVTSNQALEMKQFLPEKPGMNTSLLL

SEQ ID NO: 22896 - protein, 313 aa, Homo sapiens
MALLVDRVRGHWRIAAGLLFNLLVSICIVFLNKWIYVYHGFPNMSLTLVHFVVTWLGLYICQKLDIFAPKSLPPSRLLLLALSFCGFVVFTNLSLQNNTIGTYQLAKAMTTPVIIAIQTFCYQKTFSTRIQLTLIPITLGVILNSYYDVKFNFLGMVFAALGVLVTSLYQVWVGAKQHELQVNSMQLLYYQAPMSSAMLLVAVPFFEPVFGEGGIFGPWSVSALLMVLLSGVIAFMVNLSIYWIIGNTSPVTYNMFGHFKFCITLFGGYVLFKDPLSINQALGILCTLFGILAYTHFKLSEQEGSRSKLAQRP

SEQ ID NO: 22897 - protein, 599 aa, Plantago major
MMDAVSIRVPYKNLKQEVELVSADDDSHQRHRVQIQSSPEPLESPDSDRHHTPQKNCSLMTLILSCTIAAGVQFGWALQLSLLTPYIQTLGVEHAFSSFIWLCGPITGLVVQPCVGIWSDKCTSKYGRRRPFILIGSLMIAVSVIIIGYSADIGYVLGDTKEHCSTFKGTRTRAAIVFIIGFWMLDLANNTVQGPARALLADLSGPEQRNAANAIFCSWMAVGNILGFSSGASGNWHRWFPFLTSRACCEPCGNLKAAFLVAVVFLALCTLVTLYFAKEVPLTPKHPHHLSDSAPLLNEPQQNGSELSKLEIDTEFRHVPLEVKPDGHGMDNDIVGRKISEDDNTSLTDSPGAVLVNLLTSLRHLPPAMHSVLVVMALTWLSWFPFFLFDTDWMGREVYNGDPKGETAAKVQAYNQGVREGAFGLLLNSVVLGISSFLIEPMCKRMGARLVWASSNFIVFVCMAGTAIISFVSLRQMSDGVQDVIGANETTKIASLVIFTLLGFPLAVTYSVPFSVTAELTADSGGGQGLAIGVLNLAIVVPQMIVSLGAGPWDALFGGGNVPAFALASVASLAAGVIAVHKLPVLSSDSFKSTGFHFG

SEQ ID NO: 22898 - protein, 805 aa, Solanum tuberosum subsp. tuberosum
MAERVLTRVHSLRERVDATLAAHRNEILLFLSRIESHGKGILKPHELLAEFDAIRQDDKNKLNEHAFEELLKSTQEAIVLPPWVALAIRLRPGVWEYIRVNVNALVVEELSVPEYLQFKEELVDGASNGNFVLELDFEPFTASFPKPTLTKSIGNGVEFLNRHLSAKMFHDKESMTPLLEFLRAHHYKGKTMMLNDRIQNSNTLQNVLRKAEEYLIMLSPDTPYFEFEHKFQEIGLEKGWGDTAERVLEMVCMLLDLLEAPDSCTLEKFLGRIPMVFNVVILSPHGYFAQENVLGYPDTGGQVVYILDQVPALEREMLKRIKEQGLDIIPRILIVTRLLPDAVGTTCGQRIEKVYGAEHSHILRVPFRTEKGIVRKWISRFEVWPYMETFIEDVAKEISAELQAKPDLIIGNYSEGNLAASLLAHKLGVTQCTIAHALEKTKYPDSDIYWKKFDEKYHFSSQFTADLIAMNHTDFIITSTFQEIAGSKDTVGQYESHMAFTMPGLYRVVHGINVFDPKFNIVSPGADINLYFSYSETEKRLTAFHPEIDELLYSDVENDEHLCVLKDRTKPILFTMARLDRVKNLTGLVEWYAKNPRLRGLVNLVVVGGDRRKESKDLEEQAEMKKMYELIETHNLNGQFRWISSQMNRVRNGELYRYIADTKGAFVQPAFYEAFGLTVVEAMTCGLPTFATNHGGPAEIIVHGKSGFHIDPYHGEQAADLLADFFEKCKKEPSHWETISTGGLKRIQEKYTWQIYSERLLTLAAVYGFWKHVSKLDRLEIRRYLEMFYALKYRKMAEAVPLAAE

SEQ ID NO: 22899 - protein, 352 aa, Homo sapiens [sequence omitted]

SEQ ID NO: 22900 - protein, 177 aa, Nicotiana tabacum
IRSHLIKLCGEAEGLLESHYSKILGSFENPLHHLDIFPYFDNYIKLSLLEFNILTKNTTKPPNKIAFIGSGPLPLTSLVLATKHLTTTYFHNYDISSEANSLASRLVASDPDLSDRMTFHTTDVMDVTCALKDYDVVFLAALVGMDKEEKVKFVDHLAKYMAPGATLMLRMAHGARA

SEQ ID NO: 22901 - protein, 745 aa, Saccharum hybrid cultivar
MSGAALVAIVASIGNLLQGWDNATISAALLYIKKEFKLESEPTVEGLIVAMSLIGATIITTFSGPVSDWIGRLPMLILSSVLYFVSSLIMLWSPNVYVLLLARLINGFGVGLAVTLVPLYISETAPPEIRGLLNTLPQFSGSGGMFLSYCMVFGMSLLPSPDWRIMLGVLALPSLFFFGLTIFYLPESPRWLVSKGRMAEAKKVLQRLRGKDDVTGEMALLVEGLEVGGDTFIEEYIIGPAIEPADDHVADGDRERIILFGPEEGQSWIARPSKGSSMLGSVLSIGSRHGSMVNQNLPLTDPIVTLFGSVHENISLAGGSMRRIVPSKFDSMISITDQHPKTEQWDEENLHRDNEEYATDGAASDYENNVHSPLLSRQNTSAEGKGIAHHGHRGSALGLRRRSLSDEGGEAATSTGIGGGWQLAWKWSEREGEDGKKEGSFKRIYLHQEGVAGSRRGSVVSLPGGGDASEGGKFIHAAALVSQSALYPRDITEQRMAGPATMHPSEAAAKVPSWRDLFEPGVRRALLVGIGIQILQQFAGINGVLYYTPQIMEQAGVAVLISNLGLSSASASILISSVTALLMLPSIGLAMRLMDVSGRRFLLLSTIPVLIASLIVLVVSNVIELGTVVHAVLSTISVITYLCCFKMGFGPIPNILCAEFFPTRVRGICIAICALIFWVGDIIVTYSLPVMLNAIGLEGVFGIYAVACAIAFVFVYLKVPETKGMPLEVITEFFAVGAKQAVAKA

SEQ ID NO: 22902 - protein, 521 aa, Oryzias latipes
MALMVLPFIGPLSVLEGLIALTTVCVVYLLLKHFNKEIPGGLRQLPGPTPLPIIGNLLELGSKPYLSLTEMSKRFGDVFQIQIGMRPVVVLSGNETVRQALIKQGDDFSGRPDLYSFQFINDGKSLAFSTDQAGVWRARRKLAYSALRSFSSLEGSNAEYSCMLEEHICKETEHLVKEIEKVMKTEGKFDPYRYIVVSVANVICGMCFGRRYDHHDQELVGLVNLSEDFVQVTGSGNPADFIPALRYLPSKAMKKFVEINNRFQCFVQKIVNEHYATYDKDNIRDITDSLIDHCEDRKLDENSNIQMSDEKVVGIVNDLFGAGFDTISTALSWAVGYLVAYPDIEKRLFEEIKENIGLNRNPTISDRSNLPLTEAFILEIFRHSSFLPFTIPHCTTRDTSLNGYYIPKDTCVFINQWQINHDPKLWQDPSSFNPDRFLSEDGSEVNRLDGEKVMVFGLGKRRCIGEVIARNEVFLFLAIMIQKLCFEEMPGEPLDLTPEYGLTMKHKRCNVRASLRLKDGC

SEQ ID NO: 22903 - protein, 256 aa, Sambucus nigra
MSLACIASLVISLFSVVEARIPGNYGGGAWESAHATFYGGSDASGTMGGACGYGNLYSQGYGVNTAALSTALFNKGESCGACFEIKCANDPNWCHSGSPSIMVTATNFCPPNYALPNDNGGWCNPPRTHFDLAMPMFLKIAEYRAGIVPVAYRRVPCRKQGGVRFTINGFRYFNLVLISNVAGAGDIVRVSVKGSRTGWMSMSRNWGQNWQSNTVLVGQSLSFRVTGSDRRTSTSWNIVPANWQFGQTFTGKNFRV

SEQ ID NO: 22904 - protein, 249 aa, Sambucus nigra
MGLSAFTIVPLVFLSFCLCLRSTFGGWESAHATFYGGGDASGTMGGACGYGNLYSQGYGTDTAALSTALFNNGLSCGSCYQIKCNDDPRWCLPGTIMVTATNFCPPNPGLSNDNGGWCNPPLQHFDLAEPAFLQIAQYRAGIVPVAFQRVPCVKKGGIRFTINGHSYFNLVLITNVGGAGDVHSVSIKGSKTGWQAMSRNWGQNWQSNSYLNGQTLSVQVTTSDGRTVTSNNVAPGDWQFGQTFQGGQF

SEQ ID NO: 22905 - protein, 215 aa, Aspergillus oryzae
MSSTSPSKEPEVEPEVQSGEEQEQMDKEQQDQAQNQGEFEVKEQDRWLPIANVARIMKLALPDNAKIAKEAKECMQECVSEFISFITSEASEKCQQEKRKTVNGEDILFAMTSLGFENYAEALKIYLSKYRETQSARGEHQNRPTSSGYASGGPVGGVSSAPGGRPATAGGFPDAADNTNSIMNPSLDPTEQDPSAYGYPPMVGQPHNGTAGDSY

SEQ ID NO: 22906 - protein, 978 aa, Brassica napus
MAMRLLKTHLLFLHLHYVISILLLSFSPCFASTDMDHLLTLKSSMVGPNGHGLHDWVRSPSPSAHCSFSGVSCDGDARVISLNVSFTPLFGTISPEIGMLDRLVNLTLAANNFSGMLPLEMKSLTSLKVLNISNNVNLNGTFPGEILTPMVDLEVLDAYNNNFTGPLPPEIPGLKKLRHLSLGGNFLTGEIPESYGDIQSLEYLGLNGAGLSGESPAFLSRLKNLKEMYVGYFNSYTGGVPPEFGELTNLEVLDMASCTLTGEIPTTLSNLKHLHTLFLHINNLTGNIPPELSGLISLKSLDLSINQLTGEIPQSFISLWNITLVNLFRNNLHGPIPEFIGDMPNLQVLQVWENNFTLELPANLGRNGNLKKLDVSDNHLTGLIPMDLCRGGKLETLVLSDNFFFGSIPEKLGRCKSLNKIRIVKNLLNGTVPAGLFTLPLVTIIELTDNFFSGELPGEMSGDLLDHIYLSNNWFTGLIPPAIGNFKNLQDLFLDRNRFSGNIPREVFELKHLTKINTSANNLTGDIPDSISRCTSLISVDLSRNRIGGDIPKDIHDVINLGTLNLSGNQLTGSIPIGIGKMTSLTTLDLSFNDLSGRVPLGGQFLVFNDTSFAGNPYLCLPRHVSCLTRPGQTSDRIHTALFSPSRIAITIIAAVTALILISVAIRQMNKKKHERSLSWKLTAFQRLDFKAEDVLECLQEENIIGKGGAGIVYRGSMPNNVDVAIKRLVGRGTGRSDHGFTAEIQTLGRIRHRHIVRLLGYVANRDTNLLLYEYMPNGSLGELLHGSKGGHLQWETRHRVAVEAAKGLCYLHHDCSPLILHRDVKSNNILLDSDFEAHVADFGLAKFLLDGAASECMSSIAGSYGYIAPEYAYTLKVDEKSDVYSFGVVLLELIAGKKPVGEFGEGVDIVRWVRNTEGEIPQPSDAATVVAIVDQRLTGYPLTSVIHVFKIAMMCVEDEATTRPTMREVVHMLTNPP

SEQ ID NO: 22907 - protein, 264 aa, Klebsiella pneumoniae
MMPEIKLFMFQSGTQHCRYQHIRMNQGVGEHYEIPVPWFLLTHPDGFTLIDGGLAVEGLKDPSGYWGSTVEQFKPVMSEEQGCVEQLKRIGIAPEDIRYVVLSHLHSDHTGAIGRFPHATHVVQRQEYEYAFAPDWFTSGAYCRRDFDRPQLNWLFLNGLSDDHYDLYGDGTLQCIFTPGHSPGHQSFLIRLPGGTNFTLAIDAAYTLDHYHEKALPGLMTSATDVAQSVRKLRQLTERYHAVFIPGHDPEEWKKNRLAPACYY

SEQ ID NO: 22908 - protein, 352 aa, Mus musculus
MESGSRPSLGQVILLGTSSMVTAVLYSIYRQKAQVAQELKGAKKIHLGEDLKGILSEAPGKCVPYAVIEGAVRSVKETLNSQFVENCKGVIQRLSLQEHKMVWNRTTHLWNDYSKIIHQRTNTVPFDLVPHEDGVAVSVRVLKPLDSVDLGLETVYEKFHPSVQSFTDAIGHYISGERPKGIQETEEMLKVGATLTGIGELVLDNNAVRLQPPKQGMQYYLSSQDFDSLLHRQESSVRLWKILVLVFGFATCATLFFILRKQYLHRQERLRQQQLQEEFLEHEAQLLSQASPEDRESLKSACVVCLSNFKSCVFLECGHVCSCRQCYLALPEPKRCPICRREITRVIPLYNS

SEQ ID NO: 22909 - protein, 508 aa, Mus musculus
MLSSKKKYIVNSNSGIKAQIQFADQKQEFNKRPTKIGRRSLSRSISQSSTDSYSSAASYTDSSDDETSPRDKQQKNSKGSSDFCVKNIKQAEFGRREIEIAEQEMPALMALRKRAQGEKPLAGAKIVGCTHITAQTAVLMETLGALGAQCRWAACNIYSTLNEVAAALAESGFPVFAWKGESEDDFWWCIDRCVNVEGWQPNMILDDGGDLTHWIYKKYPNMFKKIKGIVEESVTGVHRLYQLSKAGKLCVPAMNVNDSVTKQKFDNLYCCRESILDGLKRTTDMMFGGKQVVVCGYGEVGKGCCAALKAMGSIVYVTEIDPICALQACMDGFRVVKLNEVIRQVDIVITCTGNKNVVTREHLDRMKNSCIVCNMGHSNTEIDVASLRTPELTWERVRSQVDHVIWPDGKRIVLLAEGRLLNLSCSTVPTFVLSITATTQALALIELYNAPEGRYKQDVYLLPKKMDEYVASLHLPTFDAHLTELTDEQAKYLGLNKNGPFKPNYYRY

SEQ ID NO: 22910 - protein, 297 aa, Mus musculus
MEDYIKIEKIGEGTYGVVYKGRHRVTGQIVAMKKIRLESEEEGVPSTAIREISLLKELRHPNIVSLQDVLMQDSRLYLIFEFLSMDLKKYLDSIPPGQFMDSSLVKSYLHQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLVYDPAKRISGKMALKHPYFDDLDNQIKKM

SEQ ID NO: 22911 - protein, 735 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFHIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTIKITHKNQMPMLMGPPPRSTNFFGFLS

SEQ ID NO: 22912 - protein, 626 aa, Homo sapiens
MMANDAKPDVKTVQVLRDTANRLRIHSIRATCASGSGQLTSCCSAAEVVSVLFFHTMKYKQTDPEHPDNDRFILSRGHAAPILYAAWVEVGDISESDLLNLRKLHSDLERHPTPRLPFVDVATGSLGQGLGTACGMAYTGKYLDKASYRVFCLMGDGESSEGSVWEAFAFASHYNLDNLVAVFDVNRLGQSGPAPLEHGADIYQNCCEAFGWNTYLVDGHDVEALCQAFWQASQVKNKPTAIVAKTFKGRGIPNIEDAENWHGKPVPKERADAIVKLIESQIQTNENLIPKSPVEDSPQISVTDIKMTSPHAYKVGDKIATQKTYGLALAKLGRANERVIVLSGDTMNSTFSEIFRKEHPERFIECIIAEQNMVSVALGCATRGRTIAFAGAFAAFFTRAFDQLRMGAISQANINLIGSHCGVSTGEDGVSQMALEDLAMFRSIPNCTVFYPSDAISTEHAIYLAANTKGMCFIRTSQPETAVIYTPQENFEIGQAKVVRHGVNDKVTVIGAGVTLHEALEAADHLSQQGISVRVIDPFTIKPLDAATIISSAKATGGRVITVEDHYREGGIGEAVCAAVSREPDILVHQLAVSGVPQRGKTSELLDMFGISTRHIIAAVTLTLMK

SEQ ID NO: 22913 - protein, 192 aa, Homo sapiens
MASKGPSASASPENSSAGGPSGSSNGAGESGGQDSTFECNICLDTAKDAVISLCGHLFCWPCLHQWLETRPNRQVCPVCKAGISRDKVIPLYGRGSTGQQDPREKTPPRPQGQRPEPENRGGFQGFGFGDGGFQMSFGIGAFPFGIFATAFNINDGRPPPAVPGTPQYVDEQFLSRLFLFVALVIMFWLLIA

SEQ ID NO: 22914 - protein, 345 aa, Homo sapiens
MPRIDADLKLDFKDVLLRPKRSSLKSRAEVDLERTFTFRNSKQTYSGIPIIVANMDTVGTFEMAAVMSQHSMFTAIHKHYSLDDWKLFATNHPECLQNVAVSSGSGQNDLEKMTSILEAVPQVKFICLDVANGYSEHFVEFVKLVRAKFPEHTIMAGNVVTGEMVEELILSGADIIKVGVGPGSVCTTRTKTGVGYPQLSAVIECADSAHGLKGHIISDGGCTCPGDVAKAFGAGADFVMLGGMFSGHTECAGEVIERNGRKLKLFYGMSSDTAMNKHAGGVAEYRASEGKTVEVPYKGDVENTILDILGGLRSTCTYVGAAKLKELSRRATFIRVTQQHNTVFS

SEQ ID NO: 22915 - protein, 355 aa, Mus musculus
MAGCCCLSAEEKESQRISAEIERQLRRDKKDARRELKLLLLGTGESGKSTFIKQMRIIHGSGYSDEDRKGFTKLVYQNIFTAMQAMIRAMDTLRIQYMCEQNKENAQIIREVEVDKVTALSRDQVAAIKQLWLDPGIQECYDRRREYQLSDSAKYYLTDIERIAMPSFVPTQQDVLRVRVPTTGIIEYPFDLENIIFRMVDVGGQRSERRKWIHCFESVTSIIFLVALSEYDQVLAECDNENRMEESKALFRTIITYPWFLNSSVILFLNKKDLLEEKIMYSHLISYFPEYTGPKQDVKAARDFILKLYQDQNPDKEKVIYSHFTCATDTENIPFVFAAVKDTILQLNLREFNLV

SEQ ID NO: 22916 - protein, 374 aa, Homo sapiens
MEADSPAGPGAPEPLAEGAAAEFSSLLRRIKGKLFTWNILKTIALGQMLSLCICGTAITSQYLAERYKVNTPMLQSFINYCLLFLIYTVMLAFRSGSDNLLVILKRKWWKYILLGLADVEANYVIVRAYQYTTLTSVQLLDCFGIPVLMALSWFILHARYRVIHFIAVAVCLLGVGTMVGADILAGREDNSGSDVLIGDILVLLGASLYAISNVCEEYIVKKLSRQEFLGMVGLFGTIISGIQLLIVEYKDIASIHWDWKIALLFVAFALCMFCLYSFMPLVIKVTSATSVNLGILTADLYSLFVGLFLFGYKFSGLYILSFTVIMVGFILYCSTPTRTAEPAESSVPPVTSIGIDNLGLKLEENLQETHSAVL

SEQ ID NO: 22917 - protein, 729 aa, Homo sapiens
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAAAVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIAWQLPQYALVTAGEVMFSVTGLEFSYSQAPSGMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 22918 - protein, 568 aa, Mus musculus
MPGTDLLKLKDFEPYLEILESYSTKAKNYVNGYCTKYEPWQLIAWSVLCTLLIVWVYELIFQPESLWSRFKKKLFKLIRKMPFIGRKIEQQVSKAKKDLVKNMPFLKVDKDYVKTLPAQGMGTAEVLERLKEYSSMDGSWQEGKASGAVYNGEPKLTELLVQAYGEFTWSNPLHPDIFPGLRKLEAEIVRMTCSLFNGGPDSCGCVTSGGTESILMACKAYRDLALEKGIKTPEIVAPESAHAAFDKAAHYFGMKIVRVALKKNMEVDVQAMKRAISRNTAMLVCSTPQFPHGVMDPVPEVAKLAVRYKIPLHVDACLGGFLIVFMEKAGYPLEKPFDFRVKGVTSISADTHKYGYAPKGSSVVMYSNEKYRTYQFFVGADWQGGVYASPSIAGSRPGGIIAACWAALMHFGENGYVEATKQIIKTARFLKSELENIKNIFIFGDPQLSVIALGSNDFDIYRLSNMMSAKGWNFNYLQFPRSIHFCITLVHTRKRVAIQFLKDIRESVTQIMKNPKAKTTGMGAIYGMAQATIDRKLVAEISSVFLDCLYTTDPVTQGNQMNGSPKPR

SEQ ID NO: 22919 - protein, 493 aa, Mus musculus
MGTTKVTPSLVFAVTVATIGSFQFGYNTGVINAPETILKDFLNYTLEERLEDLPSEGLLTALWSLCVAIFSVGGMIGSFSVGLFVNRFGRRNSMLLVNLLAIIAGCLMGFAKIAESVEMLILGRLLIGIFCGLCTGFVPMYIGEVSPTALRGAFGTLNQLGIVVGILVAQIFGLDFILGSEELWPGLLGLTIIPAILQSAALPFCPESPRFLLINKKEEDQATEILQRLWGTSDVVQEIQEMKDESVRMSQEKQVTVLELFRSPNYVQPLLISIVLQLSQQLSGINAVFYYSTGIFKDAGVQEPIYATIGAGVVNTIFTVVSLFLVERAGRRTLHMIGLGGMAVCSVFMTISLLLKDDYEAMSFVCIVAILIYVAFFEIGPGPIPWFIVAELFSQGPRPAAIAVAGCCNWTSSFLVGMLFPSAAAYLGAYVFIIFAAFLIFFLIFTFFKVPETKGRTFEDIARAFEGQAHSGKGPAGVELNSMQPVKETPGNA

SEQ ID NO: 22920 - protein, 501 aa, Mus musculus
MEEKHQEETGELTLVLALATLIAAFGSSFQYGYNVAAVNSPSEFMQQFYNDTYYDRNEENIESFTLTLLWSLTVSMFPFGGFIGSLMVGTLVNKLGRKGALLFNNIFSILPAILMGCSQIAQSFELIIISRLLVGICAGISSNVVPMYLGELAPKNLRGALGVVPQLFITVGILVAQLFGLRSLLANEDGWPVLLGLTGVPAGLQLLLLPFFPESPRYLLIQKKDEAAAERALQTLRGWKDVHLEMEEIRKEDEAEKAAGFISVWKLFTMQSLRWQLISMIVLMAGQQLSGVNAIYYYADQIYLSAGVKSDDVQYVTAGTGAVNVFMTILTIFVVELWGRRFLLLVGFSTCLIACLVLTAALALQNTISWMPYISIVCVIVYVIGHALGPSPIPALLITEIFLQSSRPAAYMIGGSVHWLSNFTVGLIFPFIQMGLGPYSFIIFATICFLTTIYIFMVVPETKGRTFIEINQIFTMKNKVSDVYPKKEEELGALPHAILEQ

SEQ ID NO: 22921 - protein, 246 aa, Mus musculus
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLILNATQAESKVFYLKMKGDYFRYLSEVASGENKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 22922 - protein, 428 aa, Mus musculus
MGPPPGIGVYCRGGCGAARLLAWCFLLALSPHAPGSRGAEAVWTAYLNVSWRVPHTGVNRTVWELSEEGVYGQDSPLEPVSGVLVPPDGPGALNACNPHTNFTVPTVWGSTVQVSWLALIQRGGSCTFADNIHLASERGASGAVIFNFPGTRNEVIPMSHPGAGDIVAIMIGNLKGTKILQSIQRGIQVTMVIEVGKKHGPWVNHYSIFFVSVSFFIITAATVGYFIFYSARRLRNARAQSRKQRQLKADAKKAIGKLQLRTLKQGDKEIGPDGDSCAVCIELYKPNDLVRILTCNHIFHKTCVDPWLLEHRTCPMCKCDILKALGIEVDVEDGSVSLQVPVSNEASNTASPHEEDSRSETASSGYASVQGADEPPLEEHAQSANENLQLVNHEANSVAVDVVPHVDNPTFEEDETPDQEAAVREIKS

SEQ ID NO: 22923 - protein, 415 aa, Mus musculus
MAENLYRARSRVYSPSVLFLHPDMGIGGAERLVLDAALALQEYGCDVKIWTAHYDPNHCFIETRELSVQCAGDWLPRSLGWGGRGAAICSYVRMVFLALYVLFLSGEEFDVVVCDQVSACIPVFKLARRRKRVLFYCHFPDLLLTQRNSALKKFYRAPIDWIEEYTTGMADRILVNSQYTASVFKETFKTLSHRNPDVLYPSLNIGSFDLAIPEKIDDLVPKGKQFLFLSINRYERKKNLPLALRSLVQLRNRLPSQEWDKVHLFMAGGYDDRIPENVEHYKELKKMVQESDLERHVTFLRSFSDRQKISLLHGCLCVLYTPSNEHFGIVPLEAMYMQCPVIAVNNGGPLESIVHKVTGFLCEPDPVHFSEAMEKLIHKPSLKATMGLAGKARVAEKFSADAFADQLYQYVTKLV

SEQ ID NO: 22924 - protein, 730 aa, Mus musculus
MAKEKGLISPEDFAQLQKYIEYSTKRVSDVLKVFDDGEMNRFCQGDAIGYLGFEQFMKMYLEMEEVPHHLCWALFWSFHTSQVAAEKTKSKANVICLSDVYCYFTLLEGGRPEDKLEFTFKLYDMDRNGILDSTEVEKIILQMMRVAEYLDWDVSELRPILQEMMREMDQDGSGSVSLDEWVRAGATTVPLLVLLGMDVTMKDDGNHIWRPKRFTRLVYCNLCEQSISLGKQGLSCNFCKYIVHDHCAMKAQPCEVSTYAKSRKDIGVQSHLWVRGGCHSGRCDRCQKKIRTYHSLTGLHCVWCHLEIHDDCLQAVGPECDCGLLRDHILPPCSIYPSVLVSGQECKHKTTDDTSLCTPEAFRIEPVSNTHPLLVFINLKSGGKQGQSVLWKFQYILNPRQVFDLKDGPEPGLRFFKDVPQFRILVCGGDGTVGWVLETIDKANFATVPPVAVLPLGTGNDLARCLRWGRGYEGENLRKILKDIELSKVVYLDRWFLEVIPQQNGEKSDPVPSQIINNYFSIGVDASIAHRFHLMREKYPEKFNSRMKNKLWYFEFATSESIFSTCKKLEESVTVEICGKLLDLSDLSLEGIAVLNIPSTHGGSNLWGDTKRPHGDTCEINQALGSAAKIITDPDILKTCVPDMSDKRLEVVGIEGAIEMGQIYTRLKSAGHRLAKCSEITFQTTKTLPMQIDGEPWMQAPCTIKITHKNQMPMLMGPPSNSYNFFGFWS

SEQ ID NO: 22925 - protein, 163 aa, Mus musculus
MPTIKLQSSDGEIFEVDVEIAKQSVTIKTMLEDLGMDDEGNDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVRKENQWCEEK

SEQ ID NO: 22926 - protein, 374 aa, Mus musculus
MGTAGKVIKCKAAVLWGVNQPFSIEEIEVAPPKAKEVRVKILATGICRTDDHIIKGSMVSKFPVIVGHEAVGVVESVGEGVTTVRPGDKVIPLFLPQCRECNACLNPEGNLCIRSDLTGRGVLADGTTRFTCKGKPVQHFMNTSTFTEYTVLDESSVAKVDGAAPPEKACLIGCGFSTGYGAAVKTAKVTPGSTCVVFGLGGVGLSVIMGCKAAGASRIIGIDINKDKFQKALAVGATECISPKDSTKPISEVLSDMTGNTIQYTFEVIGRLETMVDALSSCHMNYGTSVVVGAPPSAKMLTYDPMLLFTGRTWKGCVFGGWKSRDDVPKLVTEFLEKKFDLDQLITHTLPFNNINEGFELLYSGKSIRTVLTF

SEQ ID NO: 22927 - protein, 415 aa, Mus musculus
MLQKTVLLLALVAQVLMLENGLLRTPPMGWLAWERFRCNIDCVEDPKNCISERLFMEMADRLAQDGWRDLGYVYLNIDDCWIGGRDASGRLIPDPKRFPHGIAFLADYAHSLGLKLGIYEDMGKMTCMGYPGTTLDKVELDAETFAEWKVDMLKLDGCFSSSRERAEGYPKMAAALNATGRPIAFSCSWPAYEGGLPPKVNYTEVSRVCNLWRNYKDIQDSWKSVLSILDWFVRHQDVPQPVAGPGHWNDPDMLLIGNFGLSFDESRAQMALWTVLAAPLLMSTDLRTISPQNMDILQNPLMIKINQDPLGIQGRRILKSKSHIEVFKRYLSNQASALVFFSRRTDMPFRFHCSLLELNYPKGRVYEGQNVFTGDIFSGLQTEVNFTVIINPSGVVMWYLYPIKDLGISTMMSHW

SEQ ID NO: 22928 - protein, 517 aa, Mus musculus
MKQSSNVPAFLSKLWTLVEETHTNEFITWSQNGQSFLVLDEQRFAKEVLPKYFKHNNMASFVRQLNMYGFRKVVHIESGIIKQERDGPVEFQHPYFKQGQDDLLENIKRKVSSSKPEENKIRQEDLTKIISSAQKVQIKQETIESRLSELKSENESLWKEVSELRAKHAQQQQVIRKIVQFIVTLVQNNQLVSLKRKRPLLLNTNGAPKKNLYQHIVKEPTDNHHHKVPHSRTEGLKSRERISDDIIIYDVTDDNVDEENIPVIPETNEDVVVDSSNQYPEIVIVEDDNEDEYAPVIQSGEQSEPAREPLRVGSAGSSSPLMSSAVQLNGSSSLTSEDPVTMMDSILNDNINLLGKVELLDYLDSIDCSLEDFQAMLSGRQFSIDPDLLVDSENKGLEATKSSVVQHVSEEGRKSKSKPDKQLIQYTAFPLLAFLDGNSASAIEQGSTTASSEVVPSVDKPIEVDELLDSSLDPEPTQSKLVRLEPLTEAEASEATLFYLCELAPAPLDSDMPLLDS

SEQ ID NO: 22929 - protein, 720 aa, Mus musculus
MAEKFESLMNIHGFDLGSRYMDLKPLGCGGNGLVFSAVDNDCDKRVAIKKIVLTDPQSVKHALREIKIIRRLDHDNIVKVFEILGPSGSQLTDDVGSLTELNSVYIVQEYMETDLANVLEQGPLLEEHARLFMYQLLRGLKYIHSANVLHRDLKPANLFINTEDLVLKIGDFGLARIMDPHYSHKGHLSEGLVTKWYRSPRLLLSPNNYTKAIDMWAAGCIFAEMLTGKTLFAGAHELEQMQLILDSIPVVHEEDRQELLSVIPVYIRNDMTEPHRPLTQLLPGISREALDFLEQILTFSPMDRLTAEEALSHPYMSIYSFPTDEPISSHPFHIEDEVDDILLMDETHSHIYNWERYHDCQFSEHDWPIHNNFDIDEVQLDPRALSDVTDEEEVQVDPRKYLDGDREKYLEDPAFDTSYSAEPCWQYPDHHENKYCDLECSHTCNYKTRSSPYLDNLVWRESEVNHYYEPKLIIDLSNWKEQSKEKSDKRGKSKCERNGLVKAQIALEEASQQLAERERGQGFDFDSFIAGTIQLSAQHQSADVVDKLNDLNSSVSQLELKSLISKSVSREKQEKGRANLAQLGALYQSSWDSQFVSGGEECFLISQFCCEVRKDEHAEKENTYTSYLDKFFSRKEDSEMLETEPVEEGKRGERGREAGLLSGGGEFLLSKQLESIGTPQFHSPVGSPLKSIQATLTPSAMKSSPQIPHKTYSSILKHLN

SEQ ID NO: 22930 - protein, 372 aa, Homo sapiens
MKQLPVLEPGDKPRKATWYTLTVPGDSPCARVGHSCSYLPPVGNAKRGKVFIVGGANPNRSFSDVHTMDLGKHQWDLDTCKGLLPRYEHASFIPSCTPDRIWVFGGANQSGNRNCLQVLNPETRTWTTPEVTSPPPSPRTFHTSSAAIGNQLYVFGGGERGAQPVQDTKLHVFDANTLTWSQPETLGNPPSPRHGHVMVAAGTKLFIHGGLAGDRFYDDLHCIDISDMKWQKLNPTGAAPAGCAAHSAVAMGKHVYIFGGMTPAGALDTMYQYHTEEQHWTLLKFDTLLPPGRLDHSMCIIPWPVTCASEKEDSNSLTLNHEAEKEDSADKVMSHSGDSHEESQTATLLCLVFGGMNTEGEIYDDCIVTVVD

SEQ ID NO: 22931 - protein, 762 aa, Triticum aestivum
MAILGELGTEILIPVCGVVGIVFAVAQWFIVSKVKVTPGAASAAGGGKNGYGDYLIEEEEGLNDHNVVVKCAEIQTAISEGATSFLFTMYQYVGMFMVVFAAVIFVFLGSIEGFSTKGQPCTYSTGTCKPALYTALFSTASFLLGAITSLVSGFLGMKIATYANARTTLEARKGVGKAFITAFRSGAVMGFLLSSSGLGVLYITINVFKMYYGDDWEGLFESITGYGLGGSSMALFGRVGGGIYTKAADVGADLVGKVERNIPEDGPRNPAVIADNVGDNVGDIAGMGSDLFGSYAESSCAALVVASISSFGINHDFTAMCYPLLVSSVGIIVCLLTTLFATDFFEIKAASEIEPALKKQLIIFTALMTIGVAVINWLALPAKFTIFNFGAQKDVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTTATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTRRVCESAALKMVEKVRRQFNTIPGLMKGTAKPDYATCVKISTDASIREMIPPGALVMLTPLIVGTLFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGVLFKYI

SEQ ID NO: 22932 - protein, 262 aa, Plasmodium knowlesi
MATSEDLKQLRSDCTYRSKLAEQAERYDEMADAMRTLVEQCVNNDKDELTVEERNLLSVAYKNAVGARRASWRIISSVEQKEMSKANVHNKNIAATYRKKVEEELNNICQDILNLLTKKLIPNTSESESKVFYYKMKGDYYRYISEFSCDEGKKEASNFAQEAYQKATDIAENELPSTHPIRLGLALNYSVFFYEILNQPHQACEMAKRAFDDAITEFDNVSEDSYKDSTLIMQLLRDNLTLWTSDLQGDQTEEKSKDEGLE

SEQ ID NO: 22933 - protein, 234 aa, Plasmodium falciparum
LAEQAERYDEMADAMRTLVEQCVNNDKDELTVEERNLLSVAYKNAVGARRASWRIISSVEQKEMSKANVHNKNVAATYRKKVEEELNNICQDILNLLTKKLIPNTSESESKVFYYKMKGDYYRYISEFSCDEGKKEASNFAQEAYQKDTDIAENELPSTHPIRLGLALNYSVFFYEILNQLHQACEMAKRAFDDAITEFDNVSEDSYKDSTLIMQLLRDNLTLWTSDLQGDQTE

SEQ ID NO: 22934 - protein, 259 aa, Datura stramonium
AGRWNLEGCTALVTGGSRGIGYGIVEELASLGASVYTCSRNQKELNDCLTQWRSKGFKVEASVCDLSSRSERQELMNTVANHFHGKLNILVNNAGIVIYKEAKDYTVEDYSLIMSINFEAAYHLSVLAHPFLKASERGNVVFISSVSGALAVPYEAVYGATKGAMDQLTRCLAFEWAKDNIRVNGVGPGVIATSLVEMTIQDPEQKENLNKLIDRCALRRMGEPKELAAMVAFLCFPAASYVTGQIIYVDGGLMANCGF

SEQ ID NO: 22935 - protein, 343 aa, Rattus norvegicus
MEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLHARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 22936 - protein, 537 aa, Capsicum annuum
MGNACRGSFRAKTFQGSYPQNHSTSKHSKVEEEQQPDPAPLVVKDHSTSTKNMNHRSSANQSCCVLGHKTPNIRDLYALGRKLGQGQFGTTYLCTELSTCIDYACKSIAKRKLISKEDVEDVRREIQIMHHLAGHKNIVSIKGAYEDPLYVHIVMELCGGGELFDRIIQRGHYTERKAADLTKIIVGVVEACHFMHRDLKPENFLLVNKDDDFSLKAIDFGLSVFFKPGQIFTDVVGSPYYVAPEVLLKNYGPEADVWTAGVILYILLSGVPPFWAETQQGIFDAVLKGHIDFDSDPWPLISESAKDLIRKMLCMRPSERLTAHEVLCHPWICENGVAPDRALDPAVLSRLKHFSAMNKLKKMALRVIAESLSEEEIAGLKEMFKAMDTDNSGAITFDELKAGLRKYGSTLKDIEIRELMDAADVDNSGTIDYGEFIAATIHLNKLDREEHLMAAFQYFDKDGSGYITVDELQQACADHNITDVLFEDIIREVDQDTDGRIDYGEFVAMMQKGNPCIGRRTMRNSLNFSMRDAPGAH

SEQ ID NO: 22937 - protein, 137 aa, Lotus japonicus
AGGAYETFKKNLPTNSVLFYTVILEIAPTAKDMFSFLKESGPKHSPQLQAHAEKVFALTRDAATQLVAKGEVTLADASLGAVHVQKAVTDPHFVVVKEALLQTVKEAVGADEWSDDLSTAWEGAYDGLATAIKKAMG

SEQ ID NO: 22938 - protein, 191 aa, Homo sapiens
MEAKAAPKPAASGACSVSAEETEKWMEEAMHMAKEALENTEVPVGCLMVYNNEVVGKGRNEVNQTKNATRHAEMVAIDQVLDWCRQSGKSPSEVFEHTVLYVTVEPCIMCAAALRLMKIPLVVYGCQNERFGGCGSVLNIASADLPNTGRPFQCIPGYRAEEAVEMLKTFYKQENPNAPKSKVRKKECQKS

SEQ ID NO: 22939 - protein, 403 aa, Mus musculus
MSRRSRLQAKQHAQPNQPDSPQETQIIQAKKRKTAQDVKKRKEEITKKHQYEIRNCWPPVLSGGISPCIIIETPHKEIGTSDFSRFTNYRFKNLFINPSPLPDLSWACSQEVWQNMLQKENRYVHDKHFQVLHSDLEPQMRSILLDWLLEVCEVYTLHRETFYLAQDFFDRFMLTQKDVNKNMPQLIGITSLFIASKLEEIYAPKLQEFAYVTDGACSEVDILKVELNILKALKWELCPVTVISWLNLFLQVDAVKDVPKVLLPQYSQETFIQIAQLLDLCILAIDSLEFQYRILVAAALCHFTSIEVVKKASGLEWDDISECVDWMVPFVSVVKSVSPVKLKTFKKIPMEDRHNIQTHTNYLALLNEVNYVNIYRKGGQLSPVCNGGIMTPPKSTEKPPGKH

SEQ ID NO: 22940 - protein, 206 aa, Xenopus laevis
MDGDSATTDTSQLGISGDYISGSHYVIQPHDGDTEDSLNDPDDTNGSKDSFREQDIYLPIANVARIMKNAVPQTGKIAKDAKECVQECVSEFISFITSEASERCHQEKRKTINGEDILFAMSRLGFDSYVEPLKLYLQKFREAMKGEKGIGGTVTTGDGLGEDLAEEPFTSQIPAGLITTDGQQQNVMVYTTSYQQISGVQQIQFS

SEQ ID NO: 22941 - protein, 202 aa, Ranunculus ficaria
NRQVTYSKRRAGIMKKAKELTVLCDAKVSLIMFSSTGKCVDFISPSISPKAFYDKYRDVTGDDLWKSQYDKMQQELKTLVETNRKLRREIGQRVGEDLSNLSIKELRGLEQDLRDTEKVVRQRKFGLLSSQGETQRKKIRNLAEINGNLWQEYQERMEDEYALANGMSTLELGNGVFSFRLRPSQTNLHNDEEYEIHDLRLA

SEQ ID NO: 22942 - protein, 231 aa, Papaver nudicaule
MGRGKIEIKRIENSTNRQVTYSKRKNGILKKAKEITILCDAHVSLVIFSSTGKMNEYCSSPLIKQLDRYQKASGNKLWDAKHEYLSAEVDRVKKENDNMQIELRHLKGEDLTPLNPRELIPIESALDDGIVGVKAKIKEHYRALKKRTRMLEEDNKRLLTRLSQQQMEIHGRVEMDTMENTGYNNNNQKADGTRDYPAHNDNHHQVPFGFQVPPMQPNLTTVTTTTTTNNK

SEQ ID NO: 22943 - protein, 164 aa, Papaver nudicaule
NRQVTYSKRRNGILKKAKEISILCDANLSLVMISEAGSIDEYSSSPLVEQLARYQKETGNKLWDAKHERLSAEIDRVKKENSNLQIEIRHLKGEDLKPLGPRELYAIENDLEDGYACVRDKIMEQWKKLKRNGRRLEAENKHLSVINQHQQQNKWSWKPTHNAF

SEQ ID NO: 22944 - protein, 229 aa, Dicentra eximia
NRQVTYSKRRNGIMKKAKEITVLCDAEVSLVIFSSTGKMSEYCSPSTTLIKILDRYQKASGKRLWDAKHEYLSSEVDRVKKENDNMQIELRHLKGEDLTSLHPKELISIEDALQNGLVGVRAKQMEFMKMMKKNERMLEEENKRLSYILHNQQIEMADGSNVGEMENNGYHQHHHHHHHHHQKGRGDHYGQAAAAHASSQQMPPFAFRVQPIQPNLHNNNNNTNNTNNK

SEQ ID NO: 22945 - protein, 183 aa, Ranunculus ficaria
NRQVTYSKRRNGIIKKAKEIAILCAAEVSLVIFSSSDKMSEFNSRPLPQILEKYQKSSGNKLWDAKHEYLSQEIARVEKENQSMRQELKHLKGEEINSLQPKELIPIEHALENGITKVKEKQMEIYRMMKRNDRKLEEDNKRLVLKLQHQQQLMNGNGREYPSQMPPFTFQLHPSQPNLQEIK

SEQ ID NO: 22946 - protein, 180 aa, Ranunculus bulbosus
NRQVTFSKRRNGILKKAKEIAILCEAKVSLVIFTSNSKMFEFNSHPLPEILHKYQKDTGNKLWDAKHEYLHQECARIKKENESMQRELGHLKGEDINSLQPIELIPIEQALDDGIARVKERKNEIYRMMKRNDKMLEEENKLLVLKLQQMMNGNSREHPSQMPMPFTFRVQPAQPNLQDN

SEQ ID NO: 22947 - protein, 188 aa, Ranunculus bulbosus
NRQVTYTKRKNGILKKAKEISILCSAEVSLVIFSCNNKMSEFHSHSLINSLKRYHKLCPGKRLWDAKHEFLHQEIERIENENKSMQIELRHLKGEDINSLQPRELIPIERALDNGITKVRAKIDEIPRILEKNGRMIEEENKLLAFKLEQQQQQINGNGRNVDHGYPPPSQMPFTFLVQPIHPNFQDN

SEQ ID NO: 22948 - protein, 200 aa, Syringa vulgaris
NRQVTYSERRNGLMKKAKEISVLCDAQVSVVIFASSGKMHEFCSPSTTLIDMLDQYHKLSGKKLWDAKHEHLDNEINRIKKENDRMQTELRHLVGEDITTLNYKELMVLEEVLENGISSLKAKQMEFVPAMRKHNEMLGGRRTGGLQFKLRQMHLDPTMDEHNVLENGDVYHQQGVGDYEYQMPFAFRVQPMQPNLQDRF

SEQ ID NO: 22949 - protein, 196 aa, Delphinium ajacis
NRQVTYSKRRNGILKKAKEITVLCDAEVSLVVFSSTGKMSEFISPNASLIKILDKYQRTSGRRLWDAKHEYLNSEVERIKKENDNMQIELRHLKGEDLTSLNPKELIPIEAALQNGLTEVRAKQAEVWKMMKKNDRLLEEENKHLNYVLQKQQQMHMNGNARDLENEYHQNGRDYPSHMPFTFRAQPMQPNLQENQ

SEQ ID NO: 22950 - protein, 186 aa, Michelia figo
GGILKKAKEITVLCDAQVSLVIFSSTGKMSEYCSPSTELVNVLDRYHKSAGKKLWDAKHEHLSNELERIKKENDSMHVKLRHLKGEDITSLHPKELIPIEEALENGLACVRSRQMQCLKMLKKNERSLEEENRRLSYILQHQQQLAMDVNVREMDHGYHQREREYHPQMPFTFRVQPIQPNLHQNK

SEQ ID NO: 22951 - protein, 185 aa, Liriodendron tulipifera
GGILKKAKEITVLCDAQVSLVIFSSTGKISEYCSPSTTLVKILDRYQKSSGKKLWDAKHEHLSNEVERIKKENDSMQIKLRHLKGEDITSLHPRELIPIEEALQNGLACVRSKQMEYLKMLKKNERTLEEENKRLSYILHQQQLAMDGNAREMDHGYNQREREYHQQLPFTFRLQPIQPNLHQNQ

SEQ ID NO: 22952 - protein, 169 aa, Peperomia hirta
KGIIKKAQEISVLCDTHVSVLIFSSAGNMGEFCSPKTTMDAILTRYQNSTGTQLWNAKHESLKQEKERIEKENGRLQLRLRQLKGEDITSLKPEELIEIESILDDGLTNIRNKQDKGFGRKEPALGLHLEQQMGVYSGETKYLLNNFAPKSSPIAFHVQPLHPNLQEMK

SEQ ID NO: 22953 - protein, 194 aa, Piper magnificum
IENMTNRQVTYSKRKKGIIKKAQEISVLCDTQVSLVIFSSAGNMGEFCSPKTTMDAILTRYQNSKGSQLWNAKHEYLKQEKERIEKENGRLQLRLRQLKGEDITSLKPEELIEIENILEDGLTNIRNKSDGLLEGSNQEYKGFGGEEPAHGLYLHQQMGLYSGETKGLLNKCAPKSIPIAFHVQPLHPNLQEMK

SEQ ID NO: 22954 - protein, 196 aa, Piper magnificum
IENVSNRQVTFNKRKAGLLKKAREISVLCDAEVALVIVSSSANVKVEEFCSPQNKLEDVLKKYQDLSGNKLWDAKHECLSQEIDRIRKENDAMSIRLRHLEGIDVSSLNHQELEVLEKTLENGLASIRRQEMEIRDARENNIKTEEEEKRRLTYIMHEQHMRMGESLRDLESGSMKRDLPFAFRVQPIQPNLQEQK

SEQ ID NO: 22955 - protein, 202 aa, Syringa vulgaris
NGLFKKAHELTVLCDAKVSIIMISSTQKIHEYISPTSSTKQLFDLYQTTVGVDLWITHYERMQEHLRKLKDINKNLRREIRQRMGESLNDLNYDQIVSLIEDVDDSLRKIRERKYKVIGNQIETSKKKLRNVEEIHRNILLEFDARQEDPQYGLVDNEGDYNSVLGFPNGGPRIIALRLPSNHHPNLHSGGGSDLTTFALLE

SEQ ID NO: 22956 - protein, 207 aa, Pachysandra terminalis
NGIFKKALELSVLCDAKVSIIMVATNRKLHEYTSPHTTTKELYDLYQKASGKSLWNSHYERMNDNLNKLKEINNKLRTEIRQRMGEDLNELRLDELRGLEQNMEECLKNIRDRKEHQLRNQIGTSKKKTRNAEEINRKLIRRLDGMDDDSQYGLEDDGVDDEPAIALTNGNSHIFAFRLHPNQPNLHINGGGYGFHNLHLAWKKLPS

SEQ ID NO: 22957 - protein, 201 aa, Pachysandra terminalis
NGIFKKAKELSVLCDAKVSIIMVATNRKLHEYTSPHTTTKDLYDLYQKASGNSLWNSHYERMKDNLNKLKDINNKLRTEIRQRMGEDLNDLRLEELRGLEQNIQESLMIVGDRKEHQLRNQIGTYKKKSRNAEEINRKLLRRLDGIDDDSQYGLEDDGGDDESAIALTNGNSHIFAFRLQPNQPNLHINGGGYGFHNLHLA

SEQ ID NO: 22958 - protein, 234 aa, Papaver californicum
IENPTNRQVTYSKRRSGIFKKAKELTILCDAQVCLIMFSNTGKVCEYVSPSTTMKEFFDRFRRVTNIDLWASQYETLQEELKKQKEINSRLKKEIRQRTGQDDLNELTFEELRSLEANLLSSVEIVRLRKFHVLGSHTETSKKRNKAMEETHKNLLRATYSQADRDEEFLFYAIPADREGDHNRDYLSSSSSMRTLSINGGDCENSQITFQLQPSQPNLHHAAGGGYLYNQHYV

SEQ ID NO: 22959 - protein, 221 aa, Papaver nudicaule
SGIFKKAKELTILCDAQVCLIMFSNTGKVCEYVSPSTTMKEFFDRFRRITNIDLWASQYETLQEELKTQKEINNKLKKEIRQRTGQDDLSELSLDEMRILEKNLIDSADIVRNRKNHVLNSHTETSKKRNKAQEETYKNLVRALHSQADREEQEFHFYAIPADTEGDHHRDYLSSSSSMRRLSISGGGDCENSQITFQLQPSQPNLHHAAGGGYFYSQHYA

SEQ ID NO: 22960 - protein, 228 aa, Papaver nudicaule
MGRGKIEIKRIENATNRQVTYSKRRSGILKKAKELTVLCDAEVSLIMFSSTGKMTEYLSPSLNGNTKRVYDKYQQLSGISLWNSHYESLQNALNKQKEINRRLRREIRQRMGEDLDELTIEELRSLEQNLEASVKVVRDRKYHVIITQTETTRKKLRNHTEQNHGLLREFEPILDEDPHYVIAHQEEDYESAIELAHGGPNIFAFRLQPSQPNLHNGGGYNCHDLRLA

SEQ ID NO: 22961 - protein, 199 aa, Dicentra eximia
AGIMKKARELTVLCDAEVSLIMFSSTGKFSEYISPSATTKRMFDRYQQVSGVNLWNSHYERMQDNLNKQKEINNKLRREIRQRMGEDLNDLSIEELRGLEQNMDNSLKIVRDRKYHVITTQTETYRKKLRNLHETHNNLLREFEGRDEDTHYALANEGDYETALEMANGGQNIFAFRLQPSQPNLHDGGGYGSHDLRLA

SEQ ID NO: 22962 - protein, 195 aa, Ranunculus bulbosus
AGIIKKAQELTVLCDAEVSLIMVSSSGKCVDFISPTISQKEFYDKYQKITKQDLWKSQYDEMQERFKHLMETNRKLRREIGQRVGEDLEGLGIHELRSLEQDLRNSAKVVRLRKFGLLSSQGETQKKKIKNLAGINGSLWQEYQERVEEEYIASGMSELELGNAVAPQVFSFRLQPSQPNLHDDEEYEIHDLRLV

SEQ ID NO: 22963 - protein, 189 aa, Michelia figo
GGIMKKAKELTVLCDAQVSLIMFSSTGKFSEYCSPSTTTKNIFDRYQQASGTSLWNSHYERMQGHLIKLKEENNNLRREIRQRIGEDLDDLEIEELRGLEQNLESSIKVVRERKYHVIQTQTETYKKKLRSLNDEQAKLIRVLEGQAENGAYGLVDNGGPDYESALVLANGGAHILHDTGFGIHDLRLA

SEQ ID NO: 22964 - protein, 189 aa, Liriodendron tulipifera
GGIMKKAKELTVLCDAEVSLIMFSSTGKFSEYCSPSTTTKKIFDRYQQVSGSSLWNSHYEKMQSHLNKLKEDNNSLRRAIRHRIGEDLDDLEIEELRGLEQNLESSIKVVRERKYHVINTQTETYKKKLRNLHEAHANLIRELEGQAENGGYGLVDNGGPDYESALVLANGGAHRLHNTGFGIHDLRLA

SEQ ID NO: 22965 - protein, 216 aa, Peperomia hirta
IENDTNRQVTFSKRRNGLFKKAQELTVLCDAQISIILISSTNRLYDYCSPSTSHKKVYDQYQDGRKVDLWKKRYENMKHQLNEQSERSNKLKKEIRQFMGEELDGLSFEQLHGLEQKVERASNIVRERKEKAISTKVDTLNKKVKGYEKQHEGYRQKLEMMEVDYGGTQYKGIPMCGPHFLGYNMQGNPYHESAHSDVTTANNISSAYGIYDLRLA

SEQ ID NO: 22966 - protein, 253 aa, Oryza sativa (japonica cultivar-group)
MGRGKVQLKRIENKINRQVTFSKRRSGLLKKANEISVLCDAEVALIIFSTKGKLYEYATDSCMDKILERYERYSYAEKVLISAESDTQGNWCHEYRKLKAKVETIQKCQKHLMGEDLESLNLKELQQLEQQLENSLKHIRSRKSQLMLESINELQRKEKSLQEENKVLQKENPCSFLQLVEKQKVQKQQVQWDQTQPQTSSSSSSFMMREALPTTNISNYPAAAGERIEDVAAGQPQHVRIGLPPWMLSHING

SEQ ID NO: 22967 - protein, 1078 aa, Oryza sativa (japonica cultivar-group)
MLSGNLIKKVVMPPGAISLDDVDIDQVSVDYVLNCAKKGEALDLGDAIRLFHDSLDYPYVNNSGTVEEFFLLTKPEYSGPAPAREPPPVPAIAPSPVVIPAPIVDPPPVAVHSPVSTTNLSKSQSFDSPTEKELTIDDIEDFEDEEDEFDSRRASRRHQSDANDLSLRLPLFETGNSDDCYVIMKSSCWYGYIHWVKKVIDNGNCAVFPGITDDDLRETAYEILVAAAGASGGLIVPQKEKKKEKRNKLMRKLGRSKSESTQSQTQRQPGLVGLLETMRAQLEITESMDIRTRQGLLNAMVGKVGKRMDNLLIPLELLCCISRAEFSDMKAYLRWQKRQLNMLEEGLINHPVVGFGELGRKVNELRNLFRKIEESESLQPSAVEVQRTECLRSLREVATSLSERPARGDLTGEEVEEILELLKSTWRILGITETIHDTCYAWVLFRQFVFTGEQGLLKVVIEHLRKIPLKEQRGPQERLHLKSLRSSVDAEDSFQDFTFFQSFLSPVQKWVDKKLNDYHLHFSEGPSMMADIVTVAMLIRRILGEENNKGMESPDRDQIDRYITSSVKSAFVKMAHSVEAKADTSHEHVLASLAEETKKLLKKDTTVFSSVLSKWHPQSAVVSASLLHKLYGSKLKPFLEHAEHLTEDVVSVFPAADALEQYIMSVMASVVGDDGLDSICRQKLAPYQIESKSGTLILRWVNGQLERIETWVKRAAEQETWDPISPQQRHGASIVEVYRIIEEVPMRTGELNSLCRGFDKAFQVYTQLVTGPIVDREDLIPPVPVLTRYKKELGIKAFVKKEIHEVRTVDERKASEIIQLTMPKLCVRLNSLYYGISQLSKLEDSINERWARRKSESINIRRSMSEKSKSAVSSQKNQFDGSRKEINAAIDRICEFTGLKVIFWDLQQPFIDNLYKNNVSQARLDAIMEVLDTVLNQLCNVIVEQLRDRVVTGLLQASLDGLLRVILDGGPTRVFSPSDATLLEEDLEILKEFFISGGDGLPRGTVENLVSRVRPVIDLIKQETRVLIDDLREVTQGAKSKFGTDSKTLLRVLCHRNDSEASHYVKKQFKIPSSAPAT

SEQ ID NO: 22968 - protein, 339 aa, Oryza sativa (japonica cultivar-group)
MKFGAIYEEYLREQQDKYLTKCSHVEYKRLKKVLKKCRVGRSLQEDCPNGDQQEGNNESPDICKCNSCTLCDQMFFTELTKEASEIAGCFSSRVQRLLNLHVPSGFLRYIWRVRQCFIDDQQIMVQEGRMLLNYVTMNAIAIRKILKKYDKIHGSVSGRDFKSKMQTDHIELLQSPWLIELGAFHLNCNSSDIDETVGFLKNEFFKNFSCDLTEARPLMTMAISETMKYEYSLTCPICLDTLFNPYALSCGHLFCKGCACGAASVYIFQGVKSAPPEAKCPVCRSDGVFAHAVHMTELDLLIKTRSKDYWRQRLREERNEMVKQSKEYWDSQAMLSMGI

SEQ ID NO: 22969 - protein, 698 aa, Halocynthia roretzi
MSNAPQPGQYVGPYKLEKTLGKGQTGLVKLGVHCMTGKKVAVKIVNREKLSESVINKVEREIAIMKLIEHPHILGLHDVYENKKYLYLILELVSGGELFDYLVQKGRLIPREARRFFRQIISAVDYCHNHNVCHRDLKPENLLLDEKNNIKVADFGMASLQPEGFLLETSCGSPHYACPEVIRGERYDGRTADVWSCGVILFALLVGALPFDDDNLRQLLEKVKRGVYHIPHFVPPDAQNLLRGMIDVRPDKRLSLQQVLQHPWMRPGSNSVEGVLVTPDPVVPVIDCVPLPEEESVDPDVLASMTSLGCFCNKEKLLKNLITEEQNTEKVVYYMLLRRKKRYPSFDDDADSLPCKHPDAPRKRVDSTSSLSSSNGDDWCVNPIPQRKMSAESLCLTDSSSPLLSRKKSTETHQRSQSLTGESNSRLVCNISDQTKAESKSRINGTPVRRGTTCSSNQPVPQINTPASPNPWRQRLASLKNTFMGSPRFHRRKMQAPSSEDVENQGNSSSELSKRSWFGNFMSSRYSSTEHCDELPYAIAYKNRTLNSVKSELVHAFLSIPNLTHSMVSPTRFRCDYRSSGTSTTSVFHQRSIKFQVDIIQHSSLDRQENGKKPSSQTVGSFTIAFSLISGPIRRYKRVLELLQMQMSIVAANQQNKTSGEFSAFSHEIQQLCKTVNNLHQDNSTMAINNPNHKSKVK

SEQ ID NO: 22970 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMAKG

SEQ ID NO: 22971 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKRTFFGNFKPRTDLPNVVEMYMKKELEVEKFITHSVPFSEINKAFDLMAKG

SEQ ID NO: 22972 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKASDLMAKG

SEQ ID NO: 22973 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMEKG

SEQ ID NO: 22974 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERNLKGTFFGNFKPRTDLPNVVEMYMKKELEVEKFITHSVPFSEINKAFDLMAKG

SEQ ID NO: 22975 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFLEINKAFDLMAKG

SEQ ID NO: 22976 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPQGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMAKG

SEQ ID NO: 22977 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDSEFKTHPMNFLNERTLKGTFFGNFKPRTDLPNVVEMYMKKELEVEKFITHSVPFSEINKAFDLMAKG

SEQ ID NO: 22978 - protein, 199 aa, Entodinium caudatum
YEKNVYLAMLAEQCSRYKEMVQFLEDMVKQRDKDLNSDERNLLSIAYKNSISGGRSAVRTIMAYEAKEKKKENSTFLPYITEYKKQVEDELTKLCQGVLKTTDEQLLKKAEDDEAKVFYIKMKGDYNRYIAEYAEGDLKKQVSDDALKAYDEATEIAKTLPVLNPIALGLALNFSVFYYEVINDHKKAIEIAKARCRKS

SEQ ID NO: 22979 - protein, 216 aa, Oryza sativa (japonica cultivar-group)
MCGGAIISDFIPQREAHRAATGSKRALCASDFWPSASQEAADFDHLTAPCTFTPDQAAEEPTKKRERKTLYRGIRRRPWGKWAAEIRDPAKGARVWLGTFATAEAAARAYDCAARRIRGAKAKVNFPNEDPPLDDPAADGHSHGGAAIPCREFMDYDAVMAGFFHQPYVVADGVPAVPAEEAPTVAYVHHHLPPQPQQDAGLELWSFDNIHTAVPM

SEQ ID NO: 22980 - protein, 280 aa, Oryza sativa (japonica cultivar-group)
MAAAIEGNLMRALGEAPSPQMQKIAPPPFHPGLPPAPANFSSAGVHGFHYMGPAQLSPAQIQRVQAQLHMQRQAQSGLGPRAQPMKPASAAAPAAAAARAQKLYRGVRQRHWGKWVAEIRLPRNHPRLWLGTFDTAEEAALTYGQAAYRLRGDAARLNFPDNAASRGPLDAAVDAKLQAICDTIAASKNASSRSRGGAGRAMPINAPLVAAASSSSGSDHSGGGDDGGSETSSSSAAASPLAEMEQLDFSEVPWDEAEGFALTKYPSYEIDWDSLLNNNN

SEQ ID NO: 22981 - protein, 284 aa, Cistus incanus subsp. creticus
ETLIAGGPFVLPLAHKHKVKILPADSEHSAIFQCIQGLPDGALRRIILTASGGAFRDWPVEKLKEVKVADALKHPNWSMGKKITVDSATLFNKGLEVIEAHYLFGAEYDNIEIVIHPQSIIHSMVELQDSSILAQMGWPDMRLPILYTMSWPDRVYCSEITWPRLDLCKLGSLTFKAPDTIKYPSMGLAYAAGRAGGTMTGVLSAANEKAVEMFLNEEISYLDIFKFVELTCEKHQAEVVTAPSLDEIVHYDLWARDYASTLNHVNVRCPPVLAYANGSLNGAV

SEQ ID NO: 22982 - protein, 246 aa, Lycopersicon esculentum
MGRGRVELKRIENKINRQVTFAKRRNGLLKKAYELSVLCDAEVALIIFSNRGKLYEFCSTSSMVKTIEKYQRCSYATLEANQSVTDTQNNYHEYLRLKARVELLQRSQRNFLGEDLGTLSSKDLEQLENQLESSLKQIRSRKTQFMLDQLADLQQKEQMLAESNRLLRRKLEESVAGFPLRLCWEDGGDHQLMHQQNRLPNTEGFFQPLGLHSSSPHFGYNPVNTDEVNAAATAHNMNGFIHGWML

SEQ ID NO: 22983 - protein, 241 aa, Lycopersicon esculentum
MGRGRVELKRIENKINRQVTFAKRRNGLLKKAYELSVLCDAEVALIIFSNRGKLYEFCSSSSMLKTLERYQKCNYGAPEPNISTREALEISSQQEYLKLKGRYEALQRSQRNLLGEDLGPLNSKELESLERQLDMSLKQIRSTRTQLMLDQLTDYQRKEHALNEANRTLKQRLMEGSQLNLQWQPNAQDVGYGRQTTQTQGDGFFHPLDCEPTLQIGYQNDPITVGGAGPSVNNYMAGWLP

SEQ ID NO: 22984 - protein, 110 aa, Populus tomentosa
MDTDVTMVPAGEASSSSSRKPKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 22985 - protein, 105 aa, Leptospirillum ferrooxidans
RGLQGGNVMTDIDREVPAEYESVSKIVNHLTPASFALSHSLTRPVFWIPKRMIQIVVPVSMKDEVVDLIMSVNRTGWMGDGKIFVSPIGESVRIRTGERGTDSVL

SEQ ID NO: 22986 - protein, 220 aa, Leptospirillum ferrooxidans
MKPLLERLKYEVLLLDGSMGALLQSRGLPAGYAPDLWNIEKPQEIQAVHTEYVNAGSDIILTNTFGASRLRLSEYNSQDRIREINFHAVELAQRAARGKAYVAGDIGPSGTTIAPFGDLPFDDAIAIFYEQAKLLLEAGADLIAIETMFDIQEMRAALIGVREAVNGRIPVMALMTFNMDGITDSGSDPETAASVLEGFSVGHHGTELLPLDRRPWVLSS

SEQ ID NO: 22987 - protein, 112 aa, Leptospirillum ferrooxidans
MKKVEAIIKPFKLDAVKEAVTALGVYGMTVTEVKGYGQQKGHTEQYRGAEYVVEFITKIKVEIVVADAKVSPVLEAIRRTAMSNSIGDGKVFVSPVETALRIRTGETGDAAL

SEQ ID NO: 22988 - protein, 357 aa, Leptospirillum ferrooxidans
MASKGPVPKMSSRTFSQRFNNRQGNTPIYWGSKLFPHRPFIIFYRNNCLEESLFRTTERLSRMSTVSEELVWKALGRVIEPDFKKDLVTLKMIENLKIDGGNLSFTIVLTTPACPLKDEMKNSCLAALASVPGITATEISFTARTTGGSFTGKTPIPGVKNVIAVSSGKGGVGKSTTSVNLAIALSQLGAKVGIMDADVYGPNIPMMLGITDTPRQVDKKLFPPSGHGITVMSMAFMVPPGTPLIWRGPMLHGIIQQFCQDINWGDLDYLVVDMPPGTGDAQLSLAQLVPLSGAIIVTTPQEVALSDSRRGLAMFQKVNVPILGIVENMSSFICPHCHGETDIFSKGGGETAAHEKA

SEQ ID NO: 22989 - protein, 82 aa, Leptospirillum ferrooxidans
MTDILKRIREPKDIKKLTMEEMGDLAQEIRLEMIQVISKIGGHFGGGLGVVELTIALHRVFDTDSGQGLSGMSDTRPTPTRC

SEQ ID NO: 22990 - protein, 188 aa, Leptospirillum ferrooxidans
PNMVLMSPKDENELRHMMYTASQPSGANSRALPERRRRREVVLDQSFREIPIGKAEVLSEGSDVTFLAYGQMVPVAVEVARQLSLEGRSVGVVNLRFAKPLDGEVLEKLIAQKKRLVSIEEGSLIGGVGAAILEWASDHGMLSSTNLLRLGILDEYVEHGGIKFLRDHVGLTPERILEKVRAWMSGGN

SEQ ID NO: 22991 - protein, 521 aa, Trachyderma tsunodae
MSRLSFLTSLVTLALVSSTYAGVGPVVDLTVSNAVISPDGFDRDAIVVNGVFPAPLITGKKGDRFQLNVIDNMTNHTMLKSTSIHWHGFFQKGTNWADGGAFVNQCPIAPGHSFLYDFRVPDQAGTFWYHSHLSTQYCDGLRGPIVVYDPNDPHADLYDVDNDSTVITLADWYHVAARLGPRFPLGADSTVINGLGRSLSTPNADLAVISVTQGKRYRFRLISLSCDPFHTFSIDGHDLTIIEADSVNTEPLVVDAIPIFAGQRYSFVLSAVKDIDNYWIRADPNFGTTGFASGINSAILRYDGAAPIEPTAVLAPVSVNPLVETDLHPLEDMPVPGRPTKGGVDKAINLDFSFSFPNFFINNATFTSPTVPILLQIMSGAQAAQDLLPSGSVIELPAQSTIELTLPATVNAPGVPHPFHLHGHTFAVVRSAGSTAYNYDNPIWRDVVSTGTPAANDNVTIRFTTDNPGPWFLHCHIDFHLEAGFAVVFAEGVPQTQVANPVPQAWEELCPIYDALPEDDQ

SEQ ID NO: 22992 - protein, 213 aa, Brassica juncea
MAGIKVFGHAASTATRRVLLTLHEKNLDFELVHVELKDGEHKKEPFLSRNPFGKVPAFEDGDLKLFESRAITQYIAHRYEEQGTNLLPADSKNISHYAIMAIGMEVEAHHFDPVASKLAWEQVFKLFYGMTTDQAVVEEEEAKLAAVLDVYEARLKEFKYLAGETFTLTDLHHIPVIQYLLGTPTKKLFDERPRVSEWVEEITNRPASQKILQ

SEQ ID NO: 22993 - protein, 213 aa, Brassica juncea
MAGIKVFGHAASTATRRVLLTLHEKNLDFELVHVELKDGEHKKEPFLSRNPFGKVPAFEDGDLKLFESRAITQYIAHRYEEEGTNLLPADSKNISHYAIMAIGMEVEAHHFDPVASKLAWEQVFKLFYGMTTDQAVVEEEEAKLATVLDVYEARLKEFKYLAGETFTLTDLHHIPVIQYLLGTPTKKLFDERPHVSEWVAEITNRPASQKILQ

SEQ ID NO: 22994 - protein, 213 aa, Brassica juncea
MAGIKVFGSAASPSTRRVLLALHEKNLDFELVNVELKDGEHKKEPFLSRNPFGKVPAFEDGDLKLFESRAITQYIAHRYEGQGTNLLPADSKNIAHYAIMAIGLEVEAHQFDPVASKLAWEQVFKNFYGLTTDQAVVAEEEAKLAKVLDVYEARLKEFKYLAGETFTLTDLHHIPVIQYLLGTPTKKLFTERPRVNEWVAEITKRPASQKILQ

SEQ ID NO: 22995 - protein, 213 aa, Brassica juncea
MAGIKVFGHAASTATRRVLLTLHEKNLDFELVHVELKDGEHKKEPFLSRNPFGKVPAFEDGDLKLFESRAITQYIAHRYEGQGTNLLQGDSKNLAHYAIMALGMQVEAHQFDPLVSKLAWEHVFKLIYGLTTDQAVVAEEEAKLAKVLDVYEARLKEFKYLAGNTFTLTDLHHIPAIQYLLETPTKKLFTERPRVNEWVAEITKRPASQKILQ

SEQ ID NO: 22996 - protein, 213 aa, Brassica juncea
MAAIKVFGHPASAPTMRVVLTLHEKNLDFEFVHVDLMGGEHKKEAFLARNPFGQVPAFEDGDLKLFESRAITQYIAHRYEGQGTNLLPADSKNIAHYAIMAIGMQVEAHQFEPVAAKLVSEHVFKPKKGSTTDQAVVAEEEAKLAKVLDVYEARLKEFKYLAGDTFTLTDLHHIPAIQYLLGTPSKRLFTERPRVNEWVAEITKRPASQKILQ

SEQ ID NO: 22997 - protein, 213 aa, Brassica juncea
MAGIKVFGHPASAPTMRVLLTLHEKNLDFEFVHVDLMGGEHKKEAFLARNPFGQVPAFEDGDLKLFESRAITQYIAHRYEGQGTNLLPADSKNIAHYAIMAIGMQVEAHQFEPVAAKLVSEQVFKLKKGLTTDQAVVAEEEAKLAKVLDVYEARLKEFKYLAGDTFTLTDLHHIPTVKYLLGTPTKKLFTERPRVNEWVAEITKRPASQKILQ

SEQ ID NO: 22998 - protein, 294 aa, uncultured bacterium
MSLRTPDLLFTAIAPAIWGSTYIVTTQYLPNFSPMTVAMLRALPAGLLLVMIVRQIPTGIWWMRIFILGALNISLFWSLLFISVYRLPGGVAATVGAVQPLMVVFISAALLGSPIRLMAVLGAICGTAGVALLVLTPNAALDPVGVAAGLAGAVSMAFGTVLTRKWQPPVPLLTFTAWQLAAGGLLLVPVALVFDPPIPMPTGTNVLGLAWLGLIGAGLTYFLWFRGISRLEPTVVSLLGFLSPGTAVLLGWLFLDQTLSALQIIGVLLVIGSIWLGQRSNRTPRARIACRKSP

SEQ ID NO: 22999 - protein, 374 aa, Oryctolagus cuniculus
MANKVIKCKAAVAWEAGKPLSIEEIEVAPPKAHEVRIKIFATAVCHTDAYTLSGADPEGCFPVILGHEGAGIVESVGEGVTNLKAGDTVIPLYIPQCGECKFCLNPKTNLCQKIRVTQGKGLMPDGTSRFTCKGKTILHYMGTSTFSEYTVVADISVAKIDPSAPLDKVCLLGCGISTGYGAALNTAKVEPGSTCAVFGLGGVGLAAIMGCKAAGASRIIAVDINKDKFARAKEFGATECINPQDFSKPIQEVLVEKTDGGVDYSFECIGNVKVMRAALEACHKGWGVSVVVGVAGAGEEISTRPFQLVTGRTWKGTAFGGWKSVESVPKLVSEYMSKKINVDEFVTNTLSFDQINEAFELMHSGKSIRTVVKI

SEQ ID NO: 23000 - protein, 567 aa, Pisum sativum
MSDLEAPLRPKRKKIWVDYFVKFRWILVIFVVLPISFTLYFLTYLGDVRSEWKSFKTRQKEHDENVQKVVNRLKKRNPSKDGLVCTARKPWVAVGMRNVDYKRARHFEVDLSPFRNILDIDKERMIARVEPLVNMGQITRVTVPMNLALAVVAELDDLTVGGLINGYGIEGSSHKYGLFSDTVVAFEIILADGSLVKATKDNEYSDLFYAIPWSQGTLGLLVAAEVKLIPIKEYMKLTYKPVVGNLKDIAQAYSDSFAPRDGDQDNDEKVPDFVETMIYSPTRAVCMTGRYASKEEAKKKGNKINNVGWWYKTWFYQHAETALKKGLFVEYIPTREYYHRHTRCLYWEGKLILPFGDQFSFRFLFGWLMPPKVSLLKATQGEAIRNYYHEMHVIQDMLVPLYKVGDALEWSDREMEIYPIWLCPHKLFKLPIKTMIYPEAGFELQRRQGDTQNAQMFTDVGVYYAPGPVLRGEVFDGAEAVRKMESWMIENHCFQPQYAVSELNEKNFWRMFDAGLYEHCRRKYGAVGTFMSVYYKCKKGRKTEKEVREAEQAHLDTAYPEVDQPPD

SEQ ID NO: 23001 - protein, 330 aa, Erwinia amylovora
MSQNTLKVNELNEDAEFDENGAEVFDEKALVGNEPGDNELAEEDLLSQGATQRVLDATQLYLGEIGYSPLLTAEEEVFFARRALRGDVPSRRRMIESNLRLVVKIARRYSNRGLALLDLIEEGNLGLIRAVEKFDPERGFRFSTYATWWIRQTIERAIMNQTRTIRLPIHIVKELNVYLRTARELSHKLDHEPSAEEIAEKLDKPVDDVSRMLRLNERITSVDTPLGGDSEKALLDILADEKDNGPEDTTQDDDMKQSIVKWLFELNAKQREVLARRFGLLGYEAATLEDVGREIGLTRERVRQIQVEGLRRLREILQGQGLSIEALFRE

SEQ ID NO: 23002 - protein, 350 aa, Homo sapiens [sequence omitted]

SEQ ID NO: 23003 - protein, 625 aa, Danio rerio
MDYHKPDEKTLQALKDIANKLRIHSIRQTCASNSGHPTSCCSAAELMSVLFFHTMRYKAGDPRNPCNDRFILSKGHAAPILYAAWAEAGYIKASDLLNLRKIDSDLEGHPTPKLAFVDVATGSLGQGLGAACGMAYTGKYLDKSSYRVYCMLGDGECSEGSVWEAMAFASHYKLDNLVAILDVNRLGQSEPAPLQHNVNVYKERCEAFGFNTYVVDGHDVEELCKAMWHAEGVKGKPTAIVAKTFKGKGLKGIEDQDNWHGKPMPKDRAEELINDLLSQIQSPNKPLYPQPPKEDAPPADLSPIHLLTAPEYKLGDKISTRKAYGVALKRLGDASTRVVALDGDTKNSTFADMFKKAHPDRYIECFIAEQNMVSVAIGCATRERTVSFASTFAAFLARAYDQIRMAAISQSNVNLVGSHCGVSIGEDGPSQMALEDLAMFRSIPTCTVFYPSDGVSTERSVELAANTKGICFIRTSRPDTAVIYNPEEKFEIGKAKVVRQSSKDQVTVIGAGVTLHEALAAHDQLAKEGVNIRVIDPFTIKPLDASTIVASARATGGRVITVEDHYKEGGLGEAVLSAVGEEPGIVVHRLAVSRVPRSGKPQELLDMFGISAKCIVAAVKRTFAN

SEQ ID NO: 23004 - protein, 820 aa, Paramecium tetraurelia
MLIYILLLGLINTQNGPVLIEKFGRSKKKQVQAPPPDFECIDELDEDDAPPKEYPLKVGSLYHLSDGWYLRSEDSTNQQVTLINMNDISRIKFVEKEIEATLPDKQPEQKLKDMEWTPLLAFERFPRQRGGHSMHSIGDYVVLFGGCLLNIQCFNDLFLFNARTRIWTTPKVFGIPPVGRSGFGSLVNGARLYIFGGHTMQGLVNDLFVFDLESRSWNQLSWPGQAPTPRAGHKMVLTKLGGLIFGGFVGEVYTSDIFILDFVNERWGKPSGGGDVPLGRESFSMTYHHGLTYVFGGYAKGLIMNDLYTINEDLIWQKREVQGDIPSPRQGAAMAEYDNRIFIVGGCNPILFECYNDVYTLDTQSMTFTNVTVEKQRNLRQVAYSSMVFAGSLLIHFGGCKLLKHCSDSLIGLAVASAETCPPCKNDGECRAGHCSCKQGWQGIDCTQKVLCKQNCLEQGICLSNGYCKCYPGYTGSVCQLNVPCPGNCTDEEHGICELDGKCKCFEGFSGVTCSGNPEIDSKLPQSTGCLDECNHRGQCNFETGLCACEDGFSGPDCSLVQGTESGYTSIWDLLKDYDGEHENDLEPADTGEEDLKQFISTGYKFNQRQEGPMPMFDDDIDRVYYVDVDENGHVVDDNHQNNHNQDDNVQKQDNKNEDNNNYQQSLQYDPKFKPYNIQEGNNNNLNILQSNQNPFSFNFMMVPPKVSSKEEDPFKLLLLDECPKRCSEHGVCIENECYCWFGYTGDWCQAEKISDFYKGWTKKGVIEACIVSFIVGMIIGYGVVLLMKKRGNNDEFRNMSEVPSQNIDDNEGEVEEQII

SEQ ID NO: 23005 - protein, 119 aa, Homo sapiens
IADAASCRESPHCGPLLCTMSGGLLKALRSDSYVELSQYRDQHFRGDNEEQEKLLKKSCTLYVGNLSFYTTEEQIYELFSKSGDIKKIIMGLDKMKKTACGFCFVEYPSHGSNVAAEPG

SEQ ID NO: 23006 - protein, 303 aa, Homo sapiens
IGQWPQSGPLAALPHGSVQARSWPSEWGRAPNQAAPSYHDRGNQFWEKLCTAEFRELYALGSIHNDLYVIGGQMKIKNQYLITNCVDKYSVERDNWKRVSPLPLQLACHAVVTVNNKLYVIGGWTPQMDLPDEEPDRLSNKLLQYDPSQDQWSVRAPMKYSKYRFSTAVVNSEIYVLGGIGCVGQDKGQVRKCLDVVEIYNPDGDFWREGPPMPSPLLSLRTNSTNAGAVDGKLYVCGGFHGADRHEVISKEILELDPWENQWNVVAINVLMHDSYDVCLVARMNPRDLIPPPSDLVEEGNEH

SEQ ID NO: 23007 - protein, 323 aa, Homo sapiens
SSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 23008 - protein, 210 aa, Silene latifolia
MGRGKLEIKKIENKTNRQVTFSKRRNGIMKKAQELTVLCDAKVSLLMISSTHKLYHFLSPGVSLKKMYDEYQKIKGVDLWLKHWEEMQEEQRKMVELNNMLRTEISRRLGGDLEGLTLAELRGLQQEMDEAITEIRNRKYNVIKNQTGTTRKKVKNLEERHGDLLMDLEAKFGGAQFGTGDGEQGNYESASMYGNEGAAANLFALSLHPY

SEQ ID NO: 23009 - protein, 210 aa, Silene latifolia
MGRGKLEIKKIENKTNRQVTFSKRRNGILKKAQELTVLCDAKVSLLMISSTHKLHHFLSPGVSLKKLYDEYQKIEGVDLWHKHWERMQEQQRKLLELNNMLRTEISRRIGVDLEGLTLLELRGLQQEMEEAITEIRNRKYHVIKNQTGTTRKKVKNLEERHGDLLMDLEAKFRGAHFGIGDGELRNYGGASMYGNERAAANLFALSRHPH

SEQ ID NO: 23010 - protein, 210 aa, Silene dioica
MGRGKLEIKKIENKTNRQVTFSKRRNGIMKKAQELTVLCDAKVSLLMISSTHKLYHFLSPGVSLKKMYDEYQKIKGVDLWLKHWEEMQEEQRKLVELNNMLRTEISRRLGGDLEGLTLAELRGLQQEMDEAITEIRNRKYNVIKNQTGTTRKKVKNLEERHGDLLMDLEAKFGGAQFGTGDGEQRNYESASMYGNEGAAANLFALSLHPY

SEQ ID NO: 23011 - protein, 210 aa, Silene dioica
MGRGKLEIKKIENKTNRQVTFSKTRNGILKKAQELTVLCDAKVSLLMISSTHKLHHFLSPGVSLKKMYDEYQKIEGVDLWHKHWERMQEQQRKLLELNNMLRTEISRRIGGDLEGLTLLELRGLQQEMEEAITEIRNRKYHVIKNQTGTTRKKVKNLEERHGDLLMDLEAKFRGAHFGIGDGEQRNYGGASMYGNERAAANLFALSRHPH

SEQ ID NO: 23012 - protein, 210 aa, Silene diclinis
MGRGKLEIKKIENKTNRQVTFSKRRNGILKKAQELTVLCDAKVSLLMISSTHKLHHFLSPGVSLKKMYDEYQKIEGVDLWHKHWERMQEQHRKLLELNNMLRTEISRRIGGDLEGLTLLELRGLQQEMEEAITEIRNRKYHVIKNQTGTTRKKVKNLEERHGDLLMDLEAKFRGAHFGIGDGEQRNYGGASMYGNERAAANLFALSRHPH

SEQ ID NO: 23013 - protein, 210 aa, Silene conica
MGRGKLEIKKIENKTNRQVTFSKRRNGIMKKAQELTVLCDAKVSLLMISSTHKLHHFLSPGVSLKKMYDEYQKIKGVDLWLKHWERMQEQQRKLLELNSMLRTEISRRMGGDLVGLTIEELRGLQQEMEEAVTEIRNRKYNAIKNQTGTTRKKVKNLEERHGDLLMDLEAKFRGAHFGIGEAEQRNYDVASVYGNEGAAANLFALSRHPH

SEQ ID NO: 23014 - protein, 356 aa, Atriplex nummularia
MAAPVCCLPNDDLASRLVQKIAQTVEDEIPEQFLHKDGFPEAKDVPELWTRSLLIDFSLLSSGDQDEIVKFRSALSNWGCFLVKNHGIEGSFLEEVIEVSRKFFSLPFEEKMKYYTDDIFQGYDTDAVCQGLDQQKMNWNDRLFLTMYPKSKGNLKAWPQNPSNFSEIVDEYSKELINLTKGLYKAAAKSLNVREDSFCLEKEGVILSRFTLYPKCPRPKNVLGSKPHLDGSVFTIVLADQEGLEVQKDGQWFKVPVIPGALFVNFGDFGEVLTNGIYKSTMHRVATHSAKDRLSVTAFCTMDATQELTPLTELVTANRPPLYKKFKVYEYKEGVCCKCGPGENAIDAIKLDFPIL

SEQ ID NO: 23015 - protein, 394 aa, Homo sapiens [sequence omitted]

SEQ ID NO: 23016 - protein, 337 aa, Petroselinum crispum
MEVERVQAISKMSRCMDTIPSEYIRSESEQPAVTTMQGVVLQVPVIDLGSSNNTEENLVELIAEASREWGIFQVVNHGIPDDAIAKLQKVGKEFFELPQQEKEVIAKPEGYQGVEGYGTKLQKELGGKKGWVDHLFHIIWPKSAVNYNFWPNNPPLYREANEEYAVALRGVVDKLFEALSLGIGLEKHELKKASGGDDLIYMLKINYYPPCPRPDLALGVVAHTDMSAITILVPNEVQGLQVHKDDHWYDVKYIPNALIIHIGDQIEIMSNGKYKSVYHRTTVNKDKTRMSWPVFLEPPPELLTGPISKLITDENPAKFKTKKYKDYVYCKLNKLPQ

SEQ ID NO: 23017 - protein, 206 aa, Acacia mangium
VLCDAEVALIVFSTKGKLSHYSSDPCMEKIIERYERYSYAERPQAAPDRSPTENWTLEHAKLKARMEVLQRNQKHYRGEDLEGLSLKELQNLEHQLDSALKHVRSRKNQLMYESISEFQKKDKKLQEQNNLLAKEIKEKEKALAEKAREEKHNDEDALVQPQLPPSNIGEIVEARGGAEDNEATTTHHQPRSGPLLPSWMLPPISE

SEQ ID NO: 23018 - protein, 183 aa, Acacia mangium
VLCDAEVALIIFSPRGKLYEFASSSMREAIERYRSHNRDVQTATRFVEQNMQYLKQETETMMKKIGQLGILKRKLLGEDCGSCSVKELEEIEQQLESSVRKVRERKSQVYNEQMEQLKEKRKTLAAENARLSEKYNSLAKQAREKNDGENAASLENIPTSEVETDLLIGLPETRSITLPIHVL

SEQ ID NO: 23019 - protein, 270 aa, Populus tremula x Populus tremuloides
MGRSPCCEKAHTNKGAWTKEEDDRLVAYIRAHGEGCWRSLPKAAGLLRCGKSCRLRWINYLRPDLKRGNFTEAEDELIIKLHSLLGNSRWSLIAGRLPGRTDNEIKNYWNTHIRRKLLNRGIDPATHRPLNEPVQEATTTISFTTTTTSVEEESRGSIIKEEIKEKLISATAFVCTEAKTQVQERCPDLNLELGISLPSQNQPDHHQPFKTGGSRSLCFACSLGLQNSKDCSCNVIVSTVGSSGSTSTKNGYDFLGMKSGVLDYRSLEMK

SEQ ID NO: 23020 - protein, 303 aa, Mus musculus
MGSWKTGQSYLAAGLLKNQVAVVTGGGTGIGKAVSRELLHLGCNVVIASRKLDRLTAAVDELRASLPPSSSAEVSAIQCNIRKEEEVSYLVKSTLAKYGKINFLVNNGGGQFMAPVEDITAKGWHAVIETNLTGTFYMCKEVYNSWMREHGGSIVNIIVLLNNGFPTAAHTGAAREGVYNLTKSMALAWASSGVRINCVAPGTIYSQTAVDNYGEMGQTLFEMAFDSIPAKRLGVPEEISPLVCFLLSPAASYITGQLINVDGGQALYTHAFSIPDHDNWPVGAGDLSIVKRIKESFKKKAKL

SEQ ID NO: 23021 - protein, 305 aa, Mus musculus
MAEASAAGADAGSAVAAHRFFCHFCKGEVNPKLPEYICPRCDSGFIEEVTDDSSFLGGGGSRTDNSTATHFAELWDHLDHTMFLQDFRPFLSSNPLDQDNRANERGHQTHTDFWGPSRPPRLPMTRRYRSRGSTRPDRSPAIEGIIQQIFAGFFANSAIPGSPHPFSWSGMLHSNPGDYAWGQTGLDAIVTQLLGQLENTGPPPADKEKITSLPTVTVTQEQVNTGLECPVCKEDYTVEGKVRQLPCNHFFHSSCIVPWLELHDTCPVCRKSLNGEDSTRQTQSSEASASNRFSNDSQLHDRWTF

SEQ ID NO: 23022 - protein, 419 aa, Mus musculus
MSGAARAGPARLAALALLTCSLWPTRADNASQEYYTALINVTVQEPGRGTPLTFRIDRGRYGLDSPKAEVRGQVLAPLPIHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRVLPCKHVFHKSCVDPWLSEHCTCPMCKLNILKALGIVPNLPCTDNVAFDMERLTRTQAVNRRAALGDLAGDSSLGLEPLRTSGISPLPQDGELTPRTGEINIAVTKEWFIIASFGLLSALTLCYMIIRATASLNANEVEWF

SEQ ID NO: 23023 - protein, 233 aa, Mus musculus
MGEPQQVSALPPPPMQYIKEYTDENSQEGLAPGRPPPIKDSYMMFGNQKRCDDLIIRPLESQGIERLHPMQFDHKKELRKLNMSILINFLDLLDILIRSPGSIKREEKLEDLKLLFVHVHHLINEYRPHQARETLRVMMEVQKRQRLETAERFQKHLERVIEMIQNCLASLPDDLPHSEAGMRVKAEPMDTDDNSNCPGQNEQQRESSGHRRDQIIEKDAALCVLIDEMNERP

SEQ ID NO: 23024 - protein, 514 aa, Mus musculus
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDRFLEEIMTKREDLVVAPAGVTLKEANEILQRSKKGKLPIVNENDELVAIIARTDLKKNRDYPLASKDAKKQLLCGAAIGTHEDDKYRLDLLALAGVDVVVLDSSQGNSIFQINMIKYIKEKYPSLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 23025 - protein, 643 aa, Mus musculus
MKDYDELLKYYELYETIGTGGFAKVKLACHVLTGEMVAIKIMDKNALGSDLPRVKTEIDALKSLRHQHICQLYHVLETKNKIFMVLEYCPGGELFDYIISQDRLSEEETRVVFRQILSAVAYVHSQGYAHRDLKPENLLFDENHKLKLIDFGLCAKPKGNKDYHLQTCCGSLAYAAPELIQGKSYLGSEADVWSMGILLYVLMCGFLPFDDDNVMALYKKIMRGKYEVPKWLSPSSILLLQQMLQVDPKKRISMRNLLNHPWVMQDYSCPVEWQSKTPLTHLDEDCVTELSVHHRSSRQTMEDLISSWQYDHLTATYLLLLAKKARGKPARLQLLSFSCGTASTTPKSKNLSLEDMSTSDDNCVAGLIDYELCEDKLLAPKTPQVTKHLAESNHAASKSPAPGVRRAVANKLMDKENVCTPKSSVKNEEQFVFSEPKIPVSKNQYKREIPASPTRFPTPAKARAQCLREAPVRTPGNSAGADTLTTGVISPERRCRSMDVDLNQAHMEDTPKKKGTNVFGSLERGLDKVLTALTRNKKKGSARDGPRKRKLHYNVTTTRLVNPDQLLSEIMAILPKKNVDFVQKGYTLKCQTQSDFGKVTMQFELEVCQLQRPDVVGIRRQRLKGDAWVYKRLVEDILSGCKM

SEQ ID NO: 23026 - protein, 228 aa, Mus musculus
MCILLCPHMFCRPINQRQADWDCLENLPWKLCWQAAMASKGPSASASTENSNAGGPSGSSNGTGESGGQDSTFECNICLDTAKDAVISLCGHLFCWPCLHQWLETRPNRQVCPVCKAGISRDKVIPLYGRGSTGQQDPREKTPPRPQGQRPEPENRGGFQGFGFGDGGFQMSFGIGAFPFGIFATAFNINDGRPPPAVPGTPQYVDEQFLSRLFLFVALVIMFWLLIA

SEQ ID NO: 23027 - protein, 316 aa, Mus musculus
MASHLELNNGTKMPTLGLGTWKSPPGQVTEAVKVAIDLGYRHIDCAQVYQNEKEVGVALQEKLKEQVVKRQDLFIVSKLWCTFHDKSMVKGAFQKTLSDLQLDYLDLYLIHWPTGFKPGPDYFPLDASGNVIPSDTDFVDTWTAMEQLVDEGLVKTIGVSNFNPLQIERILNKPGLKYKPAVNQIECHPYLTQEKLIEYCHSKGIVVTAYSPLGSPDRPWAKPEDPSLLEDPRIKAIAAKYNKTTAQVLIRFPIQRNLVVIPKSVTPVRIAENLKVFDFELSSEDMATLLSYNRNWRVCALMSCAKHKDYPFHAEV

SEQ ID NO: 23028 - protein, 255 aa, Mus musculus
MDDREDLVYQAKLAEQAERYDEMVESMKKVAGMDVELTVEERNLLSVAYKNVIGARRASWRIISSIEQKEENKGGEDKLKMIREYRQMVETELKLICCDILDVQDKHLIPAANTGESKVFYYKMKGDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEEQNKEALQDVEDENQ

SEQ ID NO: 23029 - protein, 316 aa, Mus musculus
MAAFVTLLTGAKMPIVGLGTWKSPPAKVREAVKVAIDAGYRHIDCAYVYQNESEVGEAIQEKIQEKAVKREDLFIVSKLWSTFFEKSLVKKAFQNTLSDLKLDYLDLYLIHWPQGFQSGNVFLPTDDKGSILSSKYTFLDAWEAMEELVDQGLVKALGVSNFNHFQIERLLNKPGLKHKPVTNQVECHPYLTQEKLTQYCHSKGITITAYSPLGSPDRPSAKPEDPLLLEIPKIKEIAAKHKKTAAQVLIRFHIERNVVVIPKSVTPSRIQENIQVFDFQLSEEDMAAILSFNRNWRACGLFAASHNEDFPFHAEY

SEQ ID NO: 23030 - protein, 1234 aa, Mus musculus
MAGARPGVHALQLEPPTVVETLRRGSKFIKWDEEASSRNLVTLRVDPNGFFLYWTGPNMEVDTLDISSIRDTRTGRYARLPKDPKIREVLGFGGPDTRLEEKLMTVVAGPDPVNTTFLNFMAVQDDTVKVWSEELFKLAMNILAQNASRNTFLRKAYTKLKLQVNQDGRIPVKNILKMFSADKKRVETALESCGLNFNRVESIRPDEFPLEIFERFLNKLCLRPDIDKILLEIGAKGKPYLTLEQLMDFINQKQRDPRLNEVLYPPLRSSQARLLIEKYETNKQFLERDQMSMEGFSRYLGGEENGILPLEALDLSMDMTQPLSAYFINSSHNTYLTAGQLAGPSSVEMYRQALLWGCRCVELDVWKGRPPEEEPFITHGFTMTTEVPLRDVLEAIAEAAFKTSPYPVILSFENHVDSAKQQAKMAEYCRSIFGDALLIDPLDKYPLSAGIPLPSPQDLMGRILVKNKKRHRPSTGVPDSSVRKRPLEQSNSALSESSAATEPSSPQLGSPSSDSCPGLSNGEEVGLEKTSLEPQKSLGEESLSREPNVPMPDRDREDEEEDEEEEETTDPKKPTTDEGTASSEVNATEEMSTLVNYVEPVKFKSFEAARKRNKCFEMSSFVETKAMEQLTKSPMEFVEYNKQQLSRIYPKGTRVDSSNYMPQLFWNVGCQLVALNFQTLDLPMQLNAGVFEYNGRSGYLLKPEFMRRPDKSFDPFTEVIVDGIVANALRVKVISGQFLSDKKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRAKQLAALIGESEAQASTETYQETPCQQPGSQLPSNPTPNPLDASPRWPPGPTTSSTSSSLSSPGQRDDLIASILSEVTPTPLEELRSHKAMVKLRSRQDRDLRELHKKHQRKAVALTRRLLDGLAQARAEGKCRPSPSALGKATNSEDVKEEEEAKQYREFQNRQVQSLLELREAQADVETKRKLEHLRQAHQRLKEVVLDTHTTQFKRLKELNEREKKELQKILDRKRNNSISEAKTREKHKKEVELTEINRRHITESVNSIRRLEEAQKQRHERLVAGQQQVLQQLEEEEPKLLAQLTQECQEQRERLPQEIRRCLLGETAEGLGDGPLVACASNGHAPGSGGHLSSADSESQEENTQL

SEQ ID NO: 23031 - protein, 376 aa, Rattus norvegicus
MSTAGKVIKCKAAVLWEPHKPFTIEDIEVAPPKAHEVRIKMVATGVCRSDDHAVSGSLFTPLPAVLGHEGAGIVESIGEGVTCVKPGDKVIPLFSPQCGKCRICKHPESNLCCQTKNLTQPKGALLDGTSRFSCRGKPIHHFISTSTFSQYTVVDDIAVAKIDAAAPLDKVCLIGCGFSTGYGSAVQVAKVTPGSTCAVFGLEGVGLSVVIGCKTAGAAKIIAVDINKDKFAKAKELGATDCINPQDYTKPIQEVLQEMTDGGVDFSFEVIGRLDTMTSALLSCHSACGVSVIVGVPPSAQSLSVNPMSLLLGRTWKGAIFGGFKSKDAVPKLVADFMAKKFPLEPLITHVLPFEKINEAFDLLRAGKSIRTVLTF

SEQ ID NO: 23032 - protein, 542 aa, Mus musculus
MATTVTCTRFTDEYHLYEDIGKGAFSVVRRCVKLCTGHEYASKIINTKKLSARDHHKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSSAITSPKGSLPPAALEPQTTVIHNPVDGIKESSDSTNTTIEDEDAKARKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 23033 - protein, 374 aa, Mus musculus
MANQVIRCKAAVAWEAGKPLSIEEIEVAPPKAHEVRIKILATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKSVFHFMGTSTFSEYTVVADISVAKIDPSAPLDKVCLLGCGISTGYGAAVNTAKVEPGSTCAVFGLGGVGLAVIMGCKVAGASRIIGIDINKDKFAKAKEFGASECISPQDFSKSIQEVLVEMTDGGVDYSFECIGNVKVMRSALEAAHKGWGVSVVVGVAASGEEISTRPFQLVTGRTWKGTAFGGWKSVESVPKLVSEYMSKKIKVDEFVTGNLSFDQINQAFDLMHSGDSIRTVLKM

SEQ ID NO: 23034 - protein, 324 aa, Homo sapiens
MSRPSSTGPSANKPCSKQPPPQPQHTPSPAAPPAAATISAAGPGSSAVPAAAAVISGPGGGGGAGPVSPQHHELTSLFECPVCFDYVLPPILQCQAGHLVCNQCRQKLSCCPTCRGALTPSIRNLAMEKVASAVLFPCKYATTGCSLTLHHTEKPEHEDICEYRPYSCPCPGASCKWQGSLEAVMSHLMHAHKSITTLQGEDIVFLATDINLPGAVDWVMMQSCFGHHFMLVLEKQEKYEGHQQFFAIVLLIGTRKQAENFAYRLELNGNRRRLTWEATPRSIHDGVAAAIMNSDCLVFDTAIAHLFADNGNLGINVTISTCCP

SEQ ID NO: 23035 - protein, 568 aa, Homo sapiens
MPSTDLLMLKAFEPYLEILEVYSTKAKNYVNGHCTKYEPWQLIAWSVVWTLLIVWGYEFVFQPESLWSRFKKKCFKLTRKMPIIGRKIQDKLNKTKDDISKNMSFLKVDKEYVKALPSQGLSSSAVLEKLKEYSSMDAFWQEGRASGTVYSGEEKLTELLVKAYGDFAWSNPLHPDIFPGLRKIEAEIVRIACSLFNGGPDSCGCVTSGGTESILMACKAYRDLAFEKGIKTPEIVAPQSAHAAFNKAASYFGMKIVRVPLTKMMEVDVRAMRRAISRNTAMLVCSTPQFPHGVIDPVPEVAKLAVKYKIPLHVDACLGGFLIVFMEKAGYPLEHPFDFRVKGVTSISADTHKYGYAPKGSSLVLYSDKKYRNYQFFVDTDWQGGIYASPTIAGSRPGGISAACWAALMHFGENGYVEATKQIIKTARFLKSELENIKGIFVFGNPQLSVIALGSRDFDIYRLSNLMTAKGWNLNQLQFPPSIHFCITLLHARKRVAIQFLKDIRESVTQIMKNPKAKTTGMGAIYGMAQTTVDRNMVAELSSVFLDSLYSTDTVTQGSQMNGSPKPH

SEQ ID NO: 23036 - protein, 461 aa, Bos taurus
MNSFSNEEFDCHFLDEGFTAKDILDQKINEVSYSDDKDAFYVADLGDILKKHLRWLKALPRVTPFYAVKCNDSRTIVKTLAAIGTGFDCASKTEIQLVQSLGVPPERIIYANPCKQVSQIKYAANNGVQMMTFDSEVELMKVARAHPKAKLVLRIATDDSKAVCRLSVKFGATLKTSRLLLERAKELDIDVIGVSFHVGSGCTDPETFVQAISDARCVFDMGAEVGFNMYLLDIGGGFPGSEDVKLKFEEITSVINPALDKYFPSDSGVRIIAEPGRYYVASAFTLAVNIIAKKLVLKEQTGSDDEEESTDRTFMYYVNDGVYGSFNCILYDHAHVKPLLQKRPKPDEKYYSSSIWGPTCDGLDRIVERCNLPEMHVGDWMLFENMGAYTVAAASTFNGFQRPTIYYVMSGPTWQLMQQIRTQDFPPGVEEPDVGPLPVSCAWESGMKRHSAACASTRINV

SEQ ID NO: 23037 - protein, 735 aa, Mus musculus
METPDYNTPQGGTPSAGSQRTVVEDDSSLIKAVQKGDVVRVQQLLEKGADANACEDTWGWTPLHNAVQAGRVDIVNLLLSHGADPHRRKKNGATPFIIAGIQGDVKLLEILLSCGADVNECDENGFTAFMEAAERGNAEALRFLFAKGANVNLRRQTTKDKRRLKQGGATALMSAAEKGHLEVLRILLNDMKAEVDARDNMGRNALIRTLLNWDCENVEEITSILIQHGADVNVRGERGKTPLIAAVERKHTGLVQMLLSREGINIDARDNEGKTALLIAVDKQLKEIVQLLLEKGADKCDDLVWIARRNHDYHLVKLLLPYVANPDTDPPAGDWSPHSSRWGTALKSLHSMTRPMIGKLKIFIHDDYKIAGTSEGAVYLGIYDNREVAVKVFRENSPRGCKEVSCLRDCGDHSNLVAFYGREDDKGCLYVCVSLCEWTLEEFLRLPREEPVENGEDKFAHSILLSIFEGVQKLHLHGYSHQDLQPQNILIDSKKAVRLADFDQSIRWMGESQMVRRDLEDLGRLVLYVVMKGEIPFETLKTQNDEVLLTMSPDEETKDLIHCLFSPGENVKNCLVDLLGHPFFWTWENRYRTLRNVGNESDIKVRKCKSDLLRLLQHQTLEPPRSFDQWTSKIDKNVMDEMNHFYEKRKKNPYQDTVGDLLKFIRNIGEHINEEKKRGMKEILGDPSRYFQETFPDLVIYIYKKLKETEYRKHFPQPPPRLSVPEAVGPGGIQS

SEQ ID NO: 23038 - protein, 542 aa, Candida albicans
MKLSKSTLIATLALTATSTNALVVQNPFSNIQQALKLDLSYDKLTSKLTDTFEQGKANIISTIAKVMNEPLDGLTPEIKNIWLEMLMKFPNSITELNFKAPPKKGKITTQQFDFHVTDAQVPNHKLRIKSTPKDLGIDTVKQYSGYLDVVDEDKHFFYYFFESRNDPKNDPVILWLNGGPGCSSLTGLFFELGPSSIDKNLKPVYNPHSWNANASVIFLDQPINVGYSYSSQSVSNTIAAGKDVYAFLQLFFKNFPEYANLDFHIAGESYAGHYIPAFASEILTHPERNFNLTSVLIGNGLTDPLVQYEYYEPMACGEGGEPSVLEPEECDGMLNLLPRCLSLIESCYESGSVWSCVPATIYCNNGQMGPYQKTGRNVYDIRTMCEGSSLCYSQLEYIDQYLNLPEVKKALGAEVDEYQSCNFDINRNFMFAGDWMKPYQKNVIDLLEKELPVLIYAGDKDFICNWLGNQAWTNRLEWSGSKGFTKAPVKSWKVGKNAAGEVKNYKHFTFLRVFGGGHMVPYDQPENALDMVNRWISGDYKY

SEQ ID NO: 23039 - protein, 491 aa, Drosophila melanogaster
MASFQIHQDMSNKENPGIKIPAGVKNTKQPLAVIGGKAEKNALAPRANFAVLNGNNNVPRPAGKVQVFRDVRNLNVDENVEYGAKKSNVVPVVEQFKTFSVYEDNNDTQVAPSGKSLASLVDKENHDVKFGAGQKELVDYDLDSTPMSVTDVQSPMSVDRSILGVIQSSDISVGTETGASPTGRVKELPPRNDRQRFLEVVQYQMDILEYFRESEKKHRPKPLYMRRQKDISHNMRSILIDWLVEVSEEYKLDTETLYLSVFYLDRFLSQMAVVRSKLQLVGTAAMYIAAKYEEIYPPEVGEFVFLTDDSYTKAQVLRMEQVILKILSFDLCTPTAYVFINTYAVLCDMPEKLKYMTLYISELSLMEGETYLQYLPSLMSSASVALARHILGMEMWTPRLEEITTYKLEDLKTVVLHLCHTHKTAKELNTQAMREKYNRDTYKKVAMMESVEMSKDDFDQLCEAYNCKQKEDEHQQPDINTKSNVNLFYKF

SEQ ID NO: 23040 - protein, 888 aa, Arabidopsis thaliana
MPLKEDDCCLFAEEYDGPPLSYNIPCAVPINVEKIPVAAVVSPVRISDNMSFPVIQPILSVESKKFLIDSVSPTSVIANCGSNQLELVSDSITVSPTSVIEHTEEEEEEEGGDGEDCELSSSGELLLRSCSVKESLDLNESSSNPLVPDWESNESVLSMDYPSSRVTGDCVSETNGDGKKQPVVTFLGIASDDGFEEEESCSNQRRVRVVPVKKQPQTKGKKGSCYRCFKGSRFTEKEVCLVCDAKYCSSCVLRAMGSMPEGRKCVTCIGFPIDESKRGSLGKCSRMLKRLLNDLEVKQIMKTERFCEANQLPAEYVYVNGQPLYPEELVTLQTCPNPPKKLKPGDYWYDKVSGLWGKEGEKPYQIISPHLNVGGPISPEASNGNTQVFINGREITKVELRMLQLAGVQCAGNPHFWVNEDGSYQEEGQKNTKGYIWGKAGTKLLCAVLSLPVPSKSTANASGEQLYSANSRSILDHLEHRTLQKILLVGNSGSGTSTIFKQAKILYKDVPFLEDERENIKVIIQTNVYGYLGMLLEGRERFEEEALALRNTKQCVLENIPADEGDAKSNDKTVTMYSIGPRLKAFSDWLLKTMAAGNLGVIFPAASREYAPLVEELWRDAAIQATYKRRSELGLLPSVANYFLERAIDVLTPDYEPSDVDILYAEGVTSSSGLACLDFSFPQTASEENLDPSDHHDSLLRYQLIRVPSRGLGENCKWIDMFEDVGMVVFVVSMSDYDQVSEDGTNKMLLTKKLFESIITHPIFENMDFLLILNKYDLLEEKVERVPLARCEWFQDFNPVVSRHRGSNNGNPTLGQLAFHFMAVKFKRFYSSLTGKKLFVSSSKSLDPNSVDSSLKLAMEILKWSEERTNICMSEYSMYSTEPSSFSN

SEQ ID NO: 23041 - protein, 322 aa, Trypanosoma cruzi
MPSVSEAKREYEERFNGCLTKYGRVLFCLMDNVRSQQVHDVRRDLRGLGELVMGKKTLQKKIVERRAEDKKASAYDKLLYNTCIEKKLLCGNTALIFTNEEIPVITAVLDKHRVQAPARVGPSPMRRHCPAGNTGMEPKATSFFQALNIATKIAKGTVEIVSDKKVLSVGDRVDNSTATLLQKLDISPFYYQVEVQSVWDRGMLFLREDLSITDDVVEKYLLEGISNVAALSLGAGIPTAATLPHMIMDAFKTLLGASVATEYEFDEFDGKNLRKAALEGNLGGGVADAAAAADTGAAAAPAAAAEPEEEDDDDDFGMGALF

SEQ ID NO: 23042 - protein, 116 aa, Prunus persica
MGLAENQNGHRIKKYRGMGSLEAMTKGSDQRYLGDTAKLKIAQGVVGAVADKGSVLKFIPYTIQAVKQGFQDLGASSLQSGHDLLRTSVLRLEVRTGAAQAEGGVHGLVSYEKKSF

SEQ ID NO: 23043 - protein, 1442 aa, Mus musculus
MTVFRQENVDDYYDTGEELGSGQFAVVKKCREKSTGLQYAAKFIKKRRTKSSRRGVSREDIEREVSILKEIRHPNVITLHEVYENKTDVILILELVAGGELFDFLAEKESLTEEEATEFLKQILSGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYDFEEEFFRNTSTLAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSSYDVNQPNKHGTPPLLIAAGCGNIQMLQLLIKRGSRIDVQDKGGSNAIYWASRHGHVDTLKFLNENKCPLDVKDKSGETALHVAARYGHADVVQLLCSFGSNPDFQDKEEETPLHCAAWHGYYSVAKALCEVGCNVNIKNREGETPLLTASARGYHDIVECLAEHGADLNASDKDGHIALHLAVRRCQMEVIKTLLGHGSFVDFQDRHGNTPLHVACKDGSAPIVVALCEASCNLDISNKYGRTPLHLAANNGILDVVRYLCLMGANVEALTSDGKTAEDLAKAEQHEHVAGLLARLRKDTHRGLFIQQLRPTQNLQPRIKLKLFGHSGSGKSTLVESLKCGLLRSFFRRRRPRLSSTNSTRFPPSPLAAKPTVSVSINNLYPGCENVSVRSRSMMFEPGLTKGMLEVFVAPSHHLHCSTDDQSTKAIDIQNAYLNGVGDFSVWEFSGNPVYFCCYDYFAANDPTSIHIIVFSLEEPYEIQLNQVIFWLSFLKSLVPVEEPIAFGGKLKNPLRVVLVATHADIMNIPRPAGGEFGYDKDTSLLKEIRNRFGNDLHVSNKLFVLDAGASGSKDIKVLRNHLQEIRSQIVSGCSPMTHLCEKIISTLPSWRKLNGPNQLMSLQQFVYDVQDQLNPLASEDDLRRIAQQLHSTGEINIMQSETVQDVLLLDPRWLCTNVLGKLLSVETPRALHHYRGRYTMEDIQRLVPDSDVEELLQILDAMDICARDLSSGTMVDIPVLIKTDSLQRSWADEEDEVMVYGGVRIVPVEHLTPFPCGIFHKVQVNLCRWIHQQSAEGDADIRLWVSGCRIANRGAELLVLLVNHGQGIEVQVRGLETEKIKCCLLLDSVCSTIETVMATTLPGLLTVKHYLSPQQLREHHEPVMVYQPRDFFRAQTLKESSLTNTMGGYKESFSSITCFGCHDVYSQASLGMDIHASDLSLLTRRKLSRLLDPPDPMGKDWCLLAMNLGLPDMVAKHNVNNRASRDFLPSPVHALLQEWTSYPESTVGILISKLRELGRRDAADFLLKASSVFKINLDGNGQEAYASSCNSGTSYNSISSVVSRRDSHAWTPLYDL

SEQ ID NO: 23044 - protein, 280 aa, Haemophilus somnus 2336
MNKETQAMMLVPQGSIEGYIHAAYDYPMLTAEEEKELAERLYYHQDLDAAKTLILSHLRFVIHVARGYSGYGLPQADLIQEGNIGLMKAVKRFNPEVGVRLVSFAVHWIKAEIHEYVLRNWRIVKVATTKAQRKLFFNLRKTKQRLGWFSDKEVDMVANELGVSKEDVLEMESRMTGSDVGFDLPVDDDESYAPALYLEDKSSNFAAELENENFETQAADQVANALAELDERSRDIIKSRWLDDEKATLHDLAAKYNISAERVRQLETNALKKLKSAVSF

SEQ ID NO: 23045 - protein, 91 aa, Haemophilus somnus 2336
MRFVKPLDTQRIQEIAQTHSLIVTLEENAIQGGAGSAVAETLYQQQQKVSLLQLGLPDNFIPQGTQKEMLAELKLNAEGIFEQIKQFLQKI

SEQ ID NO: 23046 - protein, 154 aa, Haemophilus somnus 2336
MEVIIHPQSIIHSMVRYIDGSVIAQMGNPDMRTPIAETMAYPHRTFAGVEPLDFYQLSGLTFLKPDYQRYPCLKLAIEAFSAGQYATTALNAANEMAVEAFLNKRIKFTDIAKINTAVLEKIESQVITSIEDVLLVDKQARELANSFVLRTSGT

SEQ ID NO: 23047 - protein, 175 aa, Haemophilus somnus 2336
MGVPQITAIADAAEALRERGIPVIADGGIRYSGDIAKAIAAGASCVMVGSMFAGTEEAPGEIELYQGRAFKSYRGMGSLGAMSKGSSDRYFQSDNAADKLVPEGIEGRIPYKGFLKEIIHQQMGGLRSCMGLTGCATIEELRTKAQFVRISGAGIKESHVHDVTITKEAPNYRMG

SEQ ID NO: 23048 - protein, 242 aa, Haemophilus somnus 2336
MAKTVLITGSSRGIGKAIALNLAAQGYDIVVHCRSRVDEAENVAQEVRALGQNARVLQFDVADREKVRSILEADVEENGAYYGIVLNAGLTRDNAFPALTDDDWDSVLRTNLDGFYNVLHPIMMPMIRRRQAGRIVCITSVSGLIGNRGQVNYSASKAGIIGAVKALAIELAKRKITVNCVAPGLIDTDILDENVPIAEILKMIPAGRMGDPEEVAHAVQFLMDEKAAYITRQVIAVNGGLC

SEQ ID NO: 23049 - protein, 317 aa, Haemophilus somnus 2336
MPKENFQKLFIGNESSEGWLDKLLLARKPWSERLIQHESAVRQSINQLLKIEQETNLTISQIREICDKVAQGELKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQKMGREATSEELAERMGMPEDKIRKVLKIAKEPISMETPIGDDDDSHLGDFIEDNTLELPLDSATAQSLRAATHEVLEGLTPREAKVLRMRFGIDMNTDHTLEEVGKQFDVTRERIRQIEAKALRKLRHPSRSETLRSFLDE

SEQ ID NO: 23050 - protein, 118 aa, Haemophilus somnus 2336
MGVKKYIKYCQEKDKSTDRPYTSRYIGSLVSDFHRNMLKGGIYIYPSATTYPKGKLRLLYEGNPMAFLAEQAGGIASDGKDRILDIQPKELHERVPLFVGSREMVRKAEEFMREFSEE

SEQ ID NO: 23051 - protein, 331 aa, Haemophilus somnus 2336
MQKRKGILALGNLLVDRTLVISDYPKETMLATISEMGLHCGGGCTNVLFNLSKLDPELSLFLSGAIGKDSEGQFILRQAKKHNVVLTAMLESDLPTSFTDVMINSQNGERTFFHYIGAMQQYDHQTVTSIDCNAKIAHIAYLPLLPALLDVSKLVKTLTVLKEKGFLISIDLVSCENKQIFKNVIRPILSYVDFVIINDVEAKILTEQVNIASTEKELVTTAKAIMQLGVKKAVIVHSPKYAVACDLLGNIVTVPSYWVEKDKILSTLGAGDAFCSGILYGLHQNLPLQKTLQLGHGLAYFNLFSLSATEGAVSYVKLKDFIRTKETMQNT

SEQ ID NO: 23052 - protein, 271 aa, Haemophilus somnus 2336
MKVEGESLFNDGVGLVIFTTIFTVAFGGHEPTAMEITKLFLAEAVGGIFFGLILGVIAHFLISATDDGSLEILLTLTIPTAGFMLANLLHVSGALAMVVAGIMISNWTRHSGFSEQSQHYLDHFWEMIDHFLNSLLFLLIGSAMLLVNFTSQAIILSLIAIPVCLFCRYASVWIPFKFLSMKTVYNPYTLRILTWGGLRGGLSLAMALSIPATSAFLENIGMNVRDLFIIITYSVVLFSILIQGTTIETMIRKSKEATLQKRGYIGLKNQT

SEQ ID NO: 23053 - protein, 280 aa, Haemophilus somnus 2336
MRLLLYWEENAKGSNMSIEVWSLIRAEAAKLAENEPMLASFFHATILKHNNLGSALSYILANKLANPIMPAIALREIIEEAHQNQPQIIESAACDIRAVRHRDPAVEQYSTPLLYLKGFHALQSYRITHYLWQQGRKALAIYLQNQISVAFDVDIHPAARIGCGIMFDHATGIVIGETSVIENDVSILQGVTLGGTGKESGDRHPKIREGVMIGSGAKVLGNIEIGRYAKIGANSVVLQFVSEYTTVAGVPSQIVGKNKGAKPAFDMDQYFIDDAINLNI

SEQ ID NO: 23054 - protein, 408 aa, Haemophilus somnus 2336
MQNLIRGKRIVIGITGGIAAYKTIELIRLLRKAQAEVRVVLTNAATEFVTPLTLQAISGNAVSQSLLDHEAELAMGHIELAKWADLIVIAPASADFIARMAVGMANDLLSTICLATNSPIFLAPAMNQQMYAQTVTQQNLAQLMARGVQFIGPNSGEQACGDVGIGKMSEPFEIFTALCQSFLHTQDLLDVSVVITAGPTREAIDPVRYISNHSSGKMGFAIAEAFAQRGAKVTLISGPVNLATPHNVQRINVVSAQEMYQHAIQSAEQNQIFIGCAAVADYRVEQIAEQKIKKIPGNDEMVLKLVKNPDILATVANLMENRPFVVGFAAETQNVEQYAKDKLQRKNLDMICANDVSGGQVFNSEQNALQLFWQNGQERLTLKHKSDLAKQLVDKIIVRYKWKLEESK

SEQ ID NO: 23055 - protein, 122 aa, Actinobacillus pleuropneumoniae serovar 1 str. 4074
MIIEMTDGGVDFSFECVGNVDLMRSALECCHKGWGESIIIGVAPAGAEIRTRPFQLVTGRVWRGSAFGGVKGRTELPGIIDQFMKGEFKLRDFITHTMPLEDINKAFDLMHEGKSIRTVIHF

SEQ ID NO: 23056 - protein, 365 aa, Actinobacillus pleuropneumoniae serovar 1 str. 4074
MNQLNEQQLSEIKFVLQNFTHPTLQKDLIALNVFKKAELGAGILRLELTMPFAWNSGFAVLKTETEAQLKQVTGASEVKWILNYQIATLKRANNHPAVNGVKNIIAVTSGKGGVGKSTTSVNLALALKAQGAKVGILDADIYGPSIPHMLGAQDQRPTSPDNKHITPIEVYGLQSNSIGYLMADDNATIWRGPMASSALSQLLNETWWTELDYLVIDMPPGTGDIQLTLSQQIPVTGAVVVTTPQDIALLDAVKGISMFQKVSVPVLGIIENMSVHICQNCGHHEDIFGTGGAEKVAKKYGTKVLGQMPLHIRLRQDLDAGTPTVVAAPEHETSQAYIELAAKVASELYWQGSVIPSEIMIREVK

SEQ ID NO: 23057 - protein, 526 aa, Actinobacillus pleuropneumoniae serovar 1 str. 4074
MYDLGILREQDAFLNATLEKNNRDKSVLMATISHELRTPLNGIIGLSRILLEGELTDQQREYLKTINISAVSLGHIFSDIIDLEKIDSRRVELFRKEIEFSQLISDISNFGNLMAEQNKIKFHIDYSDDLPNFIYVDNARLSQILWNLVSNAVKFTPAGGDIYLSVKRIDNDHFSFSLRDTGIGIPKHEQRKVFAMFYQAENSQERKAQGSGIGLAISKRIAKLMGGDLTLRSEMGKGSTFTLTIQADPVEAKKSVKINAHALKVLLVEDIEVNVVVARAMLEKFGCDVDVAMTGAQAFELFERNSYDLILLDIQLPDMTGFDIAQRLRERYENEEVDYLPLLVALTANIMQTKEEYQQQGMDDVLRKPLSLEALSECLNHYFNSDFSEKTAEIPPLVETEETLNLPYDRKILSEFIEVMGAKAVLANFALFAKLMPEYLANLQHYLTEWQATDSPEMRKCTADEAHKIKGALASVSLKRLQEVAQLAQSDNGEVWEQHIAQWVFQIAQQWQADLALAENWVKENY

SEQ ID NO: 23058 - protein, 573 aa, Actinobacillus pleuropneumoniae serovar 1 str. 4074
MITGIAASPGVVFGKALVLKEEPIVLNTQKITADQIEAEKAKFFAGREKAAAQLTAIKEKARGTLGEEKEAIFEGHLMILEDEELEEEILGYIADNLVTADVAASKVIDMQASMLAEIDDEYLKERAGDIRDIGNRLLRNILNMHIIDLGDIQEEVILVAYDLTPSETAQLNLDKVLGFITDIGGRTSHTSIMARSLELPAIVGTNDITARVKTGDTLILDAVNNQIHINPSDAALAEFKAIQERVAAEKAELAKLKDLPAETLDGHRIEVAGNIGTIRDVDGVLRNGGESVGLYRTEFLFMDRSELPSEEEQFQAYKEIVEAMDGKQVVLRTMDIGGDKELPYLNLPKEMNPFLGWRAVRIGLTRREILDTQLRAVLRASAFGKLAVMFPMIISVEEIRELKAIVAELKEQLRAEGKAFDENLQLGIMVETPSAAVNARHLAKEADFFSIGTNDLTQYTLAVDRGNEIIAHLYNPLSPSVLNLIKQVIDASHAEGKWTGMCGELAGDVRATALLLGMGLDEFSMSAISVPHVKKLARSINYADAKALADEALAQPTATDIEKLVNDFYAKLN

SEQ ID NO: 23059 - protein, 465 aa, Actinobacillus pleuropneumoniae serovar 1 str. 4074
MLPNTADLSTQLTKDIRLNIPMLSAAMDTVTETKLAISLAQEGGIGFIHKNMSIERQADRVRKVKKFESGIVSEPVTVSPDLTLAELAELVKKNGFAGYPVVDSENNLIGIITGRDTRFVRDLTKTVAKVMTPKERLVTVKESANREEILELMHQHRVEKVLMVDDNFKLKGMITVKDFQKAEQKPNACKDEFGRLRVGAAVGAGPGNEERIDALVKAGVDVLLIDSSHGHSEGVLQRVRETRAKYPNLPIVAGNIATAEGAIALADAGASAVKVGIGPGSICTTRIVTGVGVPQITAIAEAAAALEGRGIPVIADGGIRYSGDISKAIAAGASCVMVGSMFAGTEEAPGEIELYQGRAFKSYRGMGSLGAMSKGSSDRYFQSDNAADKLVPEGIEGRIPYKGFLKEIIHQQMGGLRSCMGLTGSATIEDLRTKAQFVRISGAGIKESHVHDVTITKEAPNYRMG

SEQ ID NO: 23060 - protein, 214 aa, Actinobacillus pleuropneumoniae serovar 1 str. 4074
MAIQNLPVIFAIDRAGIVGADGQTHQGAFDVSFMRCIPNMTIMCPSDENEMRQMLYTAYRMNTPTAVRYPRGNAQGVALAPMQALEVGKGKLIQQGQKVAILNFGPLLNEARIVAEKHNYTLADMRFVKPLDEQLVAELADSHELLVTLEENAIQGGAGSAVNEYLQKIGKIRPLVMLGIPDFFVPQATQAESYADLGLDAAGIEQRIQAVVNQ

SEQ ID NO: 23061 - protein, 619 aa, Actinobacillus pleuropneumoniae serovar 1 str. 4074
MEQQLEQQSQLELLIAQGREQGYLTISEVHDHLPEELVDAEQIEDIIQMINDMGIKVLETAPDTDELMLAENIADEDVVEEATKVLSTVESELGRTTDPVRMYMREMGTVELLTREGEIDIAKRIEEGINEVQCAVAEYPEALTELIGFYAQVEEGTMRLSDLVTAFVDPNIQADEALEDLDVDLDDEEEAEDVADVDDESEEEESDGSTDTGDDNSIDPELAREKFYALREQHEKALQAIQKHGRSHKKSREQIQALSDIFREFRLVPKQFDLLVESMQKMMKQVRSEERQIQRYAVEYAQMKKADFLKLFQGNETSEEWIEKAINAKKGAAPKLANYIDQIRVNIDNLQRMEQTTGLTIAQIREIGGRIANGELKARRAKKEMVEANLRLVISIAKKYTNRGLQFLDLIQEGNIGLMKAVDKFEYRRGYKFSTYATWWIRQAITRSIADQARTIRIPVHMIETINKLNRISRQCLQEMGREATPEELAERMGMPEDKIRKVLKIAKEPISMETPIGDDDDSHLGDFIQDESLELPLDSATAESLRLATNEVLEGLTPREAKVLRMRFGIDMNTDHTLEEVGKQFDVTRERIRQIEAKALRKLRHPSRSETLRSFLDD

SEQ ID NO: 23062 - protein, 170 aa, Actinobacillus pleuropneumoniae serovar 1 str. 4074
MKKSLLALVLGATLTLAACDQANQAKDAAAAKMEDAKAATQDAAKAMADKATEMKDAAATKMEDAKAMTQDAAKAMADKATEMKDAAATKMEDAKAATQDAAKAMADKATEMKDAAATKMEDAKAMTQDAAKAMADKATEMKDAAATKMEAGAEAVKEKAAEVKQAVETK

SEQ ID NO: 23063 - protein, 271 aa, Actinobacillus pleuropneumoniae serovar 1 str. 4074
MNESELNQIWKNIREEAQELVDNEPMLASFFHATILKHSNLGGSLSYILANKLANPIMPAIALKEIIEEAYQTNPQIIASAACDIDAVRTRDPAVDKWTTPLLYLKGYHAIQSYRVTHYLWQQGRKALAIYLQNEISVAFDVDIHPAAKLGCGIMFDHATGIVVGETAVIENDVSILQGVTLGGTGKEHGDRHPKIREGVMIGAGAKILGNIEIGRYSKIGANSVVLQPVPDHATAAGVPARIIGQSSVQKPAFDMNQYFEDIEGTYGDGI

SEQ ID NO: 23064 - protein, 112 aa, Actinobacillus pleuropneumoniae serovar 1 str. 4074
MKKIEAIIKPFKLDDVREALTDAGITGMTVTEAKGFGRQKGHTELYRGAEYAIDFLPKIKLEIVVADDQVDACIEAIIDTAQTGKIGDGKIFIYDVERVIRIRTGEENEDAL

SEQ ID NO: 23065 - protein, 334 aa, Actinobacillus pleuropneumoniae serovar 1 str. 4074
MKTLGEFIIEKQAEYPEAKGELSGILSSIRLAAKIIHREINRAGLSQDILGVAGSENIQGEAQMKLDVFANETMKKALLAREEVAGFASEEDDNFVAFENDRAKNAKYILMTDPLDGSSNIDVNVSVGTIFSIYKRVSPIGSPVTMEDFLQEGRKQVASGYVTYGSSTMLVYTTGNGVNGFTYDPSLGLFILSHPDMKIPTEGKYYSINEGQYVTFPMGVKKFIKYCQESDEATKRPYSSRYIGSLVSDFHRNLLKGGIYIYPTSTVYPKGKLRLLYEGNPMAFLAEQAGGMATDGFNPILDIKPSELHQRVPFFVGSTSMVKQADKFMQECAE

SEQ ID NO: 23066 - protein, 297 aa, Actinobacillus pleuropneumoniae serovar 1 str. 4074
MTITILDGGMSRELMRLNAPFKQPEWSALSLYEKPSAVQQVHEDFIANGAEVITTNSYAVVPFHIGEQRFSADGKMLADLAGRLAKQAVKNSGKSAKIAGSLPPMFGSYRADLIQADRFAEIAQPIIDGLAPYVDIWLCETQSAIIEPTSIKPLLPKDDRPLWVSFTLTDDEPTPEPQLRSGEPVALAIEKMVELGVDAILFNCCQPEVIEQALAITQSILKAKNATHIQTGAYANAFAPQPKDATANDGLDEVRKDLDPEAYLAWAQKWTAQGATIVGGCCGIGIEYINTLAKHLK

SEQ ID NO: 23067 - protein, 332 aa, Actinobacillus pleuropneumoniae serovar 1 str. 4074
MKRAISFEFSRVTEAAALAAYEWIGRGDKNAADDAAVKAMRLVMNKMEIRGEIVIGEGEIDEAPMLYIGEKVGRSQPEDKEVAIAVDPIDGTRMTAMGQAGALSVLAAGSKETFLQAPDMYMEKLVVDSEAKGMIDLDLPLEQNIRRVASKKGKLLTQMTVAILAKPRHDEIIKTVQKLGVKVMAIPDGDVAAAVQCCLPDSDLDLVYGIGGAPEGVVAAAAVRALGGDIQGRLIPRNQVKGNSPENLFAAEKELSRCAQMNVPVNKVLKLEDLVRDDNVLFAATGITTGDLLKGVQRKGSMMFTETLLIRGRSRTIRKLASYHDISRLSED

SEQ ID NO: 23068 - protein, 436 aa, Actinobacillus pleuropneumoniae serovar 1 str. 4074
MAKIVKVIGREIIDSRGNPTVEAEVHLEGGFVGLAAAPSGASTGSREALELRDGDKSRFLGKGVLKAVSAVNNEIAQAILGKDGSAQAEIDQIMIDLDGTDNKSKFGANAILAVSLATAKAAAASKGLPLYAYIAELNGTPGVYSMPLPMMNIINGGEHADNNVDIQEFMIQPVGASTLKEALRIGAEVFHNLAKVLKSKGLNTAVGDEGGFAPNLASNADALACIKEAVEKAGYVLGKDVTLAMDCASSEFYNKENGLYEMKGEGKSFTSQEFTHYLEGLCNEYPIKSIEDGQDESDWEGFAYQTKVLGGKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALAAAGTPAPFNGLKEVKGQA

SEQ ID NO: 23069 - protein, 158 aa, Pseudomonas aeruginosa UCBPP-PA14
MKAKEKDMSDETFMREAIALARANVEAGGRPFGAVLVRDGRVLARGVNQIHETHDPSAHAELQAIRQASQALGSPHLDGCVIYASGHPCPMCLAAMHLCGIQAAWFAYSNEDGEAFGLSTATLYAEMARPPQRQSLPLRALRPAGEEGLYRQWRQGQA

SEQ ID NO: 23070 - protein, 234 aa, Pseudomonas aeruginosa UCBPP-PA14
MARKQAESEEITSFYLEPVDGQPLLAFQPGQYIGLRLDIDGEEVRRNYSLSAASNGREYRISVKREAGGRVSNHLHDRVAEGDELDLFPPAGDFVLRDSDKPLVLITAGVGITPALAMLQEALPQARPIRFIHCARHGGVHAFRDWIEDVSAQHEQVEHFFCYSEPRVGDSPDAEGVLSREKLADWLPQERDLDAYFLGPRPFMAQVKRHLADLGVPSQQCHYEFFGPAAALDA

SEQ ID NO: 23071 - protein, 772 aa, Pseudomonas aeruginosa UCBPP-PA14
MDIALTHRLSFKQASLTVLVAFILGTLLSLIQVGVDYASQDASINREVRALLDVSHNPAARIAYNIDAELAQELVLGLLRSPAVVRAEIIDTSGLPLASASREPAESRLRPLSDFLFGHKRVYEDPLHVDHAPGEALGVLQLEIDTFVFGNDFLRRAGITLLSGFVRSLLLSLILLVLFYTLLTKPLVSLIQALSGHDPRSPARMRLPCPKGHERDEIGVLVEVINRQLGRISVEIEQRREAENRLTQYLEELESIVAARTAELKAANARLTLSNQELEEARQTALDMAQARASFLANMSHEIRTPLNGLLGMLSLSLDGPLTPEQRQQLSIAHDSGKVLVELLNDVLDLSKFEAGQLVLEQIPFDLGVLVEDTASLLSQNAAAGVELTCLVDPALPAQVSGDPTRIRQVVSNLLSNALKFTRLGRVDVRVEATAEGVRISVRDTGIGIAQEALDRIFQPFTQADAGITRQYGGTGLGLALTRKLCEAMQGELTVESTVGLGSLFSVGLPLAPVSPPLQALPLRGRVIAQCSANSGLAQLLQTWLPRWGLEYKRLETDDSLLGHSLDVLISDCPDCLMGLRPSIGTPILLVTAYGSFLEPELARRLSPLRQLARPLSRNQLYQALKHVLEHTAIAPSSASDTAGEQRDTRVLLVEDNPVNQLVAKGLLHKLGCQVWIAEHGLNALKMLEEHPIDLVLMDCNMPVMDGYEATRQIRDSGRWGGLPIIALTANALPDERERCRAAGMDDYLAKPFHRDELKAILDRWCPLTAGD

SEQ ID NO: 23072 - protein, 211 aa, Pseudomonas aeruginosa UCBPP-PA14
MWRYVSKVDETVIRAYSMANYPEEQGVVKFNIRIASPPPGSDLPPGQMSSWVFNLKPGDKVTVYGPFGEFFAKDTEAEMVFIGGGAGMAPMRSHIFDQLRRLKSNRKISFWYGARSLREAFYTEEYDQLQAENPNFQWHLALSDPQPEDNWTGLTGFIHNVLFENYLKDHPAPEDCEFYMCGPPMMNAAVIKMLTDLGVERENILLDDFGG

SEQ ID NO: 23073 - protein, 248 aa, Pseudomonas aeruginosa UCBPP-PA14
MRNVMLITGASRGIGAATALLAAERGYAVVLNYLRNREAAEALRQRIERQGGEALAVAADVAEEGDVERLFAAIDERFGRLDVLVNNAGMLEAQTRLENIDAARLHRVFATNVTGSFLCAREAVKRLSTRHGGHGGSIVNVSSMASRLGSPNEYIDYAAAKGAIDSMTIGLAREVAAEGIRVNAVRPGLIDTEIHASGGEPGRIERLKGGIPLGRGGTAEEVARAILWLASDEASYSTGTFIDVSGGR

SEQ ID NO: 23074 - protein, 210 aa, Pseudomonas aeruginosa UCBPP-PA14
MRHEDHLGNRGLLKPGGVQWMTAAHGIIHSEMPEQVEGAMRGFQLWVNLPAKNKLAPAGYRDIEPEDVPRLETAGGVKVTVIAGRFDDGQAQQIGAVERPDTEPHYYDLQLPAGGRIAPRLPDGHRVLLYVYEGSLTVEGERPVEIATNRLARLSEEGELSLRSEAGARVLVLAGKPLREPIVQYGPFVMNSREEIEQALRDYRDGVLAV

SEQ ID NO: 23075 - protein, 292 aa, Pseudomonas aeruginosa UCBPP-PA14
MRTPAWLGSGMPLLFVLLWSTGFLGAKFGLPYAEPFTFLAIRLLLAAALLAAFALLSGAPWPGSARLAGHVAVAGLLVHGLYLGGVFLAIEHGMSAGLTSLLVGLQPLATAALAGIWLGEQVSRRQWLGLALGLAGVALVVLGRIHGGADGLAWAAVLVALAAITCGTLYQKRFCGGMDLRTGGVVQYLASGALLGLAALLFESREVQWSTPFVLTLGWLVLGLSFGAVGLLYTLIRHGAASKVASLFYLVPPVTALASWLLFDEPLAPAAIGGMLLVMLGVALVNWPGRRA

SEQ ID NO: 23076 - protein, 259 aa, Pseudomonas aeruginosa UCBPP-PA14
MFPMHPYFSLAGRVALVTGGSRGIGQMIAQGLLEAGARVFICARDAEACADTATHLSAYGDCQAIPADLSSEAGARRLAQALGELSARLDILVNNAGTSWGAALESYPVSGWEKVMQLNVTSVFSCIQQLLPLLRRSASAENPARVINIGSVAGISAMGEQAYAYGPSKAALHQLSRMLAKELVGEHINVNVIAPGRFPSRMTRHIANDPQALEADSASIPMGRWGRPEEMAALAISLAGTAGAYMTGNVIPIDGGFHL

SEQ ID NO: 23077 - protein, 918 aa, Pseudomonas aeruginosa UCBPP-PA14
MSRLCLVLLLLCCALPARAQPPAPLDGEDLRLSLGAYAEYYRDAGGKARLGDILALPAQAFAALRGDHANFGKNAAAWWFRVRLDNRNGADLAGFLEVNYPLLDDLKVYLLTADGRIEQQESGDLFAFSQRPVQVRNFWFPLRLPPGESTLLLRVQSSSTVYVPLYFSTYAASAASQETLMGFNGAFYGVLFGLFCYNLFLFVSLREATYAWYLLYNLSLGLFSASFDGLLFKLLPGHVALESAGIYLLMYLSCLVSIQFSRGYLYTRRDFPRLDRFLRGLLLACVVLLASEPLVGLRAWNVLASLTVMLVSLSLLLAGVHVWRQGLRYGLYYILAWGALLLSFLVTTAASLGFELFGLFGSSVVKIGMTVELVTLSIGLADRINALKEEGFRSRQAAEQARVENEAKSRFLAKMSHEIRTPLNGVLGMLQLLRDTPLDRGQAAYVETIASSGSALMSVINDILDYARIESGKLHLERIDFDLEELLSDTLALFSAQAVEKRLRLHLGLDRGVPRRLNGDPTRLRQVLMNLLSNALKFTAEGHVAVRVQRRFDEGGRERLLYSVSDSGIGISAQAQKTLFESFSQADSSTTRRYGGSGLGLAISRELVQMMGGRIEVSSEPGKGTRFSVDLPLSPALEAGEADELAQLLQHRPALLASEDNLTLDCLQALLERWGLRVERCLQPRRLNAYLEDFSAPPLLVLAAPWPGPPSIWLDTLYAQLEQGQRILLLCPPQHCQDLPPHEGLRLLALAQPVAVKALREALLELYRERRRQPGRSSEAAPDERLDAPCILVAEDNPVNQLVVRGFLAKRGYAVRLAGNGRLALDEYLRDPNGIQLILMDGEMPEMDGFEATRLIRREERAQGWPRVPIVALTAHILDEHRRAGIEAGMDAYLGKPVDRAELYATLERLLGQPSRQA

SEQ ID NO: 23078 - protein, 173 aa, Pseudomonas aeruginosa UCBPP-PA14
MVSGALIQLITQTAWDNLDYLVVDMPPGTGDIQLTLAQKVPVAGAVIVTTPQDLALLDAKKGVEMFRKVNIPVLGVVENMAVHICSNCGHAEHLFGEGGGEKLAAQFGVELLASMPLSIAIRTQADSGRPTVIADPESQLAMLYQEIARHVGARIVLSERASVGLPNISISDD

SEQ ID NO: 23079 - protein, 297 aa, Pseudomonas aeruginosa UCBPP-PA14
MRSQALRADVLMLITAMIWGVSFVAQRLGMDAIGPFLYTGLRFVLGALVLVPLLMLRSRRDGAQPFNRGQLLAGVILGVALTTGINLQQVGLLFTSVTNSGFITGLYVIVVPLLGLLFGQRTGAGTWLGASLAVLGMALLSIGPGFQVASGDWLQLAGAVVWGAHVLLVGLFASRYDPIRLAFLQFATCAAVSLLLALVFEEIHWDAIVQAGPALLYGGLLGVGTGFTLQVVAQKHAIASHAAIILSLEAVFAAIAGALFLAETLHLRGYFGCALMLAGMLVAQLWPRKLAAEARPA

SEQ ID NO: 23080 - protein, 192 aa, Pseudomonas aeruginosa UCBPP-PA14
MLNTAKVEEGATVAIFGLGGIGLAAIIGAKMAKAARIIAVDINPGKFDIARELGATDFINPKDYDKPIQDVIVELTDGGVDYSFECVGNVQLMRAALECCHKGWGESVIIGVAGAGQEISTRPFQLVTGRVWRGSAFGGVRGRSELPSYVEKAQKGEIPLDTFITHTMGLEDINEAFELMHEGKSIRTVIHY

SEQ ID NO: 23081 - protein, 260 aa, Pseudomonas aeruginosa UCBPP-PA14
MVQPVGAKNFAEALRMGAEIFHHLKAVLKARGLNTAVGDEGGFAPNLSSNEDALAAIAEAVEKAGYKLGDDVTLALDCASSEFFKDGKYDLEGEGKVFDAAGFADYLAGLTQRYPIISIEDGMDESDWAGWKGLTDKIGAKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAPYRGRAEFRG

SEQ ID NO: 23082 - protein, 174 aa, Pseudomonas aeruginosa UCBPP-PA14
MMNKGLELIEACWLFDAQPSQVEVVIHPQSVIHSMVDYVDGSVIAQLGNPDMRTPISYAMAWPERIDSGVSPLDMFAVGRLDFQRPDEQRFPCLRLASQAAETGGSAPAMLNAANEVAVAAFLERRIRFSDIAVIIEDVLNREAVTAVESLDQVLAADRRARSVAGQWLTRHAG

SEQ ID NO: 23083 - protein, 245 aa, Pseudomonas aeruginosa UCBPP-PA14
MVDTAHGHSKGVIERVRWVKQTFPDVQVIGGNIATAEAAKALAEAGADAVKVGIGPGSICTTRIVAGVGVPQISAIANVAAALEGTGVPLIADGGIRFSGDLAKAMVAGAYCVMMGSMFAGTEEAPGEIELFQGRSYKSYRGMGSLGAMSGSQGSSDRYFQDASAGAEKLVPEGIEGRVPYKGALSAIVHQLMGGLRAAMGYTGSADIQQMRTQPQFVRITGAGMAESHVHDVQITKEAPNYRVG

SEQ ID NO: 23084 - protein, 506 aa, Pseudomonas aeruginosa UCBPP-PA14
MRYAHPGSEGAIVSFKARYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAEVLTGGSVEKLEGNLASGYYIQPTLLKGHNKMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDINPLGFF

SEQ ID NO: 23085 - protein, 428 aa, Pseudomonas aeruginosa UCBPP-PA14
MHRRRHSQRRLGMQPGAGGADLGGTAALPTGAGDQPFRLWRHPGRQRAATGGDARDLRRSDDGGRLSAYVPARRAARGGRPRDARGTAPALARDAHRRARRVPVHDPRPAQRRRGPPRTQRPGRGLPAPLPAQPRRALDAIPQHGADLPGDPRGGRRTARPPAPRLPGRTAGAPIVRRLENRVALVTGAGQGIGRAIAECFAAEGARVLLATRTASRGQAVLEAIRLGGGTAELLAVDLSEHDAARRAVSATLERFGQLDILLHNAAAFPQCALAELDEGTLERTLAVNLKSCFRLTQAALPALRRSVAGRVLVTSSVTGPRTAIPGLSHYAASKAGVNGFIRAAALELAGDGITVNGVEPGLVATPALGSLGDAAALAAHIPLGRVGQPLDIAHAMLFLASDEASYITGQTLVVDGGALLPENGGLA

SEQ ID NO: 23086 - protein, 253 aa, Pseudomonas aeruginosa UCBPP-PA14
MRRLENRVALVTGAGQGIGRAIAECFAAEGARVLLATRTASRGQAVLEAIRLGGGTAELLAVDLSEHDAARRAVSATLERFGQLDILLHNAAAFPQCALAELDEGTLERTLAVNLKSCFRLTQAALPALRRSVAGRVLVTSSVTGPRTAIPGLSHYAASKAGVNGFIRAAALELAGDGITVNGVEPGLVATPALGSLGDAAALAAHIPLGRVGQPLDIAHAMLFLASDEASYITGQTLVVDGGALLPENGGLA

SEQ ID NO: 23087 - protein, 370 aa, Pseudomonas aeruginosa UCBPP-PA14
MSLPNANLIASSRKAAAQMATRDTSFIFNEWYVAAFAEEVGRELLARTLLGKRVVLYRTLAGQAVALEDRCAHRSFPLSRSRLEGDGIVCGYHGFRYDSQGELIETPSQKACPRGVGIRHYPLLERGPLVWIWLGDPRLADPKRLPQRPWLEDPGWACSKGYFLHPGNYVSMHENLMDLTHLTYLHANTIGTPDYAGAPYELDLKEGHYRLVRHVLPTTLSPVWGRTTGLDGCPTAARITTSEFLSPGLHQVSATFYDTALPAERRPEFHIRTAHILTPETHGSMHYFIVHGRDFAQDDETVGAFMHEQLFAAFVEDVEGLGALEKVLAEADEDSYEISVASDAPAVATRTYLKRRADEEAHQRAAHRVA

SEQ ID NO: 23088 - protein, 708 aa, Pseudomonas aeruginosa UCBPP-PA14
MAAAGHREHVRPRPELRRPCRRTVVQGAQRTAGVHQVAGHLHRPPPGQLASGQRRLHALRVRTGGSDRQAGAQRPPRGRPRLPGRLHGVQRLRDPRLPGELLPAQPAGEEPRRHHPGGAVDRRRGRGSRAEPADPAHLGQRRAAPGRQHRGHDLRHSLPDRILLQLHDPAAGRHDRHRHPGRPVRRGPRRRSGGGGGRRRSPGQPNRQRGRILPRPRTGARRMIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPTGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 23089 - protein, 648 aa, Pseudomonas aeruginosa UCBPP-PA14
MRTGGSDRQAGAQRPPRGRPRLPGRLHGVQRLRDPRLPGELLPAQPAGEEPRRHHPGGAVDRRRGRGSRAEPADPAHLGQRRAAPGRQHRGHDLRHSLPDRILLQLHDPAAGRHDRHRHPGRPVRRGPRRRSGGGGGRRRSPGQPNRQRGRILPRPRTGARRMIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPTGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 23090 - protein, 620 aa, Pseudomonas aeruginosa UCBPP-PA14
MQRLRDPRLPGELLPAQPAGEEPRRHHPGGAVDRRRGRGSRAEPADPAHLGQRRAAPGRQHRGHDLRHSLPDRILLQLHDPAAGRHDRHRHPGRPVRRGPRRRSGGGGGRRRSPGQPNRQRGRILPRPRTGARRMIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPTGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 23091 - protein, 589 aa, Pseudomonas aeruginosa UCBPP-PA14
MDRRRGRGSRAEPADPAHLGQRRAAPGRQHRGHDLRHSLPDRILLQLHDPAAGRHDRHRHPGRPVRRGPRRRSGGGGGRRRSPGQPNRQRGRILPRPRTGARRMIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPTGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 23092 - protein, 486 aa, Pseudomonas aeruginosa UCBPP-PA14
MIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPTGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 23093 - protein, 499 aa, Pseudomonas aeruginosa UCBPP-PA14
MAAMTELLSREEYAAIAATLDLPQRAFIDGGFRDACGGRTFASTNPATGELLAQVAACDAEDVGHAVASARRAFEDGRWRSRTPAERKAALLRLAELLEEHLLELAVMESLDSGKPIRECQHTDLPETINTLRWHAELIDKIYDSTAPVGSAALAMVVREPIGVVGLVLPWNFPLLMLAWKIGPALAAGCSVVVKPAPETSLTALRVAELASQAGIPAGVFNVVPGGGREAGEPLGRHPDVAMVSFTGSTATGRLFLKYAAESNLKRVVLECGGKNPAVVMNDVEDLDLVAQHVVNGAFWNMGENCSASSRLIVHAEVREALLERIGAQLREWRMGDPLDPRNRLGALVSPAHFEKVRAYLDQARTERLAVRFGGATEAGIFVEPTVVDGVSPHSRLFREEIFGPLLSVTSFDDIDEAIALANDTVYGLAASAYTGSLRHALRLSREIRAGIVTVNCFGEGDASTPFGGYKESGFGGRDKSVWAHDQYTELKTIWIDAS

SEQ ID NO: 23094 - protein, 371 aa, Pseudomonas aeruginosa UCBPP-PA14
MHIADMTMFYAPASGGVRTYLEAKHRHLWHYPGIRHSVLVPGAGYRQANGIHEVPAPPLPFGNGYRFPLRRGPWRKVLRNLQPDLIEVGDPYLTAWAALDARRRLDVPVIGFYHSDLPLLVSNRMGAWLGTNADNYVSKLYGHFDRVLAPSRVMAEKLMRLGVADVHVQPLGVDLVTFHPSNRDPGLRQELGLDEETRLLVFAGRGSREKNLPVLLDAIQRLGDGYHLLLVGSNMPTRVPRNTSVVDHFCDSREVARLLASSDALLHAGDQETFGLVALEAMASGIPVVAVRAGALAEIVPERCGVLCAPNNGDAMACAVRELFSHDVELRGQRARRHVERQHAWDAVVAGLLLHYHAVLGDSEARFPRYG

SEQ ID NO: 23095 - protein, 182 aa, Pseudomonas aeruginosa UCBPP-PA14
MIFERLKEEDGIVLKMINMGGGFPANYITKTNDLETYAEEIIRFLKEDFGDDLPEIILEPGRSLIANAGILVSEVVLVARKSRTAVERWVYADVGKFSGLIETMDESIKFPIWTEKQGEMEEVVIAGPTCDSADIMYEHYKYGLPLNLASGDRLYWLSTGAYTTSYSAVEFNGFPPLKAFYL

SEQ ID NO: 23096 - protein, 273 aa, Pseudomonas aeruginosa UCBPP-PA14
MKTLTLIDGQEVAAIGQGTWHIGEQPGERKREVAALREGIELGMTLIDTAEMYAEGGAEDVVGAAIAGRREEVFLVSKVYPHNASRKGLPAACERSLRRLGCETIDLYLLHWQGRYPLEETIEAFERLRDQGKILRWGVSNFDLGDMYELDGSACAANQVMYNLEERGIEYDLLPWCQERGMPVMAYCPVGQGGRLLRHPALGEIAARHDASSAQVALAWLLEQGVIAIPKAVTSAHIRQNAAAADLELSADDLRALDQAFPPPTRKRNLAIV

SEQ ID NO: 23097 - protein, 306 aa, Pseudomonas aeruginosa UCBPP-PA14
MVEIPLTRTRWFALACLILAMALWGSSYVVLKVAFRELPPLWVIFGRMALGSLVFLVAWRWRGRIDYRSGDWKYLLGLAVCEPCLYFLCESFALQYTSAAQAGMITALLPLLVAVGAWLLLHERIGRMTWIGFGLAVLGSIWLSLAGEPDLHAPQPLLGNFFELLAMLCATGYTLLLKHLSARYSAFALTAMQAFVGTLFFLPLALASADLPSQPSALGIQAVVYLGVVVTVGAYGLYNFGVGRLPASQASGFINLIPVFTLVFAALFLGETLNGPQMLAAGLVFIGVAISQWRSAPPPPPAGVLN

SEQ ID NO: 23098 - protein, 315 aa, Pseudomonas aeruginosa UCBPP-PA14
MSNTEERCDLSSSRDCPERREHLLQRVTARAAEIGGGITVSRLMPSRQRRMIGAWCFLDHAGPAEFEPGGGLAVGPHPHIGLQTFTWMIQGEALHRDSLGNVQVIRPGQVNLMTAGHGIAHTEESLPDERHAHAAQLWIALPYEQRDIAPAFDHHPDLPRWQEQGVTFTLLAGALDGRQAPCRLYSPLLGADLACDDASTLQLTLDPHFEYGLLPLEGGLEVGGEHFAVNELAYLGDGRDGLQLQLDPGARVLLLGGAPFGAEIFMWWNFVGHSKGEIARAQKAWEEGDARFGRLDALEGPRLSAPPIPWKIDAE

SEQ ID NO: 23099 - protein, 303 aa, Pseudomonas aeruginosa UCBPP-PA14
MRKSADAFAFQTMLLLCVIWGIQQVTIKWAATDIAPVMQAAIRSGIAAALVGLLMCWRGGWEGLRQGTLGAGLLTGTLFALEFLFIALGLQYTTASHMSVFLYTAPIFSALGLHFLLPSERLRPLQWLGVAVCFGGIAVAFGGGLSWAEMDGRMLLGDAFGLLAGMSWGATTVAVRGTRLSEAPPSLTLFYQLFVACAGLLLIALFSGQLGEVRWTPVSTASVLFQGVVVSFASYFCWFWLLRRYLANNLAIFSFMTPLFGVTFGVLLLGEPLSLNFVAGAALVLAGITLVSGEQWLRRLLRR

SEQ ID NO: 23100 - protein, 253 aa, Pseudomonas aeruginosa UCBPP-PA14
MSKLLSGQVALVTGGAAGIGRATALAFAAAGVKVVVADLDSAGGEGTVEAIRQAGGEALFIRCDVTRDAEVKALVEGCAAAYGHLDYAFNNAGIEIEQGKLADGNEAEFDAIMAVNVKGVWLCMKHQIPLMLAQGGGAIVNTASVAGLGAAPKMSIYAASKHAVIGLTKSAAIEYAKKGIRVNAVCPAVIDTDMFRRAYEADPRKAEFAAAMHPLGRVGRVEEIAAAVLYLCSDHAGFTTGIALPVDGGATAI

SEQ ID NO: 23101 - protein, 452 aa, Pseudomonas aeruginosa UCBPP-PA14
MAAGKRVQQPRRLPRGARPAGRRGRATDGDRRRQRHDRHRRAARRGRAEYQGAARTVGDRLRRYRAEPLRVSRLDHRGPVDPPARRDRRATAAATHRRARGADAAAGGGAGADPARIHRAAAGAGLNRAPGAPSLERGWNKDATMQAKVLVVGSLNMDLVVRAPRLPRGGETLAGQSFTTIPGGKGANQAVAAARLGAGVAMIGCLGDDAYGDQLYRALQAEGIDCQGVERVAGESSGVALIVVDDSSQNAIVIVAGGNGHLSPAVLARHEHLLEQAQVVVCQLESPLETVGHVLRRAHALGKTVILNPAPATRDVPADWLPLVDYLVPNETESELLCRLPVDSLESAGRAAERLREMGAGRVIVTLGAQGALLVGEGRVEHFPVARVKALDTTAAGDTFVGGFAAALARGLDEAAAIRFGQAAAAISVTRLGAQTSIPSREEVERALAGEA

SEQ ID NO: 23102 - protein, 308 aa, Pseudomonas aeruginosa UCBPP-PA14
MQAKVLVVGSLNMDLVVRAPRLPRGGETLAGQSFTTIPGGKGANQAVAAARLGAGVAMIGCLGDDAYGDQLYRALQAEGIDCQGVERVAGESSGVALIVVDDSSQNAIVIVAGGNGHLSPAVLARHEHLLEQAQVVVCQLESPLETVGHVLRRAHALGKTVILNPAPATRDVPADWLPLVDYLVPNETESELLCRLPVDSLESAGRAAERLREMGAGRVIVTLGAQGALLVGEGRVEHFPVARVKALDTTAAGDTFVGGFAAALARGLDEAAAIRFGQAAAAISVTRLGAQTSIPSREEVERALAGEA

SEQ ID NO: 23103 - protein, 637 aa, Pseudomonas aeruginosa UCBPP-PA14
MARHQPLPRALRQARPRRRDRRLRLQPELRALPRPGSQVRRHRPGPAPAGDRRRGRRMVQGAGHQRRGARWRGVHAEDGRLHQPGRPLGDPQLSGKRARRRVTRPTLRRRPRRPCTSPPRHGGTTTQESFAMIYAAPGTPGAVVTFKPRYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAEVLTGGSVEKLEGNLASGYYIQPTLLKGHNKMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDIDPLGFF

SEQ ID NO: 23104 - protein, 506 aa, Pseudomonas aeruginosa UCBPP-PA14
MIYAAPGTPGAVVTFKPRYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAEVLTGGSVEKLEGNLASGYYIQPTLLKGHNKMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDIDPLGFF

SEQ ID NO: 23105 - protein, 433 aa, Pseudomonas aeruginosa UCBPP-PA14
MRAFEDGPWKDDHALRATALEEIAAAFERHADALIDLLALENGKIKPEAAFEVGMVPGKLRYYAGLARSERGTSGTPRPDVVSLVLREPMGVAGIIVPWNSPVVLMIRSLAPALAAGTTTVVKMPGQTAQTNALVARIIAEAPSLPAGAVNIFSESGSEGARRLIDAAEVPVISFTGSSATGRAISAAGARHLKRFGLELGGKTPHLVFDDADLDAALPVLEKSLTVFAGQFCMTGSRLLVQRGVAERLRERLAQRLENLRVGPAADPRSDMGPLIDKANVERVERAVRQAIAAGARVVVRGGPVTEGELAAGAFYRPTLLEVDDPDLDIVQQETFGPVLTLQVFDREEEGVALANRSEYGLAAGVWTREVARAFRVARKIRAGTVWINDWAKVYDEFEEGGYRQSGLGRLNGVAALDDFVEYKHISLTTGAA

SEQ ID NO: 23106 - protein, 360 aa, Pseudomonas aeruginosa UCBPP-PA14
MKRRTASRPVPCALPGPSGCPPASPCSRAASASMATPRGCAGKPPAGRCGACPNSINAPCAANAPEASDREETTMSEQRQTLPAQHQDQRPGHESEMQPKPEFVSADYRPAAKLEGKVALVTGGDSGIGRAVAVAFAREKADVLLVYLDENEDAAKTREIIESLGRQCLAFAGDVADAGFCRQVVDTLRQKWGRLDVLVNNAGEQHPQARLEDISEEQWEKTFRTNIFGMFQLTKAALPLMGKGGAIINTTSITAYKGNPQLIDYSSTKGAITSFTRSLSMNLVNRGIRVNAVAPGPIWTPLIPSTFSAEKVAHFGADTPMGRPGQPEELAASYVYLACNDSSYVSGQVLHVNGGTVVNG

SEQ ID NO: 23107 - protein, 327 aa, Pseudomonas aeruginosa UCBPP-PA14
MATPRGCAGKPPAGRCGACPNSINAPCAANAPEASDREETTMSEQRQTLPAQHQDQRPGHESEMQPKPEFVSADYRPAAKLEGKVALVTGGDSGIGRAVAVAFAREKADVLLVYLDENEDAAKTREIIESLGRQCLAFAGDVADAGFCRQVVDTLRQKWGRLDVLVNNAGEQHPQARLEDISEEQWEKTFRTNIFGMFQLTKAALPLMGKGGAIINTTSITAYKGNPQLIDYSSTKGAITSFTRSLSMNLVNRGIRVNAVAPGPIWTPLIPSTFSAEKVAHFGADTPMGRPGQPEELAASYVYLACNDSSYVSGQVLHVNGGTVVNG

SEQ ID NO: 23108 - protein, 286 aa, Pseudomonas aeruginosa UCBPP-PA14
MSEQRQTLPAQHQDQRPGHESEMQPKPEFVSADYRPAAKLEGKVALVTGGDSGIGRAVAVAFAREKADVLLVYLDENEDAAKTREIIESLGRQCLAFAGDVADAGFCRQVVDTLRQKWGRLDVLVNNAGEQHPQARLEDISEEQWEKTFRTNIFGMFQLTKAALPLMGKGGAIINTTSITAYKGNPQLIDYSSTKGAITSFTRSLSMNLVNRGIRVNAVAPGPIWTPLIPSTFSAEKVAHFGADTPMGRPGQPEELAASYVYLACNDSSYVSGQVLHVNGGTVVNG

SEQ ID NO: 23109 - protein, 255 aa, Pseudomonas aeruginosa UCBPP-PA14
MQPNLARLFALDGRRALVTGASSGLGRHFAMTLAAAGVEVVVTARRQAPLQALVEAIEVAGGRAQAFALDVTCREDICRVLDAAGPLDVLVNNAGVSDSQPLLACDDQSWDRVLDTNLKGAWAVAQESARRMVAAGKGGSLINVTSILASRVAGAVGPYLAAKAGLAHLTRAMALELARYGIRVNALAPGYVMTDLNEAFLASEAGDKLRSRIPSRRFSVPADLDGALLLLASDAGRAMSGAEIVVDGGHLCSSL

SEQ ID NO: 23110 - protein, 286 aa, Pseudomonas aeruginosa UCBPP-PA14
MKKVLGIYGNANRHWVGDGFPVRSLFSYNTLGQHISPFLLLDYAGPADFPPAQQRRGVGQHPHRGFETVTIVYQGEVEHHDSTGAGGRIGPGDVQRMTAASGILHEEYHSERFRSTGGTLEMVQLWVNLPSSDKMNPPRYQTLLDADIPRVGLPDRAGELRVIAGRYGRHQGPALTHSPLAVWDVQLKAGKHLALDLPKGHTCAVVVLRGTLAVGDEIVREAQVALLDRDDPRLELEANNDVQLLVLSGEPLDEPIIGYGPFVMSSREEIDQAIEDFENGRFIRAH

SEQ ID NO: 23111 - protein, 516 aa, Pseudomonas aeruginosa UCBPP-PA14
MFFGSTALILVLTAALILYPDSAGALLGRIQAWLSHSFGWYYMLAIGAYLFFVAWVAFSRFGTLKLGEEHEKPDFSYGAWAGMLFSSGIGISLLYFAASEPIDHLYHPPEGVPGSPQAARQALQLTFLHWGLHGWAIYALVGLAVGYFAYRHRQPLALRSALYPILGERWVKGAAGHAVDCFGIFVTLLGLVTNLGIGALQVSSGLEYLTGMPHSKGTLLAVILVMSLVATLAAVSGIEKGIRRLSNLNIVLFSSLLLFVLVCGSTLELLNGFVQNLGDYLDGLVLKTFDLYVYTGAGAGKSEEWLGLWTLFYWAWWISWAPFVGMFIARISRGRSVRELVCGVLLIPLGFTLAWLSVFGNSALDLVMNHGATDLGKAALEQPSMSIYLLLEHYPLSKIVIGLSIFVGFVLFLTPADSGSVMLANLSRSGGELDEDAPNWLRILWSAVVTLVTIGLLFAGNFTAMQTVVVLAGLPFSAVLILFMFGLHKAMRADYEAQVGDRRTYQPVPAPTQHQT

SEQ ID NO: 23112 - protein, 496 aa, Pseudomonas aeruginosa UCBPP-PA14
MFELSDWQRRAATQRFIDQALIGGRQRPAASGATFDAIDPASNRLLARVAACDAADVDAAVAAARRAFDEGPWARLAPVERKRVLLRLAELMLAHREELALLDSLNMGKPVMDAWNIDVPGAAHVFAWYAESLDKLYDQVAPTAQQALATITRVPLGVIGAVVPWNFPLDMAAWKLAPALAAGNSVVLKPAEQSPFSALRLAELALEAGVPEGVLNVVPGLGEQAGKALGLHPEVDALVFTGSTEVGKYFMQYSAQSNLKQVWLECGGKSPNLVFADCRDLDLAAEKAAFGIFFNQGEVCSANSRLLVERSIHDEFVERLLAKARDWQPGDPLDPASRAGAIVDRRQTAGILAAIERAQGEGATLLGGGRQLTINGSDNFIEPTLFGDVRPDMQLAREEIFGPVLAISAFDSEDEAIRLANDSRYGLAASLWSDDLHRAHRVARRLNAGTVSVNTVDALDVAVPFGGGKQSGFGRDLSLHSFDKYTQLKTTWFQLR

SEQ ID NO: 23113 - protein, 483 aa, Pseudomonas aeruginosa UCBPP-PA14
MQLKDAKLFRQQAYVDGAWVDADNGQTIKVNNPATGEIIGSVPKMGAAETRRAIEAADKALPAWRALTAKERANKLRRWFDLMIENQDDLARLMTIEQGKPLAEAKGEIAYAASFLEWFGEEAKRIYGDTIPGHQPDKRIIVIKQPIGVTAAITPWNFPSAMITRKAGPALAAGCTMVLKPASQTPYSALALAELAERAGIPKGVFSVVTGSAGEVGGELTSNPIVRKLTFTGSTEIGRQLMAECAQDIKKVSLELGGNAPFIVFDDADLDAAVEGALISKYRNNGQTCVCANRLYVQDGVYDAFVDKLKAAVAKLNIGNGLEAGVTTGPLIDAKAVTKVEEHIADAVSKGAKVVSGGKPHALGGTFFEPTILVDVPKNALVSKDETFGPLAPVFRFKDEAEVIAMSNDTEFGLASYFYARDLARVFRVAEQLEYGMVGINTGLISNEVAPFGGIKASGLGREGSKYGIEDYLEIKYLCLGGI

SEQ ID NO: 23114 - protein, 264 aa, Pseudomonas aeruginosa UCBPP-PA14
MHSVNSIPLLSPEQERELAERLFYQQDLEAARQMVLAHLRFVVHIAKSYSGYGLAQADLIQEGNVGLMKAVKRFNPEMGVRLVSFAVHWIKAEIHEFILRNWRIVKVATTKAQRKLFFNLRSQKKRLAWLNNEEVHRVAESLGVEPREVREMESRLTGQDMAFDPAADADDESAYQSPAHYLEDHRYDPARQLEDADWSDSSSANLHEALEGLDERSRDILQQRWLSEEKATLHDLAEKYNVSAERIRQLEKNAMSKLKGRILA

SEQ ID NO: 23115 - protein, 225 aa, Pseudomonas aeruginosa UCBPP-PA14
MIVKVAEVDPICAMQACMDGFEVVSPYKNGINDGTEASIDAALLGKIDLIVTTTGNVNVCDANMLKALKKRAVVCNIGHFDNEIDTAFMRKNWAWEEVKPQVHKIHRTGKDGFDAYNDDYLILLAEGRLVNLGNATGHPSRIMDGSFANQVLAQIHLFEQKYADLPAAEKAKRLSVEVLPKKLDEEVALEMVKGFGGVVTQLTPKQAEYIGVSVEGPFKPDTYRY

SEQ ID NO: 23116 - protein, 235 aa, Pseudomonas aeruginosa UCBPP-PA14
MVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELGERMDMPEDKIRKVLKIAKEPISMETPIGDDEDSHLGDFIEDSTMQSPIEMATSESLKESTREVLAGLTAREAKVLRMRFGIDMNTDHTLEEVGKQFDVTRERIRQIEAKALRKLRHPSRSEHLRSFLDE

SEQ ID NO: 23117 - protein, 1035 aa, Pseudomonas aeruginosa UCBPP-PA14
MARWSPPAAACSAPPPSARAYPPPSNRPIAWPRRSAGTAASTARTSATVPSPASAASPDRARGRGRRTALPRPMPLPRPLGYNPAIHLRRDFAVVRLRIAIGLLVSFLLLLLGPMSPAVADDAGVSSVPLQTTATTPSANQNWRLLRDESAQLRIADVLQRKEQFRPLAKRSFIFPASPQAVWLQVQLPAQKVPSWLWIFAPRVQYLDYYLVQDGQLVRDQHTGESRPFQERPLPSRSYLFSLPVDGKPMTLYVRMTSNHPLMAWFDQIDEAGLVGLEKPAYAFGMLLGGMLLLLMYNLIRFAYSRSASSLWLAAVHAALAVCAAANLGLVAFWLPGLKFNQSLTADLGALGAAVSLLWFACSFFRGTAESRLNRLLQGEALLILAVGAIIAFTQQLWFSWLIYLLVILSSLSVPLVAAWHWYRGYQPARLIVAGMIVFNAGFMVFLPVLFGTKQLDPGWLVLGVFSFATLAGLVLSVSLTERQRLIQQLNLQQRTSEAAHTAELQTKAEFLAKISHEIRTPMNGVLGMTELLLGTPLSAKQRDYVQTIHSAGNELLTLINEILDISKLESGQIELDEVQFDLNALIEDCLDIFRVKAEQQRIELISFTQPQVPRVIGGDPTRLRQVVLSLLDNAFKQTEEGEILLVVALDDQGETPRLRIAVQDSGHPFDAKEREALLTAELHSGDFLSASKLGSHLGLIIARQLVRLMGGEFGIQSGSSQGTTLSLTLPLDPQQLENPTADLDGPLQGARLLVVDDNETCRKVLVQQCSGWGLNVSAVSSGKEALAQLRTKAHLREYFDVVLLDQDMPGMTGMQLAAKIKEDPNLNHDILLIMLTGISNAPSKIIARNAGIKRILAKPVAGYTLKATLADELAQRGVSGVTNYLQPAKEAQAPSLPSDFRILVAEDNSISTKVIRGMLNKLNLQPDTASNGQEALSAMKATQYDLVLMDCEMPVLDGFSATEQLRAWEAHEQRPHTPVVALTAHILSEHKERARLVGMDGHMAKPVELSQLRELIAYWVGERDRRRQGDALPS

SEQ ID NO: 23118 - protein, 832 aa, Pseudomonas aeruginosa UCBPP-PA14
MQYLDYYLVQDGQLVRDQHTGESRPFQERPLPSRSYLFSLPVDGKPMTLYVRMTSNHPLMAWFDQIDEAGLVGLEKPAYAFGMLLGGMLLLLMYNLIRFAYSRSASSLWLAAVHAALAVCAAANLGLVAFWLPGLKFNQSLTADLGALGAAVSLLWFACSFFRGTAESRLNRLLQGEALLILAVGAIIAFTQQLWFSWLIYLLVILSSLSVPLVAAWHWYRGYQPARLIVAGMIVFNAGFMVFLPVLFGTKQLDPGWLVLGVFSFATLAGLVLSVSLTERQRLIQQLNLQQRTSEAAHTAELQTKAEFLAKISHEIRTPMNGVLGMTELLLGTPLSAKQRDYVQTIHSAGNELLTLINEILDISKLESGQIELDEVQFDLNALIEDCLDIFRVKAEQQRIELISFTQPQVPRVIGGDPTRLRQVVLSLLDNAFKQTEEGEILLVVALDDQGETPRLRIAVQDSGHPFDAKEREALLTAELHSGDFLSASKLGSHLGLIIARQLVRLMGGEFGIQSGSSQGTTLSLTLPLDPQQLENPTADLDGPLQGARLLVVDDNETCRKVLVQQCSGWGLNVSAVSSGKEALAQLRTKAHLREYFDVVLLDQDMPGMTGMQLAAKIKEDPNLNHDILLIMLTGISNAPSKIIARNAGIKRILAKPVAGYTLKATLADELAQRGVSGVTNYLQPAKEAQAPSLPSDFRILVAEDNSISTKVIRGMLNKLNLQPDTASNGQEALSAMKATQYDLVLMDCEMPVLDGFSATEQLRAWEAHEQRPHTPVVALTAHILSEHKERARLVGMDGHMAKPVELSQLRELIAYWVGERDRRRQGDALPS

SEQ ID NO: 23119 - protein, 351 aa, Pseudomonas aeruginosa UCBPP-PA14
MFPKNAWYVACTPDELAGKPLGRRICDEPMVFYRGEDGRVAALEDFCPHRGAPLSLGFVEDGVLVCGYHGLAMGEDGRTRAMPGQRVRGFPCIRRFPVQERHGFVWVWPGAEEQADAALIPRLEWAESPDWAYGGGLYHIHCDYRLMIDNLMDLTHETYVHASSIGQKEIDEAAPTTRVEGDEVITSRHMQNVMAPPFWRMALRGNGLADDVAVDRWQICRFTPPSHVLIEVGVAHAGHGGYQAPAERKAASIVVDFITPESATSIWYFWGMARNFQAHDQALTESIREGQGKIFGEDLEMLESQQRNLLRHPRRDLLKLNIDAGGVQARRIIERLLADERQAAAPNRAQA

SEQ ID NO: 23120 - protein, 317 aa, Pseudomonas aeruginosa UCBPP-PA14
MIEVIVGAIRLEAQDIHSFELFRADGAALPSFEPGAHIDLHLPNGLVRQYSLCGPAERPRHYRIAVLRCRDSRGGSATLHAELRVGQRLRIGEPRNLFPLSPEPGPRLLFAGGIGITPLLAMAERLARDGANFQLHYCAHSAERAAFVDYLDRCAFADRVHCHFDHGDSSRRADLRALLAASPRDAQLYLCGPAGFMQWIEESARELGWEASRLHREHFAAAPRDANADGTFEVQLASNGALIRVAAGQTVLAALREAGVDLPASCEQGICGTCLTRVLDGEPEHRDLYLSEEEQAANDCFTPCCSRSRSPRLVLDL

SEQ ID NO: 23121 - protein, 166 aa, Pseudomonas aeruginosa UCBPP-PA14
MLMLTLGNGVKGFTLDRELGSFVLTHDNISVPESTAEFAINMSNQRHWEAPVKRYVEELLAGKEGPLGKNYNMRWIASMVADVHRILTRGGVFMYPRDAREPEKPGKLRLMYEANPMSFIIEQAGGAATNGTQRILDIKPENLHQRVAVFLGSKQEVERITGYHAE

SEQ ID NO: 23122 - protein, 415 aa, Pseudomonas aeruginosa UCBPP-PA14
MDTFSYRDGELFAEGVALSRIAERFGTPTYVYSRAHIEAQYRAYADALAGMPHLVCFAVKANSNLGVLNVLARLGAGFDIVSRGELERVLAAGGDPAKVVFSGVGKTRDDMRRALEVGVHCFNVESGEELERLQRVAAELGVKAPVSLRVNPDVDAQTHPYISTGLKENKFGIAIDEAEAVYARAAELDHLEVIGVDCHIGSQLTQLEPFLDALERLLGLVDRLAGKGIGIRHLDLGGGLGVRYRDEQPPLAGDYIRAIRERLHGRDLTLVFEPGRSIVANAGVLLTRVEYLKHTEHKDFAIVDAAMNDLIRPALYQAWMDVQAVRPRDAVPRRYDLVGPICETGDFLAKDRDLALAEGDLLAVRSAGAYGFVMSSNYNTRGRAAEVLVDGEQTHEVRRRETVQELYAGESLLPQ

SEQ ID NO: 23123 - protein, 682 aa, Pseudomonas aeruginosa UCBPP-PA14
MLGCFVFRLRRAIRSQGELAYMETPTTPRSTLNPPVFYTSAALILALVLFTVLLQEEAQSLFNHVQQWIITNASWFYVLAVALILISVVFLAVSRYGDIKLGPDHSRPDYRNTTWFAMLFSAGMGIGLMFFGVAEPVMHFTTPPVGEPNTVQAAKEAMKLTFFHWGLHAWAIYAIVALILAFFSYRHGLPLTLRSALYPLIGERIYGPIGHAVDIFAIIGTVFGVATSLGYGVLQINSGLHHLFGWPVNQTVQIALIAATCGLATLSVASGLDRGIRILSELNLSLAVILLLFVLVLGPTVFLLQTYVQNTGAYLSDIVNKTFNLYAYEPTDWIGGWTLLYWGWWLSWSPFVGLFIARISRGRTIREFVCGVLFVPAGFTLLWMTVFGDTAIHMVLQEGFTQLAEVVNQDSSVALFAFLEHFPLGSVISLVAVLMVVVFFVTSADSGALVVDMLASSGKDHSPLWQRIFWSVLMGVVAIALLLADGLKALQTATIASALPFSIVLLASIWGLFKALHLDATKRGIRYQALTFSRPTTRSGASEGDGWQRRLRNIAMFPRRSHVNRFITDVARPACEDVAAELRKQGYEVQVQDGEDGRVRLEVSHGGEVDFIYEVRPRAFTTPSFVMRDTEDSSESRKYFRAEVHLQEGGQDYDIMGWSRDGVIGDILDQYERHMHFLHVVR

SEQ ID NO: 23124 - protein, 488 aa, Pseudomonas aeruginosa UCBPP-PA14
MSSPSLVELKAILRLAGPLIAAQLAYVAMVFTDTVMMGKLGPDALAAGGLGAVSYAFVSTFCVGVVAAVGNLVAIRHGCDDAAGAAAAARSGLWVGAALALAAGLLLWNLRPLLLLFGQAPQTVDGAMQFLHSLTFALPGYMAFMVLRGFTSAIDRAGPVMAISVLGALANLALNYSFIEGLFGLPRLGLAGIGLVTALVMNCMPLLLALYIRRQPAYAAYSLLRGLGRPQRAMVEEILRLGLPIGGTYAVESGMFTVATLCMGIIGDHALAAHQIAIQAVYVAFMVPVGLSYATTYRIGQHFGAGRLLEARRAGRVGIGFGALCMLLFAGLFWWMPEAIIGLFLDRDAPANREVAAMAVSLLAIAAWFELFDGTQNVAMGAIRGLKDARTTFLVGLACYWLVGVPLACLLAFAAGWGAAGVWWGLAGGLACAAIGLTLAFEWKTARLLPKATASETSALNCRAAGRGAPSARRCPGNAPVPPAAAAD

SEQ ID NO: 23125 - protein, 224 aa, Petunia x hybrida
MGRGRVELKRIENKINRQVTFAKRRNGLLKKAYELSVLCDAEVALIIFSNRGKLYEFCSSSSMLKTLERYQKCNYGAPETNISTREALEISSQQEYLKLKARYEALQRSQRNLLGEDLGPLNSKELESLERQLDMSLKQIRSTRTQLMLDQLQDLQRKEHALNEANRTLKQRLMEGSTLNLQCSKMHKMWATADKQLKLREMASFILWNVNPLYKLGIKMIQLQ

SEQ ID NO: 23126 - protein, 103 aa, Homo sapiens
  unsure (1)..(103): unsure at all Xaa locations
MSGCGKGGKGLGKGGAKRHRKVLRDNIQGITKPAIRRXARRGGVKRISGLIYEETRGVLKVFLENVIRDAVTYTEHAKRKTVTAMDVVYALKRQGXTLYGFGG

SEQ ID NO: 23127 - protein, 152 aa, Onchocerca volvulus
MHCLQVVIAIVLYSFGKISAENANCKKCTPMLVDSAFKEHGIVPDVVSTAPTKLVNVSYNNLTVNLGNELTPTQVKNQPTKVSWDAEPGALYTLVMTDPDAPSRKNPVFREWHHWLIINISGQNVSSGTVLSDYWIRSTKRHRTSSLCILGL

SEQ ID NO: 23128 - protein, 130 aa, Cucurbita maxima
MVVLSQPALDLEKYSLLRSTGKPAASAADIPEIDLSDPNAKSHVVKACEEFGFFKLVNHRVPVELMTKLEDESLCFFKLSQSEKDKARPPDPLGYGSKNIGSNGDKGWIEYLLLNANPLPLFSQQSDSFL

SEQ ID NO: 23129 - protein, 321 aa, Cucurbita maxima
MAAASSFSAAFYSGIPLIDLSAPDAKQLIVKACEELGFFKVVKHGVPMELISSLESESTKFFSLPLSEKQRAGPPSPFGYGNKQIGRNGDVGWVEYLLLNTHLESNSDGFLSIFGQDPQKLRSAVNDYISAVRNMAGEILELMAEGLKIQQRNVFSKLVMDEQSDSVFRVNHYPPCPDLQALKGTNMIGFGEHTDPQIISVLRSNNTSGFQISLADGNWISVPPDHSSFFINVGDSLQVMTNGRFKSVKHRVLTNSSKSRVSMIYFGGPPLSEKIAPLASLMQGEERSLYKEFTWFEYKRSAYNSRLADNRLVPFERIAAS

SEQ ID NO: 23130 - protein, 369 aa, Oryza sativa (japonica cultivar-group)
MEQGQGDRYWCHHCEEVIEPVEPDMKCPSCDSGFVEEMGSAGFEPSTNLRSDRISLWAPLLLGMMGGSSRRARRLRRQIMEDDDDDDDDEDDEDDSDHELEDLFRRQRRGSSLVRLLQTLRDDLRGLDDIGRDSDRDRERERRERERLRERERERERMRERERERRRERTESLILINSNNEAIILQGTFGPDDNQDDSSNTSSGVSLGDYFLGPGLDILLQHLAESDLNRSGTPPAKKEAVEALPTVNIQEVLGCSVCLEDFEMGTEAKEMPCQHKFHSQCILPWLELHSSCPICRFQLPTEESKNPCESAGGIVSVNDDGDDAGTSSDVDSANQPGSPIFSALSALFSNPSSSSSSSSDDNAPHSSES

SEQ ID NO: 23131 - protein, 469 aa, Xylella fastidiosa Temecula1
MFLPRPDFRIALSICFMAVSFVISRFGSEVRPTLLLALPLVLGHVSTGLIGFVLNVIAGHHSTVTLAASTIGTALLWLPMLVPMGTLISLTVLVSQLHGAERERDIGPLFRQALWLAMLLGLVMFTFLSVVPALLPLFGIVPDIVPGAAKFLHVVRWGSLAFPLYFCMRYFCEGMHCTFPTMLLGFGGLLVLVPLSYALTYGRFGFAEYGVEGLGIATVTVMWLQAVVFALYLWRSRRFAHLQLFAHLELPCWARIRDLLNIGLPIGISILMEGGLFIVTTLLIGRFGTDEIAAHQIALSVAQLCFMIPMGVAEATTVRIGHAVGRCDLLVMRRVAWAGYAIVIGTQTLSASVLLLGYDVIVAAYTDDLVVASLASKLLLFAAIFQFPDGLQMLSSGVLRGMKDTRVPMLLAMISYWGLGMPLGLGLGFALEWNSRGMWIGLIIGLTAAALLLGWRFRVVSERMFAGIP

SEQ ID NO: 23132 - protein, 618 aa, Xylella fastidiosa Temecula1
MSNERTAQQSDIKQLISKGLEQGYLTYAEVNDHLPEDLVDPDQIEDIIGMINGMGIEVHEVAPDAETLLLNEGNTGNREVDDTAAEEAAAALSALDTEAGRTTDPVRMYMREMGTVELLTREGEIAIAKRIEEGLSEVQAALGAFPLSTELLLSEYELHKEGKRRLTEVVVGFNDLIEEDNSVTSSVDVTDESIVEVDEEDDDSVGNDEDAPMIGPDPAEVASRIESLSTEYAKFKKLYAKHGPEHKAVIKVREDVAAIFVTFKLSLPLTDLLVQQLQNMVNSVKDHERKVLHLATNVAKMPRKDFIRSWENNQTNLEWVEDAIKRKQKWSSALRDIKDQITAEQQASIDLEKVNSLTLADIKEINRMMVYGEAKASKAKKEMVEANLRLVISIAKKYTNRGLQFLDLIQEGNIGLMKAVCKFEHRRGFKFSTYATWWIRQAITRSIADQARTIRIPVHMIETINKLNRISRQMLQQFGREATPEELAKEMDMPEDKIRKVMKIAKEPISMETPIGDDEDSHLGDFIEDPNVESPVDTTTNVNLSETVREVLAGLTPREAKVLRMRFGIDMNTDHTLEEVGKQFDVTRERIRQIEAKALRKLRHPSRSEQLRSFLDID

SEQ ID NO: 23133 - protein, 304 aa, Mus musculus
FEHQTYCQRTLREIQILLRFRHENVIGIRDILRAPTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFDMELDDLPKERLKELIFQETARFQPGAPEGP

SEQ ID NO: 23134 - protein, 358 aa, Penicillium marneffei
MGGCVSSESNVDLEQKKRSQMIDRKIEEDSRRLRRECKILLLGSGESGKSTIVKQMKIIHQNGYSVEELTMYRLTVYKNLLDCAKSVIEAYEHFDIEPTSQKVRDFITYISEYNIDPDPSIPLDPKVGDAVTFIWNDPCTASVMEHQSEFYLMDSAPYFFENAKRIAASDYIPNEADVLRARTKTTGIYETRFTMGQLSIHMFDVGGQRSERKKWIHCFENVTSIIFCVALSEYDQVLLEESNQNRMMESLVLFDSVVNSRWFMRTSIILFMNKVDLFRQKLGRSPLSNYFPDYSGGNDVNRAAKYLLWRFNQVNRAHLNLYPHLTQATDTTNIRLVFAAVKETILQNALKDSGILSY

SEQ ID NO: 23135 - protein, 259 aa, Streptomyces griseoflavus
MTSPRHALVTGGSSGIGKSVARRLASAGHTVTICGRDSERLQQAAKELSEQGAPVTSLIADVSKPRQVGDLVREAVETNGPLGILVNNAGRNGGGRTAELSDELWREVLSTNLDSVFYVTREVLARGGIGEVDHARIINIASTAGKQGVLLAAPYSASKHGVVGFTKAVGKELAPQGITVNAVCPGYVETPMASRVRQAYADAWETTEAEVLSAFEAKIPLGRYSTPDEVASLVEYLTTEGAASITAQAFNVCGGLGNF

SEQ ID NO: 23136 - protein, 291 aa, Oryza sativa (japonica cultivar-group)
MAAAIDLSGEELMRALEPFIRDASGSPPVCSQFSPTSPFSFPHALAYGGGLAQQPELSPAQMHYIQARLHLQRQAAQAGPLGPRAQPMKASSSSASAAGAAATPPRPQKLYRGVRQRHWGKWVAEIRLPRNRTRLWLGTFDTAEEAALAYDQAAYRLRGDAARLNFPDNAASRGPLHASVDAKLQTLCQNIAAAKNAKKSSVSASAAATSSAPTSNCSSPSSDDASSCLESADSSPSLSPSSAATTAETPATVPEMQQLDFSEAPWDEAAAFALTKYPSYEIDWDSLLAAN

SEQ ID NO: 23137 - protein, 427 aa, Streptomyces coelicolor A3(2)
MGRTRSPNGAQSERGVVRARYPSRGETVDKPKVVLGVSGGIAAYKACELLRRLTESGHEVRVVPTASALHFVGAATWSALSGNPVSTEVWDDVHEVPHVRIGQHADLVVVAPATADMLAKAAHGLADDLLTNTLLTARCPVVFAPAMHTEMWEHPATQENVAALRRRGAVVIEPAVGRLTGVDTGKGRLPDPGEIFEVCRRVLARGVREPDLAGRHVVVSAGGTREPLDPVRFLGNRSSGKQGYALARTAAARGARVTLVAANASMPDPAGVDVVPVGTAVELREAVLRAAADADAVVMAAAVADFRPATYATGKIKKKDDQEPAPITLVRNPDILAEISQTRARSGQVVVGFAAETDDVLANGRVKLKRKGCDLLVVNEVGERKTFGSEENEAVVLGADGSETPVAHGPKEALADTVWDLVARRLE

SEQ ID NO: 23138 - protein, 112 aa, Streptomyces coelicolor A3(2)
MKLITAVVKPHRLDEIKEALQAFGVHGLTVTEASGYGRQRGHTEVYRGAEYTVDLVPKIRIEVLVEDDDAEQLIDVVVKAARTGKIGDGKVWAVPVDTAVRVRTGERGPDAL

SEQ ID NO: 23139 - protein, 642 aa, Streptomyces coelicolor A3(2)
MPLLTRITGPRDLDRLSLEELTQLAEEIRTFLVDAVSKTGGHLGPNLGVVELTLALHRVFESPKDKVLWDTGHQSYVHKLLTGRQDFSKLKMKGGLSGYPSQGESEHDVIENSHASTVLGWADGIAKANQVMERDDHVVAVIGDGALTGGMAWEALNNIAAAKDRPLVIVVNDNERSYAPTIGGLANHLATLRTTDGYERFLARTKEVLERTPVVGRPLYDTLHGAKKGLKDFIAPQGMFEDLGLKYVGPIDGHDLEALESALTRAKRFGGPVIVHCLTEKGRGYQPALQDEADRFHAVGKIHPDTGLPISTSGADWTSVFGDEMLKLGKEREDVVAITAAMLQPVGLDKFAKAFPDRVYDVGIAEQHGAVSAAGLAHGGVHPVFAVYATFLNRAFDQVLMDVALHKCGVTFVLDRAGVTGTDGASHNGMWDMSILQVVPGLRLAAPRDADQVRAQLREAVVVDDAPTVVRFSKGAVGPAVPAVGRVGGMDVLRAPGTGTPDVLLVSVGALAPMCLEVADLLNKQGISTTVVDPRWVKPVDEAMAPLAERHRVVVTVEDNSRVGGVGSAVAQALRDAGVDVPLRDFGIPPRFLDHASRAEVLAEIGLTAPDIARQVTGLVARLDGRYDRAGAEVDQVEAARD

SEQ ID NO: 23140 - protein, 304 aa, Streptomyces coelicolor A3(2)
MTSDFADALASGPLVLDGGLSNQLEAAGHDLGDALWSARLLAEDPEAITRAHLAYFEAGAEVAITSSYQATFEGFARRGIGRERAAELLALSVASAREAARRARTARPERALWVAASAGPYGAMLADGSEYRGRYGLGRGALERFHRPRLEVLAAARPDVLALETVPDTDEAAALLRAVRGLDVPAWLSYTVAGDRTRAGQPLDEAFALAADVDEVIAVGVNCCAPEDVSGAVETAARVTGKPVVAYPNSGETWDAKSRGWRGRSSYTAERVRDWRERGARLVGGCCRVGPETITSIARALPRE

SEQ ID NO: 23141 - protein, 615 aa, Saccharomyces pastorianus
MKGLSSLINRKKDRNDSHLDEIENGVNATEFNSIEMEEQGKKSDFDLSHHEYGPGSLTPNDNNEEVPDLLDEAMQDAKEADESERGMPLMTALKTYPKAAAWSLLVSTTLIQEGYDTAILGSFYALPVFQKKYGSLNSNTGDYEISASWQIGLSLCVTAGEIVGLQMTGPFVDYMGNRYTLILALILLAAFTFILYFCKGLGMIAVGQVLCGMPWGCFQCLTVSYASEICPMALRYYLTTYSNLCWTFGQLFAAGIMKNSQNKYPNSELGYKLPFALQWIWPAPLAIGIFFAPESPWWLVKKGRIDQARRSLERTLSGKGPEKELLVSMELDNIKVTIEKEKKLSDSEGSYWDCLKDSVNRRRTRIACLCWVGQTTCGTSLIGNSTYFYEKAGVGTDTAFTFSIIQYCLGIAATFLSWWASKYFGRFDLYAFGLAIQTVSLFIIGGLGCSDSHGAEMGSGSLLMVLSFFYNLGIAPVVFCLVSEIPSSRLRTKSIILARNAYNMASIVTTVLIMYQLNSEKWNWGAKSGFFWGGLCFATLVWAVIDLPETAGRTFIEINELFRLGVPARKFKSTKVDPFAAAKAAAAEINVKDPKEDLETSVVDEGRSTPSVVNK

SEQ ID NO: 23142 - protein, 603 aa, Homo sapiens
LIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMSEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSEPPPPAPGLSWGAGLKGQKVATSYESSL

SEQ ID NO: 23143 - protein, 420 aa, Homo sapiens
MPRASRVPVAASLPLSHAVIPTQLPSRSGHRPPGRPRRCPKASCLPPPVGPSSTQTAKRVTMGWPRPGQALVAVKALLVLSLLQVPAQAVVRAVLEDNSSSVDFADLPALFGVPLAPEGIRGYLMEVKPANACHPIEAPRLGNRSLGSIALIRHYDCTFDLKVLNAQRAGFEAAIVHNVHSDDLVSMTHVYEDLRGQIAIPSVFVSEAASQDLRVILGCNKSAHALLLPDDPPCHDLGCHPVLTVSWVLGCTLALVVSAFFVLNHLWLWAQACCSHRRPVKTSTCQKAQVRTFTWHNDLCAICLDEYEEGDQLKILPCSHTYHCKCIDPWFSQAPRRSCPVCKQSVAATEDSFDSTTYSFRDEDPSLPGHRPPIWAIQVQLRSRRLELLGRASPHCHCSTTSLEAEYTTVSSAPPEAPGQ

SEQ ID NO: 23144 - protein, 400 aa, Pseudomonas putida KT2440
MGCDVSRPQRITVLGATGSIGLSTLDVIARHPDRYQAFALTGYSRIDELLALCVRHRPAFAVVPSTEAAVRLRASLAAAGCTTEVLEGEAGLCQVASAAEVDAVMAAIVGAAGLRPTLAAVEAGKKVLLANKEALVMSGALFMEAVRQKGAVLLPIDSEHNAIFQCMPGDYARGLSAVGVRRILLTASGGPFRETPVEALLDVTPEQACAHPNWSMGRKISVDSASMMNKGLELIEACWLFDAVPSKVEVVVHPQSVIHSLVDYVDGSVLAQLGNPDMRTPIANALAWPERIDSGVAPLDLFAIARLDFQAPDEQRFPCLRLARQAAEAGNSAPAVLNAANEVAVQAFLERRIRFPEIAGMIEQVLDQEPVVPLPSLDAVFAADQRARELSREWLRRHGR

SEQ ID NO: 23145 - protein, 386 aa, Kitasatospora griseola
MVILGSTGSIGTQAIDVVLRNPGRFKVVALSAAGGAVELLAEQAVALGVHTVAVADPAAEEAAARGPGGQGAGRPLPRVLAGPDAATELAAAECHSVLNGITGSIGLAPTLAALRAGRVLVLANKESLIVGGPLVKAVAQPGQIVPVDSEHAALFQALAGGARAEVRKLVVTASGGPFRNRTREQLAAVTPADALAHPTWAMGPVVTINSATLVNKGLEVIEAHLLYDVPFDRIEVVVHPQSVVHSMVEFVDGSTMAQASPPDMRMPIALGLGWPDRVPDAAPGCDWTKAATWEFFPLDNEAFPAVELAREVGTLGGTAPAVFNAANEECVDAFLKGALPFTGIVDTVAKVVAEHGTPQSGTSLTVEDVLHAESWARARARELAAG

SEQ ID NO: 23146 - protein, 469 aa, Streptomyces atroolivaceus
MPSQPPADFTDFKVADLSLAAFGRKEITLAEHEMPGLMSIREEYAAAQPLAGARITGSLHMTVQTAVLIETLVALGADVRWVSCNIYSTQDHAAAAIAAAGIPVFAWKGETLEEYWWCTEQALTWPGHTGPNMILDDGGDATLLVHKGVEYRKTGILPEAENEELAVVRALLDRSGLDWTAMSSEIRGVTEETTTGVHRLYEMHRDGTLLFPAINVNDAVTKSKFDNKYGCRHSLIDGINRATDVLIGGKTAVVCGYGDVGKGCAESLRGQGARVIITEIDPICALQAAMDGYQVATLDEVVDKADIFVTTTGNKDIIMASDMAKMKHQAIVGNIGHFDNEIDMAGLAQIPGIVKDEVKPQVHTWKFPDGKVLIVLSEGRLLNLGNATGHPSFVMSNSFADQTLAQIELFTKPDEYPTDVYVLPKHLDEKVARLHLDALGVKLTTLRPEQASYIGVEVDGPYKPDHYRY

SEQ ID NO: 23147 - protein, 1372 aa, Cercospora zeae-maydis
MPTSNGGRTSPASLRSHHVRYASDSNIALRSTIMEQPEGPPELETYDSSGTNSSGNDGDEYAGTQESHSDSDGISSRHFVPGSGQAYAQDEVTPLTNVSTYGWSQPGSSNVSRTTTRGSVGSALPGTPAYEGTGTAMTNGTRRPANTRKESSNIYAPNRGPGSSMRYALNTGTRPRNGFTHMRRRNPNDEYRAQEKAYVQRIRQDGPDNDFQTEPRTPSLDYSFGSEDDEESPTNANYADHDPAEVDTLLYYGQEDLEPSVEELNIPANRERLEWHAMLANVLTGDVVKQEKKRLIGGPEQQGENTLKTEVWIGVRAKTCGRSIAAQKRLVEDGRSKVKQTIESIVAFEIKGEAEVGQSPMQQVQDVVKKIEKIEGLYPPRQAFRAAHPPAASSAYEHTCDAVIAWNNTTELIGTELGILQSWVGNMELDFTTARVRPEGEQHNELFDDSSFIDRILKEDGLKSLQGDKNLLNGVNTVIHKAKATLIANAEAFSDRHLPPYIEELLTLINFPSRLIQEIIRMRLSYAKKMKDAAQQGVMTAEQMILQFQILLQLAVKIKEQYLLIGQPEPGWDLPPCIDDNFDSVVLDALKFYFKMLNWKLMANKNTFKEAEILEQEWDFSNELGRHLDGGDVEVAEQFSSLTSKSMGRLAAPFEKELQRPADEVAGTAEMDKRYKSILDSVRVRQRKIFRFSRILSQRFENATEYNINIDNELYEDFLLALRLSGHFLVETNAESSVPTPGENEKAGGKVYILASPVLKERPKDIQSMLGTCYHAEDSPEDPSNPYVLILRPELPLVWEGDRMDASHSGKETLKVPQTLDLKTGRLRLVADGSLQRLQNANMAFTTATGNFDLTILVEQRANLCRESTKNWQRFAKLHTSSPTHSWTRSPLFALRSKPREGKAKAKNSTHPELLCFCYGIWSAFCHSHGRTTAGGQSHKLTKLALDWVSFICDDCVASDRKTFRWAVVALEFAMVMTRGQNILSISDEEYALLRSKVAGCRSLLISHFDIMGARGTVAAQAEKQRMDAMVGKLRLDIGKLKDDDESSRIVRAQWLDELEKLDQARKDREAERQALGRVLEDSNDADRALTHLSASAGNVHLRWQQGQFVGGGTFGSVYAAINLDSGHLMAVKEIRLQDPKMIPTVVSQIRDEMGVLQVLDHPNVVQYYGIEPHRDKVYIFMEYCSGGSLAGLLEHGRIEDETVVQVYALQLLEGLGYLHEASVVHRDIKPDNILLDHNGVIKFVDFGAAKVIAKQGKTMVADGPTGNGRQRSVQGTPMYMSPEVIKGGKHTGRLGAADIWSLGCVISEMATGSRPWANMDNDFAIMYNIANGNSPQMPTRDQMSDVGLDFLQAMLRTRPCEACVRCGASAT

SEQ ID NO: 23148 - protein, 198 aa, Oryza sativa (japonica cultivar-group)
MKRFAFEDSDMARVLMLMSSHGQQEQALALPVPVQLPLAAARGDRAPERAFVCKTCNRVFPSFQALGGHRASHKKPRLDGDGDFSLSKPRLHGCSICGLEFAIGQALGGHMRRHRAMTGGMPRAIVVDKKPDVVDVHVHGHDDDGGIKRGGLWLDLNHPPCDDAGDDDVECGHNAAGAGITFHQFLDTGAMAVDCVGY

SEQ ID NO: 23149 - protein, 306 aa, Populus tremula x Populus tremuloides
MVSAMDLFEKLEKVGEGTYGKVYRAREKATGKIVALKKTRLHEDDEGVPPTTLREVSILRMLSRDPHIVRLLDVKQGQNKEGKTVLYLVFEYMDTDLKKFIRSFRQTGENIPIKNVKSLMYQLCKGVAFCHGHGVLHRDLKPHNLLMDRKTMMLKIADLGLARAFTLPIKKYTHEILTLWYRSPEVLLGATHYSTAVDVWSVGCIFAELATKQALFPGDSELQQLLHIFRLLGTPNEEMWPGVSNLMNWHEYPQWKPQSLSSAVTNLDKDGLDLLSQMLQYDPSKRISAKKAMEHPYFDDLEKDHL

SEQ ID NO: 23150 - protein, 165 aa, Cicer arietinum
VHICHFMGVLHRDLKPENFLLSSKDEGATLKATDFGLSVFIEEGKVYRDMVGSAYYVAPEVLRRSYGKEIDIWSAGIILYILLSGVPPFWAETEKGIFNAILEGELDFASEPWPSISDSAKDLVRKMLNHDPKKRITSAQVLEHPWMREGGEASDKPIDSAVLSR

SEQ ID NO: 23151 - protein, 132 aa, Cicer arietinum
EANSDPNSDTHVYDLALDIGDVHKHGVMHGDLKPENFLFANKKETAALKAIDFGLSVFFTPGEKFNEIVGSPYYMAPEVLKRNYGPEVDIWSAGVILYILLCGVPPFWAETEQGVAQAIIRSVVDFKRDPWP

SEQ ID NO: 23152 - protein, 298 aa, Bos taurus
MTDAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFWRYFAGNLASGGAAGATSLCFVYPLDFARTRLAADVGKAGAEREFRGLGDCLVKIYKSDGIRGLYQGFNVSVQGIIIYRAAYFGIYDTAKGMLPDPKNTHIFISWMIAQSVTAVAGLTSYPFDTVRRRMMMQSGRKGTDIMYTGTLDCWRKIARDEGAKAFFKGAWSNVLRGMGGAFVLVLYDEIKKFT

SEQ ID NO: 23153 - protein, 298 aa, Bos taurus
MTEQAISFAKDFLAGGIAAAISKTAVAPIERVKLLLQVQHASKQIAADKQYKGIVDCIVRIPKEQGVLSFWRGNLANVIRYFPTQALNFAFKDKYKQIFLGGVDKRTQFWRYFAGNLASGGAAGATSLCFVYPLDFARTRLAADVGKSGSEREFRGLGDCLVKITKSDGIRGLYQGFNVSVQGIIIYRAAYFGIYDTAKGMLPDPKNTHIVVSWMIAQTVTAVAGVVSYPFDTVRRRMMMQSGRKGADIMYKGTVDCWRKILKDEGGKAFFKGAWSNVLRGMGGAFVLVLYDELKKVI

SEQ ID NO: 23154 - protein, 298 aa, Bos taurus
MSDQALSFLKDFLAGGVAAAISKTAVAPIERVKLLLQVQHASKQISAEKQYKGIIDCVVRIPKEQGFLSFWRGNLANVIRYFPTQALNFAFKDKYKQIFLGGVDRHKQFWRYFAGNLASGGAAGATSLCFVYPLDFARTRLAADVGKGAAQREFTGLGNCITKIFKSDGLRGLYQGFNVSVQGIIIYRAAYFGVYDTAKGMLPDPKNVHIIVSWMIAQTVTAVAGLVSYPFDTVRRRMMMQSGRKGADIMYTGTVDCWRKIAKDEGPKAFFKGAWSNVLRGMGGAFVLVLYDEIKKFV

SEQ ID NO: 23155 - protein, 298 aa, Rattus norvegicus
MGDQALSFLKDFLAGGIAAAVSKTAVAPIERVKLLLQVQHASKQISAEKQYKGIIDCVVRIPKEQGFLSFWRGNLANVIRYFPTQALNFAFKDKYKQIFLGGVDRHKQFWRYFAGNLASGGAAGATSLCFVYPLDFARTRLAADVGKGSSQREFNGLGDCLTKIFKSDGLKGLYQGFSVSVQGIIIYRAAYFGVYDTAKGMLPDPKNVHIIVSWMIAQSVTAVAGLVSYPFDTVRRRMMMQSGRKGADIMYTGTVDCWRKIAKDEGRKAFFKGAWSNVLRGMGGAFVLVLYDEIKKYV

SEQ ID NO: 23156 - protein, 347 aa, Mus musculus
MGLEEELLRIAKKLEKMVSRKKTEGALDLLKKLNSCQMSIQLLQTTRIGVAVNGVRKHCSDKEVVSLAKVLIKNWKRLLDSPRTTKGEREEREKAKKEKGLGCSDWKPEAGLSPPRKKGGGEPKTRRDSVDSRSSTTSSPKRPSLERSNSSKSKVETPTTPSSPSTPTFAPAVCLLAPCYLTGDSVRDKCVEMLSAALKAEDNFKDYGVNCDKLASEIEDHIYQELKSTDMKYRNRVRSRISNLKDPRNPGLRRNVLSGAISPELIAKMTAEEMASDELRELRNAMTQEAIREHQMAKTGGTTTDLLRCSKCKKKNCTYNQVQTRSADEPMTTFVLCNECGNRWKFC

SEQ ID NO: 23157 - protein, 405 aa, Leishmania major
MPANRDMRTGAPTQRGESRSANASKVVLTESLLATDAEKNPTSKSLYGDSAARISSNINMIHDHQRLRAYEVIFRNVRGKTLLHLGCGMGLYTMLAARGMAKMVIGVDSSAIVDAARVVAEQNGLKNILFIRGRLCDVLHQLPGGMKFDYVLCEWMGPLLLNERVLTDALYARAHLLTPSGALCPNRASLHVVAVSDYSFRLDTEDFWSNVYGFQMEPMKELVRQEVEMCAIPGSNIVSAPCLAHTVHMDTLEGLTVEETATYEAQANQAAASRDNEEENPVEHRWVPTAVAQRGYEAAFTLSITRNATVHYLTFYLDAAFTSKTNPGANFVLAVRPGGENNWTEVSVGLREPLPVNVGEKIQGTLRIYTPADKGGKITVVEVTAKTEGQVAAVETSGTYYYQSY

SEQ ID NO: 23158 - protein, 306 aa, Achromobacter xylosoxidans
MSLPLRLPETPAMKQPSTSLATSGNALALAIANPGALGTIDAYISAVNRLPVLSAERETELGRRLRDQEDLGAARELILSHLRLVVSVARQYLGYGLPHADLIQEGNVGLMKAVKRFDPERGVRLVSFAVHWIKAEIHEYIIRNWRLVKVATTKAQRKLFFNLRSMRPDGQTLDPEQVEHIARELNVRREDVSEMEVRLSGRDMSLENQDDDDDSYAPIAYLSDDGRQEPTRVLERAARDQLQGSGLSDALEALDPRSRRIVEARWLQDDGGATLHELAQEFGVSAERIRQIEAAALKKMRGNLAA

SEQ ID NO: 23159 - protein, 309 aa, Hydrogenophilus thermoluteolus
MREATTMLPQPLASGVHSTAALPAAWQGSLPSPVSSLSRYIQAVNRFPVLSEAEEHELARRFHETNDLDAARKLVLANLRYVVMIARQYFGYGLPEADLIQEGNVGLLKAVRRFDPYKGVRFITFAAYWIKAEIHDYILRNWRLVKIATTKAQKKLFFNLRKLLGSEPLTRAKADAIAETLAVKPEEVAEMHARFAGGDVALEAPIDSDEEADWRAPLAYLPDPSGTPEEAVAEAEAERLSHEGLQQALTQLDERSRAIVTRRWLTEKPATLHELAAEYGISAERVRQIEAAALKKLRVWLSPQADAVL

SEQ ID NO: 23160 - protein, 307 aa, Trypanosoma brucei brucei
MTDKKREPAPKLGFLEEFMIGGVAAGLSKTAAAPIERVKLLVQNQGEMMKQGRLDKPYNGVVDCFRRTISTEGVYPLWRGNLSNVLRYFPTQALNFAFKDKFKRMFNYKKEKDGYGKWFMGNMASGGLAGAASLCFVYSLDYVRTRLANDTKSVKGGGERQFNGIVDCYVKTWKSDGIAGLYRGFVVSCIGIVVYRGFYFGLYDTLQPMLPVDTFIVNFFLGWAVTIVAGLLSYPLDTVRRRMMMTSGAAVKYKNSMDCMLQVIKQEGAASLMRGAGANILRGIAGAGVLSGVDALKPIYVEWRRSN

SEQ ID NO: 23161 - protein, 340 aa, Lactococcus lactis
MDELSVKFGIVDDALEDLFKQIQDAGISIVDKDGNPSPLALVTDEIEKEEVSDTAMDEIVTNVRIDDPVRMYLKEIGRYPLISLDEETKLAEAIIAGGEGAEFAKQMLAEANLRLVVSIAKRYSGRGMQFLDLIQEGNMGLMKAVDKFDHTKGFKFSTYATWWIRQAITRAIADQARTIRIPVHMVETINKLIRVQRNLLQELGRDPSPEEIGKELHMAPDKVREVLKIAQEPVSLETPIGEEDDSHLGDFIEDDVIESPVDYTNRILLREQLDEVMDTLTDREENVLRMRFGLDDGRMHTLEDVGKQFKVTRERIRQIEAKAIKKLRHPRRSKPLRDFM

SEQ ID NO: 23162 - protein, 43 aa, Elaeis guineensis
KLNEACMLLLPCRHLCLCKECESKLSFCPLCQSSKFIGMEIYM

SEQ ID NO: 23163 - protein, 376 aa, Danio rerio
MATAGKVIKCRAAVAWEPKAPLVMEEIEVAPPQEGEVRIKILYTSLCHTDLFHLLESTDNKGFPTILGHEAAGVVESVGPGVTEFKPGDKVIPNSGCQCRECKFCKSPRTNLCERSWVNDHIEYMSYPKTSFTCRGKPILQFTNTGTLAEYIVIRQIYVVKIDDDAPLDRVCLLGCGVTTGYGAAVNSAGVTPGSVCAVFGLGAVGLAAVMGCKNAGASRIFAVDINEKKFEKAKVFGATDFLNPKAYNKPISEVLIEMTNGGVDFSLECVGNTEVSRLALESCAKGWGLSVLVGYTNTDFSSKPIQLIYGKTWKGTLLGGFKIKDGVPKLVLDYMSGKIMLDEFITQRMKLEQVNDVVKLMKNGECIRCILDMSK

SEQ ID NO: 23164 - protein, 324 aa, Lactobacillus reuteri
MAKKTYIKAITEGIDIALAEDPKTLVFGEDVGKNGGVFRATNGLQEKYGKDRVFSTPLAESGILGLSIGLAATGWRPVSEIQFMGFTFEAMDSIAGQMSRVRFPIGWSKNMPITIRLHTVVVSTAELHGDDLENFFVGIPGLRVVTPSSAYDAKGLVISAIENNDPVLFLENLRLYRSVKGEVPDDKYTVPLDKANVVEEGNDVTIIAYGGEVSEAQKAAKKLAKKNISAEIIDLRSLYPLDTDTIFESIKKTHRVVIVQEAQKMAGVGAQVASAISEGAIMYLDAPVIRVAAPNSVYPFPQAENVWLPGADDIEDAATQAVNY

SEQ ID NO: 23165 - protein, 337 aa, Xenopus laevis
MPLGKNVKKKIEDINMVYNIKEKLGAGAFSEVVLAQEKNSERLVALKCIPKKALRGKEAVVENEIAVLKKITHQNIVSLDDIYESPTHLYLAMELVTGGELFDRIIERGYYTEKDASQLIGQVLDAVQYLHNMGIVHRDLKPENLLYATPFEDSKIMISDFGLSKFEDSGMMATACGTPGYVAPELLEQKPYGKAVDVWAIGVISYILLCGYPPFYDENDSELFNQILKAEYEFDSPYWDDISESAKDFIRHLLEREPEKRLTCEQALQHPWICGDTALERDIHGSVSEQIQKNFARSQWKRAFNATSFLRHITKMGQSAETEEHHGEPVPEEKDKW

SEQ ID NO: 23166 - protein, 323 aa, Plasmodium falciparum
MMDNIKEAEISLRGVLEGGHSDWVTSVSTPTDPKLKTIVSASRDKKLIVWNINTDDDSGEIGTARKSLTGHSQAINDVSISSDGLFALSGSWDRSVRLWDLSLGETIRSFIGHTSDVFSVSFSPDNRQIVSASRDKTIKLWNTLAQCKYTITDQQHTDWITYVRFSPSPNQAIIVSCGWDKLVKVWNLKNCDLNKNLEGHTGVLNTVTISPDGSLCASGGKDGVAKLWDVKEGKHLYSLETGSTINSLCFSPCDYWLCAATDRFIRIWNLESKLIISEIYPVKQSKIGVPWCTSLTWSANGQLLYCGSTDGNIYVYEVKKHSV

SEQ ID NO: 23167 - protein, 872 aa, Rattus norvegicus
MCDSGELWPMTPVLRPHVAQVITCKAAIAWKTDSPLCIEEIEVSPPKAHEVRIKVIATCVCPTDINATNPKKKALFPVVLGHECAGIVESVGPGVTNFKPGDKVIPFFAPQCKKCKLCLSPLTNLCGKLRNFKYPTIDQELMEDRTSRFTCKGRSIYHFMGVSSFSQYTVVSEANLARVDDEANLERVCLIGCGFTSGYGAAINTAKVTPGSACAVFGLGCVGLSAVIGCKIAGASRIIAIDINSEKFPKAKALGATDCLNPRDLDKPVQDVITELTGGGVDFSLDCAGTAQTLGRAQERQDPCLRHRRNLKETDRINSSLHPNPVGGRAEPSERQTRLGNQKRLQSVHIQTPEENTKRHLEPWCTEAPGKSGADLPGCCRRGEDLGSTPRANLSLGTTGWKSVDSVPNLVTDYKNKKFDLDLLVTHALPFDKINDAIDLMNQGKRHLLPPPRKPAYIKPRLRRSAPPLTHAGLIPGFRYTFVPLRSLDPELADMANQVIRCKAAVAWEAGKPLSIEEIEVAPPQAHEVRIKIIATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKPILHFMGTSTFSEYTVVADISVAKIDPSAPLDKVCLLGCGISTGYGAAVNTAKVEPGSTCAVFGLGGVGLAVIMGCKVAGASRIIGIDINKDKFAKAKEFGATECINPQDFSKSIQEVLIEMTDGGVDFSFECIGNVKVMKPLSMPWPESQRSALEAAHKGWGVSVVVGVAASGEEISTRPFQLVTGRTWKGTAFGGWKSVESVPKLVSEYMSKKIKVDEFVTGNLSFDQINKAFDLMHSGNR

SEQ ID NO: 23168 - protein, 858 aa, Brassica napus
MKGVRKTYDSSYTLSFLLVFFVMFLFHPALSIHINTLSSTESLTISNNRTLVSPGNVFELGFFRTTSSSRWYLGIWYKNLPYKTYVWVANRDNPLSDSIGTLKISNMNLVLLDHSNKSVWSTNLTRGNERSPVVAELLENGNFVIRYSNNNNASGFLWQSFDFPTDTLLPEMKLGYDRKKGLNRFLTAWRNSDDPSSGEISYQLDTQRGMPEFYLLKNGVRGYRSGPWNGVRFNGIPEDQKLSYMVYNFTDNSEEAAYTFRMTDKSIYSRLIISNDEYLARLTFTPTSWEWNLFWTSPEEPECDVYKTCGSYAYCDVNTSPVCNCIQGFKPFNMQQWELRVWAGGCIRRTRLSCNGDGFTRMKNMKLPETTMAIVDRSIGRKECKKRCLSDCNCTAFANADIRNGGSGCVIWTGELEDIRNYFDDGQDLYVRLAAADLVKKRNANGKTIALIVGVCVLLLMIMFCLWKRKQKRAKTTATSIVNRQRNQDLLMNGMILSSKRQLPIENKTEELELPLIELEAVVKATENFSNCNKLGQGGFGIVYKGRLLDGQEIAVKRLSKTSVQGTGEFMNEVRLIARLQHINLVRILGCCIEADEKMLVYEYLENLSLDSYLFGNKRSSTLNWKDRFNITNGVARGLLYLHQDSRFRIIHRDMKVSNILLDKNMTPKISDFGMARIFARDETEANTRKVVGTYGYMSPEYAMDGVFSEKSDVFSFGVIVLEIVSGKRNRGFYNLNHENNLLSYVWSHWTEGRALEIVDPVIVDSLSSLPATFQPKEVLKCIQIGLLCVQERAEHRPTMSSVVWMLGSEATEIPQPTPPGYSLGRSPYENNPSSSRHCDDDESWTVNQYTCSDIDAR

SEQ ID NO: 23169 - protein, 857 aa, Brassica oleracea
MKDVRIYHHSFLLVFVVVILFHPALSIYFNILSSTATLTISSNRTLVSPGDVFELGFFKTTSSSRWYLGIWYKKLYFGSIKNYVWVANRDSPLFNAIGTLKISNMNLVLLDQSNKSVWSTNLTRGNERSPVVAELLANGNFVMRDSNNKDASGFLWQSFDYPTDTLLPEMKLGYDHKTGLNRFLTSWRSSDDPSSGEISYKLDTQSGMPEFYLLINGSPDHRSGPWNGVQFSGIPEDQKLSYMVYNFIENTEEVAYTFRMTNNSIYSRLTISSKGILERWTWTPTSFSWNLFWSLPVDLKCDLYMACGAYSYCDVNTSPECNCMQGFMPFNMQQWALRDGSGGCIRRTRLSCSSDGFTRMKKMKLPETRMAIVDPSIGLKECRKRCLSDCNCTAFANADIRNGGTGCVIWTGELEDIMTYFAADLGQDIYVRLAAADIVKKRNADGKIITLIVGVSVLLLMIMFCLWKRKQKRAKAMATTIVNRQRNQNLLMKLMTQSNKRQLSRENKTEEFELPFIELEAVVKATENFSNCNELGQGGFGIVYKGMLDGQEVAVKRLSKTSLQGIDEFMNEVRLIARLQHINLVRILGCCIEADEKILIYEYLENSSLDYFLFGKKRSSNLNWKDRFAIINGVARGLLYLHQDSRFRIIHRDMKPSNILLDKYMIPKISDFGMARIFARDETEANTENAVGTYGYMSPEYAMDGVISEKTDVFSFGVIVLEIVSGKRNRGFYQLNPENNLLSYAWSHWAEGRALEIVDPVIVDSFSSLPSTFQPKEVLKCIQIGLLCIQERAEDRPTMSSVVWMLGSEATDIPQPKPPIYCLITSYYANNPSSSRQFEDDESWTVNKYTCSVIDAR

SEQ ID NO: 23170 - protein, 381 aa, Pisum sativum
CVFDAKSVLSSSRRKHVNGSGVRCMAVKEATSETKKRSGYEIITLTSWLLQQEQKPIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 23171 - protein, 122 aa, Nicotiana alata
HGTESLPDATLQRFKFKWPFFGKSPKNSPKSSPSRSPPPKREQPSPPPPVKSPPPPSPPPPSPSPPPPSPSPPPPSPSPPPPSPPADDMAPSPSPAAAPTPPDMLLRPSARLAGNMVISGLH

SEQ ID NO: 23172 - protein, 151 aa, Nicotiana alata
MAVNSVKALVLLQLSILVISSFSELTNGDHGTESLPDATLQRFKFKWPFFGKSPKNSPKSSPSRSPPPKREQPSPPPPVKSPPPPSPSPPPPSPPPPSPSPPPPSPSPPPPSPPADDMAPSPSPAAAPTPPDMLLRPSARLAGNMVISGLH

SEQ ID NO: 23173 - protein, 154 aa, Nicotiana tabacum
AFTSVKILVLIQVSVLALSSFSELSFGKGIESSSLDKGQHHPIFSTVHLFFGKSPKKSPSSPTPVNKPSPSPPPQVKSSLPPPAKSPPPPPAKSPPPLLPPPPSQPPKQPPPPPPPPAKQPPSAKPPIKPPSPSPAAQPPATQRATPPPAMQRA

SEQ ID NO: 23174 - protein, 477 aa, Solanum tuberosum
MATAATLSPADAEKLNNLKSAVAGLNQISDNEKSGFINLVGRYLSGEAQHIDWSKIQTPTDEVVVPYDKLAPLSEDPAETKNLLDKLVVLKLNGGLGTTMGCTGPKSVIEVRNGLTFLDLIVKQIEALNAKFGCSVPLLLMNSFNTHDDTLKIVEKYANSNIDIHTFNQSQYPRLVTEDFAPLPCKGNSGKDGWYPPGHGDVFPSLMNSGKLDALLAKGKEYVFVANSDNLGAIVDLKILNHLILNKNEYCMEVTPKTLADVKGGTLISYEGKVQLLEIAQVPDEHVNEFKSIEKFKIFNTNNLWVNLSAIKRLVEADALKMEIIPNPKEVDGVKVLQLETAAGAAIKFFDRAIGANVPRSRFLPVKATSDLLLVQSDLYTLTDEGYVIRNPARSNPSNPSIELGPEFKKVANFLGRFKSIPSIIDLDSLKVTGDVWFGSGVTLEGKVTIAAKSGVKLEIPDGAVIANKDINGPEDI

SEQ ID NO: 23175 - protein, 239 aa, Antirrhinum majus
MEFPNQDSESLRKNGRGKIEIKRIENITNRQVTFCKRRNGLLKKAYELSVLCDAEVALVVFSSRGRLYEYANNSVRATIERYKKASADSSNSVSTSEANTQFYQQEANKLRRQIREIQTSNRQMLGEGVSNMALKDLKSTEAKVEKAISRIRSKKNELLFAEIEHMQKRELELHNANMFLRAKIAEGERAQQQMNLMPGSDYQPMTSQSYDVRNFLPMNLMEPNQQQYSRHDQTALQLV

SEQ ID NO: 23176 - protein, 761 aa, Hordeum vulgare
MAILGELGTEILIPVCGVIGIVFAVAQWFIVSKVKVTPGALRRRRAKNGYGDYLIEEEEGLNDHNVVVKCAEIQTAISEGATSFLFTMYQYVGMFMVVFAAIIFLFLGSIEGFSTKGQPCTYSKGTCKPALYTALFSTASFLLGAITSLVSGFLGMKIATYANARTTLEARKGVGKAFITAFRSGAVMGFLLSSSGLVVLYITINVFKMYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTAMCYPLLVSSVGIIVCLLTTLFATDFFEIKAANEIEPALKKQLIISTALMTVGVAVISWLALPAKFTIFNFGAQKEVSNWGLFFCVAVGLWAGLIIGFVTEYYTSNAYSPVQDVADSCRTGAATNVIFGLALGYKSVIIPIFAIAVSIYVSFSIAAMYGIAMAALGMLSTMATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGNSEHARSLGPKGSDCHKAAVIGDTIGDPLKDTSGPSLNILIKLMAVESLVFAPFFATYGGLLFKYI

SEQ ID NO: 23177 - protein, 248 aa, Zea mays
MAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLHDNLTLWTSDISEDPAEEIREAPKHDLSEGQ

SEQ ID NO: 23178 - protein, 858 aa, Saccharomyces cerevisiae; identical to SEQ ID NO: 856

SEQ ID NO: 23179 - protein, 429 aa, Candida albicans
MGCGASVPVDDDEIDPFLQDKRINDAIEQSLQLRQQNSKKGVKLLLLGAGESGKSTVLKQLKLLHKGGFTQQERRQYSHVIWCDVIQSMKVLIIQARKLKIKLDCDQPNNSLIPYKQIILRSDPLKQIDASVAGGTDFLNDFVVKYSEENKNKRRLKSTGTTDIWGKDDDSNINSDAINQALELSLNKDSEQFTRLSIAEAIHKLWKLDSGIKKCFDRSNEFQLEGSADYYFDNVVNFADTNYLSTDLDILKGRIKTTGITETDFLIKSFQFKVLDAGGQRSVRKKWIHCFEDITAVLFVLAISEYDQNLFEDERVNRMHESIVLFDSLCNSKWFANTPFILFLNKIDIFENKIKKNPLKNYFPDYDGKPDDTNEAIKFFETNFLKINQTNKPIYVHRTCATDSKSMKFVLSAVTDMIVQQNLKKSGIM

SEQ ID NO: 23180 - protein, 437 aa, Leishmania donovani
MADYKVKDISLAEWGRKAIELAENEMPGLMELRREYGPSQPLKGAKIAGCLHMTVQTAVLIETLKALGADVRWSSCNIFSTQDNAAAAIAKAGVPVFAWKGETDEEYEWCIAQTVKGFSGDGLPNMILDDGGDLTNLVIDHHPELVPKIFGISEETTTGVKNLYKRLSKGNLPMCAINVNDSVTKSKFDNLYGCRESLVDGMKRATDVMIAGKTCCVCGYGDVGKGCAAALRAFGARVVVTEVDPINALQASMEGYQVALVEDVMADAHIFVTTTGNDDIITSEHFPHMRDDAIVCNIGHFDTEIQVGWLEANAKEHVEIKPQVDFYTMENGRHIILLAKGRLVNLGCASGHPSFVMSNSFTNQVLAQIELWSNRDNGKYPRGDKAGVFFLPKALDEKVAALHLAHVGAKLTKLTPKQAEYINCPVNGPFKPDHYRY

SEQ ID NO: 23181 - protein, 483 aa, Acinetobacter sp. ADP1
MQHVQLLIDGQSVDAANQATFERISPIDGHVASVAAAATLEDVDRALESASRAFQIWSKVSPTERRLRLLKAADLMDQNTEKFIEIGMRETGSTATWYGFNVHLAANMLREAAAMTTQIDGSLIPSDVPGNLAMGIRVPCGVVVGIAPWNAPVILPTRALAMPLACGNTVVLKASEACPATHRLIGAILNEAGLGEGVVNVITHAPQDAPQVVERLIEHPAVKRINFTGSTKVGKIIAETAAKHLKPVLLELGGKAPVVILNDADLDEAVNAVAFGAFFNQGQICMSTERVLVQDGIADRFIEKLIQKTASLKAGNPTQQGSMLGVLESRRAAERIQHLLEDAQQKGANLPLGIQIQDTLMQPTLVLDIQPEMLLYREESFGPVCTVQRFASIEDGVRLANDSEFGLSSAVFSQNFGLAMDVAKQIDSGICHINGATVHDEAQMPFGGTKSSGYGRFGSKASIAEFTELRWITVQTQPRHYPI

SEQ ID NO: 23182 - protein, 414 aa, Bigelowiella natans
DSSLLLAKPSPSSSSRCAKISIAVNVALATIGFIAVASNGAPTQLAQPVRAANPTTFSAHSMAGISHMGMSAMRRPQQQFNFAPMNRGARHSMKMQAVESSVATEQSTTIEEFLANTEPKLQKAIMGMFSACKEIGYKIRTASCDKQACFNAFGDEQLAIDVLADNVIFENLRASGAVATASSEEEPTEVPLGGEGYSVAFDPLDGSSIIDTNFAVGTIFGNLGLDPRLTGIKGTEQKAAGLGVYGPRTTITLAVDGIQGAHEFLLIDDYSAKHGQWVLSQSFMSIGESKLFAPGNLRATKDNKGYEELFNYWYDNQYQLRYTGGMVPDVNQIMVKGKGVFVNAESKAAKAKLRLLYEVAPIGYVIEKAGGKSSDGEQSVLNIEVVGTEDRTQVAYGSAAEVDRFEQMVGKKYL

SEQ ID NO: 23183 - protein, 420 aa, Bigelowiella natans
MNVVLGLTMAAVLFRGGVLSSTMTAARTFAAPSVHTRGMHMSVKSSNPFSQAGRRAAVRSSVAPSPVQDSAGTIVDDGTVTLTRFMIEEAMKSKTPGQEDMVRLISSISVACKRIASMVQTAGISGSTGLAEGGGSVNVQGEEQKKLDVISNDVLKSALRPSGKLGVIASEEEDNPVVVDELYSGEYVATFDPLDGSSNIDAAISTGTIFGVFKAPEECLIGDSDNLSIAEQQCLEATLQPGTNLVAAGYCMYSSSTILVLTTGDGLNGFTLDPSIGEFILTHPNIQIPSRGKIYSMNEANYFDWDPKLQTYVDNLKKAEGQTGEKYSSRYIGSMVGDVHRTLLYGGIFAYPGDKKNVNGKLRLLYEAAPMSLIFEQAGGKSITGPGGRVLDLVPDKVHQRCPVFIGSPDDVDEVEKALA

SEQ ID NO: 23184 - protein, 856 aa, Magnaporthe grisea
MNPGPAPRPPTDRPRLNLTPSQNLPGNMANMSLNSPGMGRGQFGGGSSVYGGSTISLPLSRAASNTDGLGGVAVIKEGWAQVKESKNFINPWKQKYLILRKEALDFHKQEGSKSSYTLYLKDVINVGRVEAAGTIFEVKRQSNGTSTSPGEDDGTVRTLQIKVKSDDDLYEWIDFIYARCPGMGGVSNPTNFSHAVHVGFDPQTGEFVGLPPEWSKLLNSSAITKEDYERNPQAVFEVLDFYSDLTKRNDNPAQYSSLTPTPPAGAMPNKQLGYSTGANVAPPRQMQQQQQPMQRTNNYPNMSGGGLPPNASGARGPSPPDPQQQQRQQMQNMSSNYINQGDPNRDAERQRQAEAAQRQRMMEIEEQNRRDLEAYNASIPQTKKPIAQQEIGGYGGAPSSSADRFNPNRAPPPAPKPTAQQSNLQAQRPAPRAPNAAGGPRPGISQQNSSQNVRDPASQQQQRVPPRNDQSPNAQRYPNGGPAPQPRTNGQPQNQQPSRLPAPVKPLNVAPKPAAQSDAVRAAEAALTAKPPAQERQKDVRMSTMSETEVMAKLKEAVSKDDPNLSYSKQKKIGQGASGSVYVAKVKETAVSPIARELLREQGSRAQVAIKQMDLAHQPRKELIVNEIMVMKDSTHRNIVNYLDAFLRNNYSELWVVMEYMEGGALTDVIDNNPVITEEQISTICLETCQGLQHLHSQSIIHRDIKSDNVLLDARGNVKITDFGFCAKLTESKSKRATMVGTPYWMAPEVVKQKEYGPKVDIWSLGIMAIEMIESEPPYLNEEPLKALYLIATNGTPRLKNPAKLSKELKAFLSVCLCVDVKSRASAKELLEHDFLKHGCPLGSLSDLLAFKKHAK

SEQ ID NO: 23185 - protein, 564 aa, Oryza sativa (japonica cultivar-group)
MACLAPHFKWAPCPHAHHHHSTSSLPSSSSSSTSAPSSSSRCSFSRGGPFRVHCAVTATTSAAAPVVVEAPGGGMRLAYAAAPDSSAPALQKKIQSALASEVFLNEEAVVTAAAAEAVALARAAAEAAQEVVRMVQNNKNERNTRPKKAVVNYLANEILRTEMKPNILDKYSDGILSEEIESYGILSDEAELDGDTQDIPSIAVKSARQTEGRARRTRAAIKAATIVRTSPKPATSSKKKRSKGASSGTNPLGSLWKMTGRRLLTAKEEVEFSEGIQDLLKLEAIQAELAEYNGGQPTFAQWATAAGVDERTLRKRLDHGIYCKNRMVTSNVRLVISIAREFEGPGMELYDLIQEGMQGLIRGAEKFDASKGFRFSTYSHWWIKQAMRKSVSEQSQIFRLPAHMVEASYRVKECIKRLRRKLKRRPTNEEIAADTGMPIKRVEAAVNLPKYSVSLDSKIGSTDMTYQEVTADPTAETAEEMLNRLSMKRDVHKALDTLTTRERQVVTLRFGLEDGRIRTLQEIGNTMGVSRERIRQIESAAFRKLRSKKRVNALKDYLVPVGNW

SEQ ID NO: 23186 - protein, 240 aa, Oryza sativa (japonica cultivar-group)
MASAADEGNAAAPRAAVSHVIFDMDGLLLDTEGFYTEVQEKILARYGKVFDWSLKAKMMGKKATESARIFVDECGLDGLLTPEQFLEERESMLQELFPSCAVLPGVLRLIHHLHANGVPMAVATGSHKRHFALKTQNHKEMFTLMHHVVMGDDPDVKTGKPSPDIFLAAMRRFEGNIEPSNCLVFEDAPSGVAAAKNAGMYAVMVPDSRLDVSYHKGADQVLSSLLDFKPGEWGLPPFTD

SEQ ID NO: 23187 - protein, 323 aa, Oryza sativa (japonica cultivar-group)
MQRICPAHCSVTHSLTMKSMRLSYIPPAASAAPQSPSYGRKKNASAAPPSAAASTTVLTSPLVTTTRTPKQTEQEDEQLVAKTKTTRTVIATTNGRAAPSQSRPRRRPAPAAAASAASLPMTFCNALEEVINTFIDPPALRPAVDPRNVLTSNFVPVDELPPTPCPVVRGAIPRCLAGGAYIRNGPNPQHLPRGPHHLFDGDGMLHSLLLPSPASSGDDPVLCSRYVQTYKYLVERDAGAPVLPNVFSGFHGVAGMARGAVVAARVLTGQMNPLEGVGLANTSLAYFAGRLYALGESDLPYAVRVHPDTGEVTTHGRCDFGGR

SEQ ID NO: 23188 - protein, 470 aa, Petunia x hybrida
MNVMRRLKSITSGRSSISDPGGDSSIKRVKVEQEIERVVGDTQMDDRCTTTAPKEDMASTSKDTTTASTSTMDTRPENSEVDELPKELHEMKIKDERTDSHEDNLKDMEPAVVSGNGAETGQIIVTTVSGRNGQQKQTLSYMAERVVGTGSFGVVFQAKCLETGESVAIKKVLQDRRYKNRELQIMRTLDHPNVVKLRHCFYSTTEKNEVYLNLVLEYVSETVYRVSRHYSRMNQHMPIIYVQLYTYQICRALNYMHSVLHVCHRDIKPQNLLVNPHTHQLKLCDFGSAKMLVPGEPNISYICSRYYRAPELIFGATEYTTAIDMWSAGCVMAELLLGQPLFPGESGVDQLVEIIKILGTPTREEIRCMNPNYTEFKFPQIKAHPWHKIFQKKMPPEAVDLVSRLLQYSPTLRCTALEACAHPFFDALREPNACLPNGRPLPHLFNFTAQELSGAPADLRKRLMPEHMRK

SEQ ID NO: 23189 - protein, 102 aa, Heterosigma akashiwo
SGRGKGGKGLGKGGAKRHRRVLRDNIQGITKPAIRRLARRGGVKRISGLIYEETRGVLKVFLENVIRDAVTYTEHARRKTVTAMDVVYALKRQGRTLYGFGG

SEQ ID NO: 23190 - protein, 67 aa, Heterosigma akashiwo
  unsure (1)..(67): unsure at all Xaa locations
AGAPVYLAAXXXYLTAEILXLAGNAARDNKKSRIIPRHVQLAVXXXXXLNKLLGNVTIAQGGVLPNI
